United States Patent 6,812,339 (POLYMORPHISMS IN KNOWN GENES ASSOCIATED WITH HUMAN DISEASE, METHODS OF DETECTION AND USES THEREOF) - sequence listing, part 23

SEQ ID NO: 12707 - DNA, 190078 bp, Human
  misc_feature (1)...(190078): n = A,T,C or G
catgctggatgtccccagcggggagatcagatgaggtcccttagaagtcaacaggacctcaagcccccatgtgctagctgagggcgtccctcttctacacccaagcctccctgggtgctgggtctctgggtcctgtgggctcaggggcccatatttctcaagttctgctctgtgtccagctgagggcactgaccccactgccacagtccccagtgctcagatgccagggaggtagagggctgtgtgccagggcacagccaaggcatcctccactgctctgggccacaggtgggcagctgagccccacatcccactaacaccaggtcctgggatttctggctctgcccattttttctctcagcctccattccaaccacgtggatcagcaaggaggagcaccatgctgtcccttcacctttgtccatcctccttttctccccgtcatcttctgcagaggagatcccaataggagcccctcacagagttatgaagggcaaatgggataactcaagtaaagtgcaaagcaggtacacagtagtgctcaagaaatgggagccactactacatcttcatcatcaccatcaggacaggcacacggtagtgagtgctcaagaaatggaagctgttactgcatcttcatcatcaccatcaggataggcacacagcagtgctcaagaaatggaagccagtactaccatcttcatcatcaccaacacgacaggcacacagtgagtgctcaagaaatggaagccattactgccatcttcatcagcacaatcaaccagagaaagagcccactatgtttgagaaaagcatttatatgttgataaaaatttccttgttatatttatcatttacagtcagtagtaagaacattaaaaagttaaaatataggtgccagatgttagtttcattcctgtgaatttattgaaataacagacaagtaaatacaattctatttgtcagtgaaaaatattttttaaaatcttgtcaagtgtaaattttactaatagggtaagtcctcacctaatgtcattaacagattcttggaaactgcaactttaagtgaaacaatgtactacaacaccgatgttaccataggctaatggatattaactagagttaagtttctacaggcatatttctggccacaaaaacatcaccaaactttttttttttttttttttgagatggagtctcgctctgttgcccaggctggagtgcagtggcgcaatcttggctcactgcaagctccgtctcccgggttcacgccgttttcctgcctcagcctcccgagtagctgggactacaagcacctgccaccacgcccagctaattttttctatttttagtagagacggtgtttcactgtgttagccacgatggtctcgatctcccgacctcgtgatccgcccccctcagcctcccaaagtgctgggattacaggcgtgagccaccgcgcccggccaaacatcactaaacttctaaatgaagaccaaaacatttctagtattaaacattgaaataaatgtgagctatacatacacttaagaaagattaataaaaacaagtaagataatcattaacccagtaattccaattcagggttgcaggtggccacagcctatcctggcagctcagggcacaaggcaataaaccacactggacaggatgccatcccctcacagagcacactcacacccacacccacactcactcagatggggccattttatttattttttttgaaacagagtccctctctgtcacccaggctggtgagcagtggcgtgatcacagctcactgcagtcttgacctcccaggctcaggtgatccacccacctcagcctcccaagtagctgggactacaggggtgcaccactaccccccgataatttttgtattctttggagagatagggtttcaccatgttgcccaggctggtcttgaacccttgggctcaagtgatcctccctccttggtttcccaaagggctgggattacaggtgtaagccaccacacctggcccagactgggcccatttagacatgccaattcacttgatgtgcacatcctgggaatatgagaggaaaccagagagccagagaaaacccatgaacacatggggagaatgtacagactgcacccagatgatggccttggctgggaattgatttttctttttctcaccaacattataatgaaacattttagtattattccaggacctgctgtacagtaactttaaaggactgaagagcagaaaactgacatttattgactgtctactatttccaagagctaccattcccagccactttttaatcatcaccacaactttataaggcagggattattagccccgttgttggagagaggctcagagaagtgaagtgacttgtccaaggtcacacagcaagtgagatgaccagaacttaaacctaggtctgtctgagttcagcccttcacaaatcaccatgctgcctccctctcttcaaaacataaagcaaacaaataaaacaattcactatttgcctgggaaattgttggcaagagcaagacaggattggaggaaaatgtattcccagacatactgtaaacctcctgactccactggacaacttcttttggggcctgagagcaacagttgctgggattcccttcatccaccacagcatcaggtgtgggccagggtctggttgctgaagggtccagccagaggtcccaaccatcccatgtctgtgccacccctggtgcaagggacagtagattctcccaggcaggagcagagaaccactgggactaacatgcaggcaccggagaaatggattgtgtgtgtgtgtgtgtctgctctgtgtgtgtgtatatatatacacacatatatgtgtatatatacgtatatatacacatatgtatacacacatatatatacacacatatgtatatatacacatatatgtatacatatatgtatatatgtgtgtgtatgtgtgtgtgtgtgtatatatatgtctgtttttctccctcttttcctccatcctctctctctctccattccttcttagccctgtccctgaccctgtccttctgcctccctctctatcttcctctccctctccctcttggttctctcccttctcactctccccttgaattgctcccccatctctgcttctctctctacttgctgctccatctttcccaaatgtcctcccagtgtccagggcagatgtcaccactcagttccctagcttacataccctcacacaccattcctgcacagacagaccagcattcataaatcctaagtcttagttcccgggagagaagcaagagtgggcccaatgcgggtcaagggtccaccccaggtcttctcggccatgccaaaaattcagctgcctccaggagactctccatcaccttctccttcttctcctccttcccatcacattccaatgaactccacgacctgcacaggatgaaggcaggtcaggacctgtgttttgtctaggctcgaagcctggttaggccctagctcagtgcgtggactatggagccagaccacatgggttcaaatcccacttcagcaacttacaagtcggtgacctgggccagggggttaatcctttgagtgtctcagctcctccatctgcaaaacagagataagaacagtgccccctcctcagagctgttgtgaggataaaatgcagatgagtatatgcgaggaactcaaaacagcgcccagcacacagaaaaccctgtgttgtcgatcaccatcatctttacatgatgacagaggcagagcccaggcagcccctcaagaggccagtcaataccctccaggaacacatgtgcagtggagcaagttgggtttattactccttgcagggacaaaaagcatgcaccatgggggaactgtggggtgtcagttttaggttggtcatttggggctaggtgtcagtaagcagtggctccatagtgattggatgctgccagaatgtggggacaattatacaattaagtgtctcagcacattgtacgtaaggggaggctcactcgagtgagaataaagttctgactggtaaagaagcagcagccagccagccctccacaaggaacaaagatattggaattttggaagctgcacaggaaccttgtttttatttcacattttatcacagtctcagagtaccttgtctaatgttgatgttccgtgaggttacttatctccaataaagcgacaatgataatggcctgtttctggtcatcagacccatttctggatgtcaggggctgattttctttctcaggcctcatcattcacacatattcattcaaaaaccattgaataagcacctcccagatgccaggcctgcagcaggcactggggatacagtggtgcataagtggggcccctgggggctctcagcctagaggggaagcagggacaggaggggtgacagaaaaaggcggagtgacagaaaagcacatggagtggaaagacatcagccagtgaggaggtgggggcagcccatgacatgtgaagctgcagagccaggccagggctagaactccaggcccagtagactatgctgaaagcttttcatagcatgtggcttacaaacacacacacacacacatgcacacacaaacacacacatgcacacacgacataaaagagataagaaaagcattcaataattttgagtatacaatttttgggccaggcatggatggttcacacctgtaatcccagtgctttgggaggcagaggtaggaagatcacttgaggtcaggagtctgagaacagcctgggcaacacggcaagatcctgtctctactaaaaaaatttttttttaattatccaagcatggtggcacacccttgtagtcctagctactcaggaggctgaagtgggaagatcacttcagcccaggagtttggggttacagtgagctatgatggtgccaccacacttcagattgtgtgatacagcaacaccctgtcttttaaaacaaaagcaaaaacaaaaccacaatatgatattcttatactgtgtagatcataaaaactatgacatagatatacaattgaccttgcacggtgcaggggttggagcaccaacaccccgtgcagctgaaaatcctcatacaatgtttgactatgtttttggaaatgtaacagctaatagcctactattgactggaagcctattgataatataaacaatcgattaacacatattttgtatgttatatgtattagatactgtattcttacaataaagtaagctagaaaaaagaaaacattaaaatcataaggaagaaaaaatatatttactattcattaagtggaaatggatcatcataaaggtgtactaacataatctaaaatgtattgtttaaaaatagattatcaaagagcatgtataaaatactccagattttttaaaatatgaatatacataccactaatgcccaagtcaatgggaattacattggaatgtacataccactaatgcccgaatcaattttcccagtgcaaaaattaaaaaaaaaatatgtcccagtgagtgaacagaaatgctggggttgtccagattatataagcttttagggaaaacaaatatgtacttataatactagtttagatgcaactatctatctatatgatatattttatgagtattgctggtttctttcacattagaaaacatttttttttttttgaagcagagtttcactctgttgcccaggctggagtacagtgtagcgatctcagctcactgcaacctccacctcctggggtcaagcaattctcctgcctcagcctcccaagtagctgggattacaggcacacgccaccataccggctaatttttgtatttttagtagagacggggtttcatcatgttggccaggctggtctcgaactcctgacctcaggtgatccacctgcctcggcatcccaaacacctgggattacaggcgtgagccaccgcacccagcaggaaaacaatttagttttttcacagagacagccaaccatcttttattcatttattcatttttaatttcaacttttattttagatacagggggcatatgtgcagattgtgacatgggtacattgcacccaggtattgaggctagtacccaactggtactttttcaacccccatccccctccttccctccctccctccccgctctagtagtctgcagtatccattgttcccatgtttatgtccacagatgctccatgtttagctcccacttataagtgagaacatgtggtatttggttagaaaacaatttttttaactcaaattcttcacaagcatctccaacagtaatgcctttctcttctctaaagcgagtttggcatcttcaaagccaagttttccagggcttcacatcttttctttcatctaagcggagggagaaacagaagccttgaatcaggaaactcttgaccacagcgagggattcatgtggcattaggacatttctaaattaatcctttaagtgtgaaacctccacaatatcaatgtgagattcttcttttaagtaactgtaaaaacactgtatacatccccatccatgcatgtaagtgtaaggtcatcttccaaggaataattgctaagtctgagtccaatttctttaccacttgttttcctggtttcctgggacacctctttaggtcccagtattcatgttaatagaggtcctttaaagcccatgcatcttctctaaacttccttttgcaattcaaaatgaagttgagagaaacccttaccccatgaacaactttttaaggactcattctctctttcctatgggataatggggagggggctcatgtagacataagacatgaatgaggcctactcaaatacaaatggtaagggtcccttggtttggggattatttttgtggaatggtttcatttagttcatttcgtgcatctgcaatttctacactttctactaagaacattcattgcttacttaataaaggaaaaaaaaacaacaaataatggttgtatttgccatttcttttagaaaatagttagtctcaggctccaggacccctcaggctcagcccaagcttcccatccctgaccccaggcagtcagcacctcctgatctcagtgagaggtgaagccacctggacttcctgggtggagtggggacttggagaacttttctgtctagttagaggattgtaaatgcaccaatcagcactctgtgtctagctaaaggtttgtaaacgcaccaatcagcactctgtaaaaacacaccaatcagcgctgtgtctagctaaaggtttgtaaacgcaccaatcagcactctgtaaaaacacaccaatcaacaccctgtggtctagctaaaagtttgtaaacgcaccaatcagcactctgtaaaaacacaccaatcagcactctatgtctagctaaaggtttgtaaacgcaccaatcagcactctgtaaaaacacaccaatcagcaccctgtggtctagctaaaggtttgtaaatgcaccaatcagcactctgtaaaacagaccaatcagcactctttaaatggacgaatcagcgctctgtaaaatggagcaatcagcaggacgtgggtggggccaaataagggaataaaagctggccacccgagccagcccggcaacccacttgggtccccttccacgctgtggaagctttgttctttcactcttcacagtaaatcttgctgctgctcactgtttgggtctgcactacctttatgagctataacactcaccgcagggtctgtggtttcattcctgaagtctgcgagaccacgaacccaccgggagaaacaaacaactctggatgcctcacctttaagagctataacactcactgtgaaggtctgcgacttcactcctgaactcagcgagaccacgaacccactggaaggaagaaactccggatacatctgaacatctgaaggaacaaactccggacacaccatctttaagaactgtaacactcaccacgagggtccgtggcttcattctagaagtcagcagaccaagaacccaccagaaggaaccaattccggacacaccaggggcagatattacactatctagttcatgtagggggcaatgtctcctcatgcagcaggaaatggggaatgatggaggcccgttccaggacatgctaggaaattcccaaggaagtgggggctatgcccagggaggttgcataatcttgagcaaatcacttacacatacatcttcgcccattctccaagcaagctttgctttacaggacccctggcagccatttttcctagcagccttaaacagaggaaattccagctcagaaaactcaaatttcaatttttgaacatgaaaatagcaggaaggacctggaaggccacttacagcagcccaaagagtgaggaagttagatgctgcctggaggacttcccagccctctcctcagcccaaggagaagaggataaatccctctctgccccacactgtctccttccctgtcagcagaggaaagcctgctggagaaagaatggaaggtgccccttacagggctgggcagaagcagagaggatttattccaaggggtagcctcgtcctgcagaaatggagccctccagggatctggatagactcctggggacaggctagtgccttcttagagtgcagcctttaaccctagggggactgggaggaggaagtgcaagatgcctggcaggttctgcgcttccaggatgagctgcttccaaaccatgaaaacatatcatcatttgaaagggatgtggggcttcaaggcttgtagatggaatacatatgacaaccataacataaagagccacatgaatgtatatgactgttaggctttcacatattactcgagttggtaagatacacctcttattagactgaaaagtgtggcataaatattctaatccccagaacaaccacctaaaaataattccatacacattcaagacaaaatggataaaatgaaaagtcctatgtcaaggagataagactaatgcaaccaaaaccatctacatacaggttatgggtgaataaacatccacccagaagttttcatttctcttgggcaaatacatggaacaggattgctgggttataagggaagcatgtctctctccacctgtcctccccaccacaagagaccccgtcagaatctgtttagcccttgaggggctcttcccaattccgctggagaaagggcaggacatctcgagggtgctgaccccaaagctgccacctgatggcgcagcagttctcgccctcctagcccaagggatccccgtcctacgccgtcccctgtcagcgctggggccccagtgcgggagggccagctgcatttccccatgagcctgtctccctcataccaaacaccctccaccggcagctgccccctgtgcacattcctagggtgatctctgccccctccctttcctccccggtgcgccttccttgcgggttccatgagcatgcgcgcccattcttggctcacacattccaaaggtgcatcccagcaacaggcccaacagtgcaggatgagcctttggctgagttggcagccaaggagaactcgccaacctcgctgtgctgccaagacctgacttgacactactgctcccctttgcccgttacccgtgaaagctttgctccacagcgccccctgcagggggctggtagggcagctggctgcctgcccttggcccgttccttggctgccccggcttctgcacttacccttggtcctggaccaactccaagaattcagtgactttacactggcttttcttagagcctcttggagacaacatcctaagatactgcagaccctgtgttttgtttttggttttgaaggccctctgagggccctcaaatggaccctgaggaaatggatacctgagcaggacaaggaccttggagtcacagaggttctcgataattagagaaaggggcctgatgatactgggggtgcacagatcacatttaggtccttgagggtcaatggaggcctctcttctgtcgtgcccaagtctgggcctctgcagagagacctccatgcccagaaatcagaagtcagattgaacaagaaatcccagcctttctaggtgagctcctgcccccaaaatgctgtctccagctcacacagcaccacaggaggtttcccgccactgaagaggaggagggggccagcctcattcctctcccggctgcccctccggagctcaaagacagtgagtgaggagggaccctggtctccctctttggctacagaggtttcccagaggaagatctggagtgaaaaggcagcagatgcaacacaagggcagaaactcacctccaagaatggctccctcgcatccacagtactggccccttcgatgcaagtttcctctgctgccatgcaggcgaggggagcctctgacgctgtacctccctcccagctggggttccgactcacggctgaagacctggacctggagaaggaaacagtgctgctatgcatcaaaagtgcattgtggggtgaggccaaggccatccgggactggggagccttgcagccttcccatattttgccaccacctgcggcagcaatggctcctctgcccactgcctctccagaccccctccaccctctgggactaatgcacaggaggagggacgcaggacgcaagactgcccaggcccagtagccctcctggaatctgctgcagtggctacctctatgcctcctgtgtctgggaggaagcacagctcaccagggcccctgttctcccccttagagctccatccagtcacctcttcatacttcctggtctcagccttgctgaccctgctccctcctcatcatcaggcagatacagagcactgcagcaaaaaagagaggggtcccaagcaccacacacttcgtgggggaagcttgggcctgaacagcagtagtccctgtagccagagcacccaaaccatgggacccagcgccaggaataattgttcgcaggcactgttgcccatgctttttaagccacatccctagagggctacccaagcagaaaccccacatttcaagttgggggcctaataccacttgcaagcaaggctgcccctaggtgcatgcctgcgccagcctctgaccctaggaaccgtacttcccatgtgggcacagaaaggcagaacctcacctttaggtctccctcatcccctgtccagggttctgcagggccttcctcctccaggttgggttccactcccttggggtccaagagggaaatgctggtctgagaggagaacttcctggagccagtgcccacccatccccccaggctggactttgtgtgagcctgtttagttgggaaatgcaaggctagcccctacctctgccatcctggagggctagagatatagcattccagtcccaccccttccctcgaagctttagtctgaaagtaggtagtttgaggctcttaaattgtcctatcccagtggtcagagtcctcatagcaatagacagaggtagcattccagtcccaccccttccctgaagatttagtctgaaagtaggtggtgtgaggctcttcaattgtcttatcccagtggtcagagtcctcatagcaatagacagagggcccttggtttatttcactccagtcctgaagcaggtgggatactccctgctgcctacagttgactctcctctcccgttttttcccccagaacccttgtgtgtcttctgtgtaacttataataaagctttgttattgcttctgtacaataagaattctcatgtctctgctccataaatcaagtgtgaagagagtattgacttacatgagcagtgacagatttaacggattaaaatttcctgtaacctacctaatggggtgtggaaagcagcacagctcaatggctaaaaggactcagtattaaatagtgtttggggtttaagggatggtttgggtttaagcccaggatcaagtggccccagggaaggcacaggcgggggactcatccctgcctgtaagcacaggtctctgacttggagtagactggatcatccctagaagtccagactctacacgtttagtcttttttaatgtggattgctttttcaaacatttttgcttttaattcaaacttggacaaatcacttacacatatatcttacctagagaacataggcccagcatcaagtctcctggcctggggcaaacaaggaagaaaactctcttctgtaatcaatagaaaattaagtctaactggataaagaatatgtgctacatatacaccatggaatactaggcagtcataaaaaggaatgagatcatgtcctatgcagggatgtggagggcgctggaggccattatcctcagcaaacaaacgcaggaacagaaaagcaaataccacctgttctggcttataagtgggaactaaatgatgtgaacacatggacacatggaagggaacaacacagtggggcctgtcggagggtggggagtgggaggagggagagcatcaggaagtatggccaatggatccctaggtgatgggatgatgtgtgctgcaaaccactgtggcacatggcataggtttacctacgtaacaaacctgcacatcctgcacaggcaccgctgaacttcaaagttggaaatgtttaaaaatcttttaaaaagggaaggaaaaaagcttaatcctaagtctagaatgtgacatagttcagattaattcttttcatcttaaaagaatcaacttctgcctaaaagaagcagagtacctctaagtatgtatcttccttttttcaagatttagcatggagggctgtttgcagaaagagactacaaaattcatgatattttaactaaaataagggtaaaaagttcatacccaccctataaagtgcgcattcacaagtgatggacagggataaagatctcaggtaatttgcctgaagtcacccaagtaattaataacaggtcttgggtacagaagataagctggattctagtctaaaccacaagggctacaattctaccacaagttgggctgaccccgaggcccaagctgtgtctccaccccacccaagtgctaaaaatgcaacccttgtaaaccatgtcgccactcaggaaagtcatcttacacatggtagaaaaaggcaagtgctttatatcagtttattaaaacatgtatcgagtgatgattctgtgctagacctctatgctgggcactgagcatagagagctgaaaggcaagtctttttctcggggcaattacaatctagtgagacaaatggatgaagaaccaataatgagaacttaagaaatacacgctagagggaacactaaccaaggctggggaagttgaaattggagctggatatcaaaagaaggaggaagcagccaggtggtaaagggacattttcagagaaggaagaaggagtttgagtcagtgggaccctccacagagctctctgagctcctgataaatacctattgaatgaatgaatgaattgaatgtataaaaacaaatgagtattgtccaaatctgagatatgccaaagtcttggttctttagcctctagggagtctgtcacttgtgacagaggctcaggcgcatgtatacctccccacaccttccctgccttgcttctcccaacaaagcagctcacatttgctttcatactggctacactggggtttacctttgatgtggccacccctcaacaacactaaatgagctcctaggaagtgctgaatcctagtgctgaatcccagagcacaggctctggggcaggctgtgctgggttcaaatctcagcactgccatttaatggctgagtgagcttgggcaatggggtcaacaacagtacctgcctcagagagtggtagggaggaaaacatgaggtgccttcttcaaagtgctcagcagagactgacaaggttaagacataggccactcaggcagggagcacaaaatctagccctagactagactggcaatgcgtagccagttatctcaggtttgcacacactcagaactggcacaatgcaaatcagacacctcttccagacaaaacagcaaacatgagtgaaaaaatggaagactctcatcactagtgtgctgagacaacagacaacaacaactcttgtctgttgaggatttgcactgcactcagccataatacagagctttctcctggaaatgtggtttatttcatgatccaaatgttgatcctttaatctgtttcctaagaagctgcaaaggaaaagtgaagtgaggaaatggagtagagaaaaggagagaatattttgccccatactttcaggtcgttgactctgtgttggctgctgggtgtgagtgactagaatcaactctttctcctttcctatttttctcctttcctactttttctcctttcctgttttgtgtgaagaatctaatccaagttctaagtctgaaaaaggtgtatgagtatattaatagcaatttcattttcctgacctccaataaatacatgacaagtaaatattgcagaatgatgactaaagggtgccaaattatgagcctgcccatatattccatggctctcataggtgggctctgtgtcagattcaggaaaggttgaaatgactgtgagctgctattgtaaccttggtagtggtggtggtggccacctgcacagagtcattctttgttgttaaaaggaataggtcatagcccagagatgtaatttttcagcccatgtggttcaatggagagaaatatagcagaggcacaaagtcagatagctgctcctcaataagaaaccccaaccacatttccaaaatggaaaagctaagctgttctgaatcagctctttgcatgcatctgatgtagaactttcttcccccagctctgcagtcactgtacttctcagctgcatcaaggtagccccagtgtttgtcccaattgctacagaaactatgatttcaaatccagaaactcctgatgaatcttagggcctggaatgaggctctgattaattgaattttccagttatttgagtactaatcagaaaatcctttgcctttcagttcctgtggctgagaatcttccaagaagtatgttggttccctcttctcattcttcacagctccatcactgaggagttgggcagcctttcacaggttatttaatgtaattgctacagatgatcgtgtagcaaattaccacaaatttatcagtttaaaataacatatattgattattgtgcaatctccacatgtgcgcatgtacacacacacgcacacacatacagacacagacacatgcttaaccagaaatggggaactagtggtacagacaggttcctaagagagcccaaaagatgacttcctcgtctcagggaatcagaataagtaatatttgagctgggtctaggagagtaagaaggagaccaccaagggtcattattacacacttagaatactgactgaagtgaattaagatttactgctcaaaaaacatgacagaaaaacactcaaaagcagcttttctcacctgggtggtcatctgtaacatgaaaaacttatcgtccttatccaaatattaattattacaccaaaattataaggtagatatcaaaagggcagtcatccctataaggcaaatttgtacacttcctggcaacgtggatagtggttcagatttctagcagctgctgatgccaagcctaggcagtaactaagcaaggaacagaaaccgaggaaaaaagaaaagaaggggaaacctaagtttttgactcacaagacaggttctgctcccacagatatccttctgagagctcccaggcccagagctatctagagggaacatgagactatccactatccacaatccatcattgcaagactgaataaacaaaacgtggtctatgcattcagtggaatattactcagccataaaaaggaatgaagtactgtcttagtttgggctgttatcacaaaataccatagactaggtggcttacaaacaattgaaatttatttctcactgttctggaggctggaaatcctagaccagggtgccagtatggtcaggttctggttagtagcctcttcaggatttcagactgctgacttctcactatgccctcacatggtggaaagaggatgccagagctctctagggtcccttttataagggtactaatcccattcatgaggagtctgccctcatgcctaattgcatacccagggctccatctcctaataccatcacgttgaaggttaggattcaacatatgagtttgggggtaacagaaacattcagtccattgtaattactagtacatgctacaatgtggataaacctggaaatcatactatttttttaaaagccattcaaaaaataatacatgctgtattattccatttacatggaatatccaaagtaggtaaatccacagaggcagaaagcagattagtggttgccagagcctggggatgagggaaatggggaatgacttctaatgggtatggaggtctcctttggggcttattaaaatgttgtgaaactagatagaggtgtttattgtacagcattgtgaatgcactcagtaccactgattgtactctttaacatggtcaatttaatgtcaggcaaattttgccacagtaaaaaaaataaataaccccaagtaggaaccttatttctaatggttgtcacagggcttagtttacaccaatgtcacctcctccaaaacaaataactatttaatgagcaaagccacacaaacaatatgatagcctgagaaaaatccttgagactcctccaaaaagcaacacttcaggtacacataataatttgtaaagtaacatagtttatcctaattctgaaaggcaattaaacatatacatatgtatgtatatatgtacacatgtacatgaaatggaagtcacttaatagaaatataaaccaaataataagatccagttagataagaactgcacacaggtctcctttaaatggtaaaagtgaaattcaaagtttcccatggcttgcaaatgcaaagacagactcacagagccttttgtgaatttggaagttgaagggaactatctgatctcagatgaagattaaccattcaaaagtttattttgattgttttaactaaattgctccatttcttttaagtaaaaaaagaagtgccttaaatttatccttcagtctattaaaaggggaataaaaactcttaactccaaaacagataagggcgttctagtgtctgatcttgattgacaagctgtggctgtcttagctgttcaccataaaactcaacatgaaaatatgaagtttctaaatgtcctttgctctcattgaacgaattaactaaaaaataatggaatgctattgtcattaagttcaaagcctactccaaaatcatcaagttcacttataatagtctactgtactaagtggcctcttagcaattccttcagcagaaatatttaagaatccgagtgaaaaataaaattcaacttaattaaaagattctccttgcattttgattatcaatattgccaataagaaggtgcattggagccgggcgcggtggctcacgcctgtaatcccagcactttgggaggccgaggcgggcggatcacgaggtcaggagatcgagaccatcctggctaaaacggtgaaaccccgtctctactaaaaatacaaaaaattagccgggtgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagaaggtgcattggaaacgtatcaaacctgttcccccaaaacatccttttcccaatttctgtaacaagatggttttattgtgtcatgttataacaagtcggtcaagaaagtaaaaatcagagtttaaagaaagggctcagtgtgtccagaagagaggtactgagaggaagactcactttggaggctgtagcctacaattttcagatattgcctcacaggtgaaaatatacttggagtatcttggagagaaaaatacaagagagttgaaagttttccaaagaaaaacacatcaaagttcaatgggaggcccagctgtgggctgctccccacgccagcccgcgccccacatggctgccgcccccgccggacctgtgtagctggccatcgccaagtcggcgcgggcgggcgaatgcgcagcgagcagtttcccagcaggctgggcgggcggccaacgtggctgggcgtggctgggcgtggatgggcgcggccgggctgccggggctccggcccccggcctgagagctgtgcgaccgtcgctcttcttccggcggcaggtgtacgcgtcgctgcccggccgcgaagacgccttccaccgcggcatcttcctcttctgctgccacgagccgccgtgctgtgccgccctgcgagtttctaggaatcagctacccaggaaaaatgatttttactcatatgagccaccttctgagaatccttccccagaaacaggagaatcggtgtatctccaacttaagtctggtgctcatctctgcagtgtttgtggctgtttaggccccaaaacttgctccagatgccacaaagcgtattactgcagcaaggagcatcagaccctagactggagattgggacataagcaggcttgtgcacaaccagatcatttggaccttacaactccagaccacaacttcctttttccagaatttgaaattgtaatagaaacaagatgagattatgcctgaggttgcggaaaaggaagattattcagatattatagggagcatggttaagcagtttcaggacttcattcattaagtggttaaacttaatgcttggaagaaaggtctcaatgtgtctagaagagaggtactgagaggaagactcactttggaggctggagcctacaattttcaaggattgcctcaggtgaaaatatacttcctggactttgtttcctgacatatatcaggtgtgttctgctccctataaagacaagaggaggcgggtatccagatggtcccacgagtagggctacacaagatgctggaggcttggtaagttcctctgggtcccagatctttttctcaggtcgggatagtgtgagtgcctagcacagtgtcgggcatgcagaagggccccttaaaagtttctctttcatctggccagttttagatacacaattttgtcagtttatctgcagtgcatactcttgggtagtgcctgtgctgaccaagtatcttagaggcttattttattatagtagccaacatttatccagcacttaaccttatataaagggctgtttttgcatgagctaattaaaatcctgagagtagaccagtaagtcagaaactctgccccgttttgaaggtgaggaaattgaggttctgggtataacttgctttggtcacataatgttaagttttacaatttgagccttgagccatacacaaagccaccataaacattagatttatagactcaaaatgaaaacatcagcttactggtttgtagttcataccagtcatacattccaaaacatgtttgagtcttactctgtgcctgaccttgtgcttgataatatggatataatgggaagcaaccctccagtggtcatgctcacagtctcatggaggaccccaaataatacttatggaagataaattccatgtaatgactgataagagtacaatacaggtgtcatgggaacatgtgacattactgaagactgcctggaaggggacacacatgtgttcataccaataagatgaaaaggataaagaatgaaaatgcttacctttaggagaaggaagagcctagagtaggagggtcaaggatgaaacctggacttcaaatatgccttgtttatgtaaatgtgacttcggaactgtgtgagtattttaagatactaaaatcagttttaaaataagttttaagaagcagtccctaatcatcaaaagtaaaaaactcttgatgtagtcatatacccacactaagaactcttctaggtgacttcaaaacatagggcaatacatctctagtggaatataccctgagaatgaaaagaacgtaacagtgttagtattttcaataaacatgttattactagactgttgctgttattttgagatggttgtgtgtgtattgggggataaagcaaatgagtaattatgttggtgttactgagaactgaggtgttgggcatgggaggaagattttgttgattgtgtctacataccattctctctaaaaggaactccaggctctttggagaggtcgttgattccagaactgggtcaggaaatgttcaaataatgtgggaacatggtcacatcaacaaggtcatatgaaagattaaggaagctagcaaggattactagggccatgtcagaagaactcaagcaacatgaaaaggctcctgttggcaaaagatagacagtttgcacatcctgcatcagatatgtttaacgagttcaaaataatacttaaaagaactcagtaatcatctttgtaggatacttgggaacagattcattattttcaaattggtaaataaaaggaaagagtttgcattataggggtacataacttaattatgaatgaagtgatatctgtgggatttacttcagagtaatcgagttggaagtggcagagaaaggaaacactggacttgatagtgttgaagctgattaatggtacgtggtggttcattatagtatttccacttttgtatatgttcaaatttttccaaaataaaaggagaattaaagaaaaaaattcaatgggaaacaatcctttaacagaaattcactttattgtaaccactctcagaatcacatggtccatgatgatgagatgtacccttaatatatggggctcaggcttaggagggagctgagtgtttttaagcagagtggaaacagctgtcatgcaactcaacatcggcatcctcaccagtaccaagtccttatcacgggagctcaggacttaccaaactcatatttctcctaaaagctaatgtatcagtccattctgacattgctataaggagctacccaagactgggtaatttataaagaaaagaggtgtaattggctcatgattccacaggctgtacagcaagcatggctggggaggcctcaggaaacttacaatcatggtggaaggtgaaagggaagcagggatggcctacatggctggagcaggagaaagagagagaggagggaggtgctacacactttcaaacaaccagatctcgcgagaactcactcactatcacaagaacagcaaggggaaaatccaccccaccatccaatctcctcccaccaggtccctcctccaacactggggattacaattcaatatgagatttagacagggacacaaatccaaaccacatcagctaactaaaaaaacaactgtttctaggccctcttcatagctttttttttcttcattatttgcaattccagaatttgctaataaagtaagtgcaaattttgatctgcagtattcgtgattggtcagcaaatgtacggaattcctatctaacctcccaccttggagtggctctctgggaggataaaggaaggaaggaaggagtatggcttggaagccaactgaaattgaagaacccacagaaccactttcagtaaagacgctttatttctgccacttgttaatactgtttagtaaatcctatgctgaatcctatgtctagacttgaaatctgtatttgttttgaaatactttcttgtgctctcatcccatttgctattggaaaagaacaagaagtctcagccttcatgacttcataaggaagagaacgttatcttacaaatttccacccaattaaaaatataattgtttttacaactttactttggagcacaagcataactttttaaaactgtattccacttttatgaaaagtggattattctggattaaatcatacaattcctctgcctacctgtgctcacagcatcattatggtaacctttttcatccatagaggacacacccagaacagatgtcaccattatctaatgatttcctgctagagaaaaacgaatggggttagcaagtcatgtggaactcaacctcacctacatcagaatttaatggccccatcaatccaacagtacttggtgagtggtcaatctctaaagtcaatcaattatgaaaaaaaatagagagactaccagaagatgtctaacagaatggaaggtcaaatttctcatctagtgcagagggagcacaaagaacactcctcccccactcacttgtgtgattatggcaacaaatctgggatggacagcacaaaaggaactatcccaggtcacatgagaaacccggatgtcatcatagcactggtcatttttcaccactagaccaagtatattccaaaactcgctctgatgtaccactcacttcatgtgtctgcagaagagcaagaattatgtcagaacttcacaaactcaaagctttgctttcatcaatgaaaagctgcaactagaaaaaacaaaatggtgtgatattctgtctgctctcctaagaagcagccaaattgcaatccaaatctcctttaatggcatatacccagagaaaatgcaaaatacatcagaggtagaattatacagaaacgaaaaatccctaattcaaaatccagaaacagttcatcatttttaattgcaggagaaagatcagcgggaaggataaaagcaaattagatttggggagctttcacggcaataaccactgcaaccttatcctttgatagataagaaaactctaaaggtaagaagttttctggtaggtgtgaagctgaagaaagcccccaaacaatttatggttttgtggctttgtcctcagactgccaaggtaatttttcagtttttaaccattttccccagacattagcactctgctgagaactgtgcccatacaccaatgtctccaaaagaaaaattacatttagtggggattcaacagaaacacaagcaaccacccttgtcttcaagagccttccattctcctcctgacacaggcattctaatacagcctgtctgtcctccccatttcctacaagcctgcacatcctcaaacaattaggcccagggataatcccttacaaactgatatctctcctttaatcagcacttaacttcccaaatccatttgaaattttaatctctcttcttttatccacctctgtattttttaggcaatttctcttccctatttttagaataagaatttaaaaataactctgattttaattattttttaaaaataatgcaaaagtcaaattccttttgactttggaacagggccgtttgcattacttacttctacataggaatgtttatattaaagaactactgagactcattttcatagcacagtagtgatacatggctttggttgtcttatttggcttttacccaaaaaagcattttttttaaaaaagctgggcatggtggctcatgcctgtaatctcagcattttgggaggacaagacaagaagactggttgagcccaggacttcaagcctgcagtgagctctgatagcaccactgcactccagcctgggtgacagactgagaccctgccactaaaaaacaaaagaaaacaaaagccaggctttcttgtttgtatgtctgtgcctgagtgtttgtttcaatttcagctgatattgaaggtaacaaaataggattaagaattaagttttggcgtaatgtggtgtggctcatgcctgtaatcccagaactttgggaggccaaggtgtgaggattgcttgagctcaggaaatcaagaccagcatgggcaatgcagggagatcctatcactacaaaaaacaaacaaacaaacaaaaaaaccaatttaactagccagacatggtggcgagagcctgtagtcccagctactcaggaggctgaggtgggaaagtcccttgggcccatgagttggaagctgcagtgagctatgattgtgcccctgcactccagcctgggtgacagagagagaccctgtctcaaaaaaagaaaaagaattaagtcttgactgcctagcaatcatcataattaatatctcatcagcagaaaatatacccctgcttttcagtttaggagaaagaaaacttaaaaactagtgatacccataataattcacaggctcatctaagaaaatcaaatagatcaacagtttcattacatgtcaggtgaacatcttaactaagaacaaccagtggccgggcgcgatggctcacgcctgtaatcccagcactttgggaggctgaggtgggcagatcacgaagtcaagagattgagaccatcctggctaacatggtgaaaccccatctctactaaaaatacaaaaattagctggacatggtggcgcatgcctgtagtcccagctacttgggaggctgatgcaggagaatcgcttgaaccggggaggcagaggttgcagtgagccaagattgcaccactgtctggtgacagagcgagactgcatctcaaaaaacaagcaaacaaacaaacaaaacaacaacaaccagtaaaaataaggtctacttatatgatgtaaggacttgtttcataagtgaaatcaaaatgtttgctaaaatccttctcagaatataatttccaccccacagtcaattaacagtcctcaacctttcaaggagactataaaggcatgcttctcattgtactgccaagctggatcacacctagaaagtgtacttcgtaagccatacaagaaatgtgttgagtgttaggaggaaaaaatgtcgataggacaagatgtttatagggtagtaaccccaagtaagcacactcaaaacaccagagcaaatattactacgttttctttaattttccctggatatttccatcaaccttataaataaaataattttttcattttcctgttaattgagaagttatctgtttaaagattccagcaaatagactcctgtgatttagatttcggttgattcatacaaaaggacacacctcctgccaggaacacatagaggataagccctgctagtaggagaatcctgtatggcccgtttgctgagaccattccagggcatcagttactcaagtgcacagtagaccaagagtattccctcagctagaagcaactgcagaattatgagatccacatggcagcgctgctgaccttaaccttcatctcttggtcaaggtcgtgtgtgccagcctgctccaccttaaagtgactctcttccttctctatactcggttctttggagctatgtcaccaagtctagcacatctcagtatgggtgaatgaatttagatccgcctcctgaaggtcagtcacaggcagtgacacttccctgtcattcagagcatcaaagaatgaggagcaagaagagtctgggtcactctccttgggaggaggacatgtccacatttatgcataaacctccacattgtgtatataggaggaagaagaacctccattatacatagtggtatatggtgagatatatagtaaggtataataatatatataataatatgcatattggtatacagtgatatgtagtgagatatgtgatggtatgtatggatatagtgatatatattgtgatatataatgagacgtatagtgatgtataataatgcatatggtgagatacatagtggtatacaatgatatatagtgagacatagagtgatatgtagggatattgtgacatatagtgagatatggtgagatgtatagagatgtataataatatatagtgatacatatagtggtatgcagatatataatgatatatattgtgatatgtagcagtatcatgatatatgtcatgatatacactgatacatattgtggtatatagtgatatgtaatgatatttatagtggtatacatagtggtatacaataatgatatgtagtgagttatatagtgatatgtaggaatatatagtgagatacatagtgatgtataataatatacagtcatagacatagtggtatatggtgatatgtagtgagatatatagtgatatgtaggaatatatagtaatatatattatatagtgagatatgcagtgatttataatagtatatagtgatatacatagtggtatacagtgacatatagtgagatacatagtgatatgtagggatataaagtgacataaactgatacagattgtgttatatagttgtgatggttaatattgagtgtcaacttgattgaagggtgcaagtatcattcctgagtgtgtctgtgagggtgctgccaaaggagattaacatttgagtcagtggactgggaaagacagacccaccctcaacctgggtgggtgcaatctaattagctgcccatgtggccaggataaaagcaggcagaacatggaaggactagactggcttagtcttctagccttcatctttcccccatgctggacgcttcctgccctcgatcatcagactccaaattattcagcttttggactcttggacttacaccagtggtttgccaggggccctcagaccttcaatcacacactgaagggtgcactatcggcttccctacttttgaggtcttgggactcaaactggcttcctggctcctcagcttgcagacagcctactgtgggactttaccttgtgatcgtgtgagtcgatactccttaatataaactctcctttatatatacatctatcctattaagtctgtccctctagagaaccctgattaatacaatagtgatatatatagtgatgtatagttatatatatagtgatatatatagtggtatataatggtatgtagagagatacatagtgataagtcaggatatatagccatctgtattgtgatatatattgtaatgtatattgtgatatatagtgatatagtgatacataatgatagatattgtgatatatagagatatatagtgatgtatataatggcatgattcaggatttgtcactggaaaagtatgaaagtttttcagtgtttctaagaacaaagacaagagaaaatgcaaacaagatataccaagagatgttcaggctcaggcctcatgggagctaggattggagagggttccaaagctcatccattccaggcccttcatgtttcagcctggagacgtgtaactcctccaaagataaagacttctgagaaagacacagtgacctggaacctcaaagtaccgggcagctcaactgttcagcccataaacttccatactcttccaatgataaatcctgactcatccatataattcagctatctggctgaactgcaaccacatcaacggcactggaggacattatcttaagggaaataaactgggcacagaaagacaaacttcacatgttttcactcatttgtgggagctgaaaattaaaacaattgaacttatggagatagactagattgatggttaccagaggctgggaaggctagtcacagggagggggaagtggagatggttgactggtacaaaaatatagttaaaatgaataaaatctagtatttgataggacaacagagtgactatggtcaacaataatttactgtaaatttttaagtaacttaaagagtataattggaatgctactaacacaaagaaagggtaaatgcttgaggcgattgataccctatttaccctgatgtgattcttatgcgttgcatgcctgtatcaaaatatttcatgtaccccataaatatatacatctactatgtatccacaaaaactaaacatttaaaaattaaaattaaaaagatcatttgaagatgaaaagattattaaaaagaaaagaaaaagaaagaaataattttgtgagcatctgttaatgtggcagtgctagtttcagaactaaggacccagcagtgaatgagacccacattcccctccttggaatctacagtgagtggggatctaggcactaagtaaagattgagcgaatcaatgctgactggcagctaaactgcggggttggaaggagggtggtgtgggaaggagctgaacaaaggaatccaacttgcagaggaaagaaaaggacagaacgtgtgaatgaatgggttggaaaggggagagctgccagttgagaaagccaggaccccgtagaccagaaaggagtctgcatttggttccacagtactggtagcgagggtgggttccacatgtttagacaaaatcagatggaggcactgcagggcggtcaaggcaagtgttcaagaagccatgcatgggccgggcacggtggctcatgcctgtaatcccagcactttgggaggccgaggcgggcggatcacgaggtcaggagatcgagaccatcctggctaacccggtgaaaccccatctctactaaaaatacaaaaaaatagccgggcatggtggcaggtgcctgtagttccagctactcgggaggctgaggcaggagaatggcacgaacccgggaggcggagcttgcagtgagccgagatcatgccactgcactccagcctgggcgacagagcaagactccttctcaaaaaaaaaaaaaaaaagaagccatgcatggaaatgggccctacgtgcagacacctcacaacccagggagaccacatctgcttactgggacatcctcctgactgtgctctttccaagccacctgcagagaatgcatggtccctggacaacctcacagtccccgcctggcctgatggccagctcctccagccctcccaataaggacactgcacactccaggcttcccgttcatagtggcatgttgactgctcctgtgtgtgtgcctattagctgcatctcacctgcaccctggaaggttgtttcctgcagcccagggagtgtggaccagatctggccctggaagcccataaagcttcttcccatccagtgggctccaaccacaccctctcctgtgaagtctgaagcccatccttggggagagagccctctaagagtgtttccttccttgggtactctccctgcagttctctttacatcttatggttactctcctatcatagcttaattattctttatattatgcatgccctatttaaaacaccttgtagtttatgtcttctggatgatccaaactggtacttgatcttcatgttgattctctgtgattttctgcaaatagtttatattagttgtatgatttatttgaaaatcatggccgggcgtggtggctcacacctgtaatcccagcactttgggaggccaaggcgggcggatcacgaggtcaggagatcgagaccatcctggttaacatgctgaaaccctgtctctaataaaaatacaaaaaattagctgggcgtggtggcaggcgcctgtactcctagctactcaggaggctgaggcagaagaatggcgtgaacccaggaggtggagcttgcggtgagccgagatcacgccactgtactccagcctgggtgacagagcaagactccgtctcaaaaagaaaaaaaagaaaaaaaaaaaaagaaaatcacattcgaatatcacctcctccctcaagtattgccttatttcccaagattggctagttatttcctcctttttgttccttttagtgtacttttgtagaggctaataataatcataagataggttatggaaataattacaatatctactcagaacggaatgcttttttatggcccaagtactgtgctgttacagcaacactattgtgtcatcctttcattgaccctctgaaagagatacaattattctccctatttagtagatgaggaaattagggctgtgattggtgcaaagtcatccatacagcaagtgtcagagcctgaatcaacatgaagttgtctgaccccagagcctgtgtgcgtagccatagcagatgctgcctcctgttggtcatttgtcattaatctatgcatgcatttcttttggctgttccttcatcaaaggattcgcaagggcacagggatgcttttgtccacctttagtggattctgaccaagagttttccaaatgaaatgcccatctgatgctcacgccagccatggacaagagattggttgttccccagcctctccatcaattggtattttctgacttttaaattttagccatgcttggagatgtgtaaaaagcacatggaaagtccagatgctttggggaagcacacagattctgagagtctggaggcaacacaaagaacaaactgattgtcttagctcattcacgctgctttaacaagagaccatatagttagtggcttataaacaacaaaaacgtatttctcatagttccggaggctgggaagtccaagatcaaggcactgacagatttagtgtccagtgaggacatctatgaaccaagaagcttgttaggtatggtgccttctctttgtgtcctcacataggggaaggggtgagagagctctctggggtcttttttataagggcactaatcccattcataagatctcaacccttatgatccaatcacctaccaaaggcccctcctcctaaaaccatcacacgggagggaggctttcaacgtataaattttggggggacacaaacattcagtctatagccctgtgtcttctataatctttttccactggcatatactaaaaccataaaatttatggttttatcattacagtatagtaatttttttgttaattaaaagacataagcaaagtttggttttgttgttacatagaataattagttttaggggaaaaagaaaagagctccaggtcactgtccatttataatgtgcagatctcctgactggaacctactgagggttggggtggggaggcaaagtcacctctgccacccctgtgtcatcagaccttctgcttttctcagggtccaggtgcatgggactctgcctttacatcctggaggcctagagacctcccctttccaccgcatctgtttcactagtcaagtgaatgcctgggctaatttgctcctataggacatttatagacactctctgctgaaaacaacagcctcagtggagagcagcagacagccctcagtgtcctgtggacctgacttgaatcaatattctctgtgttcttttaatatgcagaatctcctagtaaaggtgaactcaattaatgaatgacatacagagtttcgttttattttgtttttattgatgcataatgtacatagtttcagagtacatgtgataatttcacacattcatataatttgtaaacatcgatcagtatacttgggatatccatcaccttaaatatttgtcttttctttatactagaaccatttgaattctctcttccagctatttttaaatgtataatagactatcgcaaactatagtcactctattgatctatctaatactaggtcttatttcttctgtaaaaccatgttatttgtttatagccaataattactgagcccacaacggggttttttttcctgttgcctctgttccatgtgcaactgtcaacatatggttcactcgcggggccaaaacagagctcactgggaaaactcttggtctaaataactttatggatgaatgagaattaagccatgggcctgtccagcttttcctttccagacagtgaaaaagaagctttgaatgctctagggaaggccaaaccagaggcaagaataacaaattcttgacttttctgtggatacagagaaaatatgtgagactagatataaacagggtgttatataaattaggcaaaaatgggccctgtattgtacatccaatggaataaaactagaaatcaacagcagaaggaaaaatggaaaattcacaaatatgtggaaattaacacattctaaagtgactaatgggccaaaaaagaatttataagaaaaattaggctggatatggtggctcacacctgtaatcccagtactttgggaggctgaggagggcggatcacgaggtcaagacatcaagaccctcctggccaacatggtgaaaccccatctctactaaaaatacaaaaagtagccaggtgtggtggtgcacacctgtagtcccagctactcaggaggctgaggcaggagaatcgcttgaacccaggaggcggaggttgcagtgagccaagatcataccactgcactccagcctggcaacagagtgagactccgtctcaaaaaaaaacaaaaaacaaaaaacaaaagatatgggatccatcactaaggtaacaacaagtaatgtttgtaatgccagtatccagcaaaatccctgctttatgtaaccagggattcacccacagtgcattcagaagcacagtgctggctgagaagcaccttccctttctcaaactcagtgtccagaattcaagttctgtagacagtctgatctctcctcgctggtgaacagattctttgcaagctcctaggtctgattctgtgcttgttcccaaatcttcctcctaataatagcaactggaagtgaactgaggggagcccaaactctgaaggtaaatctcagcatgttctttcagcttctgttccatatgcccacattggacactctgcaggtcatcagaaatgacaaggagctcatcagctgtgtcaacatccaaggtcatatctactgtgaaagaaaaaaatcagcctctcagcaagtgggcagtacacgtattgcattcaaacccaatgcagccaccattaattctatgacacattgtaatagacactaggaacagagagagatgcaggaagacttagcacattcaaatgagtctgcgttcaggaatctggtaggtataggctggcatgctgactttagcacattacacaggcagctgagttatgataattcactttaaatatacacattccaccaaattgggttacaaaaattactccgagttaagttgcgatattgaatcgagcattatttcctttagtgcctgctacatgtggttagcacatgatgtagtgctctgggccagaattcacaaccaaatctatatgtacaggatcaataaccacatgcacttttatcactgtttgctgaggggcattagccctggaataaattcattgatcataatggttgccaagactcattgtgggttgttacaaatcaccagactgcttctaaatattgcagtcatgagcctcacagccagagagaagctcagatgcagctgataccaggcccttgctattcggtgtgtgtgggaaccagctgcaacagcatcatctgggcacctgggagagaaatctagatttgcagaccagcctagagctgcaggatcagaatctgcattttaacaagtcccccaggtaatctaatgcataaaagtttgaaaagccatgatacagcatagtgttcccaatagaaacataatgccagccacatgtgtaatattaaagtttctagtagccacattatcaaacataaaaagaaacaggtgaattaattttaataatatttttatttaacttgatcaaacatattctctttccatatgtggctgtaaccacatttcaagttcttaatggttacagtggctatcatgttggacagcacaggtatagggcatgacctaaacattacgcatccttcaaaaaatccaggtggttctaacccatactcaggagagagaactagtgttgcttaaagagcataagaacattaggtgccaacatttggcggggcacggtggttcacgcctgtaatcccagcgctttgggaggccaaggcgggcggatcacaaggtcaggagtttgagaccagcctggccaatatggtgaaaccctgtctctactaaaaatacaaaaattagccgggagtggtggcagacacctgtagtcccagctactcgggaggctgaggcaagagaatcacttgaacctgggaggtggaggttgtagtgagccgagatcgagatcaggccacttcactccagcctgggagacagagcgatactctgtctcaaaaaaaaaaaaaaaaaattaggtgccaaaattcagctgactcctatatttaatggagagcatttttcaccgttggcttttctggggccttcatggggagggctccagatacctaaccttggaacttcggcatccttgagttcaggcatagaatagctttcagctgggctccagttctttgatcttggaaatcagcttccccaggtggcaatttgtcttaatctcattcttttgagaaactattgagcagaaagtgcacaataaactctccttttggggttctgtcttcagtaagttgaagcagtgggggcagcagatgtagccacattacaagatggataggacatctgcttgcttcttgaaagtgtgcagcctttgctgctgctgctagggtgaaacatacataatagtaatggagatccaggagatgaaagaacaggggctatttcatcttcacatgcatagagatatcatgtaccatccctagcacaaggcaaaggctaaggaatctctctttcatatatatatatgaacatatgcgaatggccctggtcttctgaatttgaaattctagttgaaataaagggtgtgatctgtcacttggcttagagttgagattgtgaaagggaatggaactggactgtctaatataggagctgccaaccacatgtggctcttgtcacctgcaatgaggcttatctacagtgagacatgctttgagtgtgaaatctgcccaggattttgaagacattatcagaaaaatgtttcattaataaggtgaaaattgatttacatgttaaaaattataatcctttggatattaaaattaatttatcttgtttcttgttacattttttaacttggctatcaggaaatacatagctacatatatgaattacattattttgtctgagacatccctagcctagacccagagcccctccaactcttcatctggtcccacctggctgggcacagacccatagcagcagctgaagggttaagtcaatgggggaaactcaagttatcatctcctagagtagcccaagctatgatttgattgaaagaatctgtcagactcccagcctgtgtattgagaatctagtcctgccttcagcttctgggcagaggatcccgtgtccctaagtgctcccactgtgcctggcattgagttggcctcagatcatacttgcagcattaattacttcattccctggatgttgctctcttatatttgtcttttgtagaaagctgagaagtgagaaaggaataacactggactcacttccacaagatgcttctcttgctccagctgcttctgaaatgagctgagatgtggagtgggacccacctataaggggcttttttatagaaagtcctccctcccactttatccacatcctgccccttctctttaactcaatcagttattgatttaaatctggaatcaatgagttttttactgaagatatagagaagcaccacgtgcaaaggacagcaatttatcctgcaagtggttgtattttgattaatatagacatacccttttttctggattagcttttgaatatcatgtttgcatatgacaaaatttggaatttggccagaaaactttcaaagccaaatatgaggcatcactattagcccttatgcaatgaatggagctagtttcaagtactttttactcacaaagtaaaaccacctcatatttatttaatttatttattttgttaattagagacagaaatctcactatgctgcccaagctggtctccaaatcctgacctcaagtgatcctcttgccttggcctcccaaagtactgggattacaggcatgagctactatgcccagctttcatatttattttagaccaaggaaattaattcaacctaatcttaagtctttcctaaagtcaccctcactagaccatgatttcttcaaatgggctttttctttatgcttcttatttatttatttatttatttatttatttattgagatggagtctcactctgtcgcccaggctggagagcaatggcgtgatctcggctcactgcaacatccgcttccttggttcaagcaattcccctgcctcagcctcctgagtagctgggactacagacacccaccaccatgcccggccaatttttgtatttttagtaaagacggggtttcaccatgttggccaggctggtctcgaactcctgacctcatgatccgcccgcctcagcctcccaaagtgctgggattaagatctgtgtttagaagtttgattttaaaacaaacaggaataatagccccagataatcaggcttttcaagtttctggcgtttttttttcctttccctttgttagtaaccatgtcaaaagtaaaagatatttttataatcttactattttccttatatcacaaactacatgaaatgagatggctctctttattaaaatataattcaataaaaggtttccctgtggttttagatcattcagtggtgggagagttgagaatgggagaatgaaaaactgggactcaaggggctgggctggggaagaaattagattatatatttcactgcttgaatctggcctgagggtgagatgtcacagcctgggctgctatctggatgctgggagggtctcagggagtgtttctgacccgggcatctttgtccagaggagaagttgacaaatgcccacccacagggcttttctgttgaactgcatggagcaaaaggagctccttggtgttcatccagtttgccatgtggggaacccagcaatgaggggatttgagggagcctttctcgggcagtttgttctaacaaccagaagatggcgcccgagattgaggtccggtgcccggtctgccctcaaggaatattcaatatagaccatattctgggccataaaacacaccttcacatattgaaaagaatataaatcatacaaaggttgatttcagatcacaatagatcagaatagccatctctagcagaaagacagaaaatttcaaaaatattaaacaacactcttctctgaaaatgtttagagatttagtaacacatgggtcaaagaagtcgcaagagaaattaaagaatatttgaggcaggatgtggtggctggcacctataacctcaactactagggaggctgaggtgggagaatagcttgacactaggagttccagaccagcctgggcaacatagtgagaccctgtctctaaaaaaaattaattaattaattaataataaattttatttttaaaacttgggttttaccaaaaatttcacttttgcttggcttcttccttttcctcctgctcctacctttccctccactagtttttctgaaacttcatgaattctggagtcagagtctgggaaacttacctatgccagtcaggacaggtatacatatactgggatcttcctgattctgctgaaagtgtacttttcagtcatagaatattgcatatatccccagcacattcacgtggctgggaggcagggccttttctaagtcagctcacaatgctgacacctcagacccttgaccatcttcaatgattcttaaaaatgggatataaggccaggagcagtggctcacacctgtaatcccaacatttggggaggtcaaggtgggcagattgcttgaacccaggagtttgagaccagcgtggggaacatggtgaaaccccatttctatttaaaaaaaaaaaaaaggagaaattagctgggcatgatggtgcacacctgtagtcccagctggggctagagggaggcggaggtggaaggatcacctgcacctggggaggtcaaggctgcagttagctgacatcacaccactgcactccagcctgggtgacagagtgaggctcttaaaaaaaaagtatgtaaaggttgccaatggtttaaaatgcaaagaacacttgaaaagccagcactagtttcagtagatccctcctgcagggaactgacttgtgataagagcatgactgcctggcccccagcatgcatctccagagtgaccagagctgtgccagccagaggagcacagcactgaggaccccacagggataacggaaggaggaaggatcggctgatcagagtcaggtattaccaggagtgcactcgagacaaagcagtacattctacagtgggggaattaccattgttaatgtagacaatctcatgtccaagacaatgttagctacacggagctgtggtggtggaaagttgttcagtgctggataagacacaggtatttatccacatttgttttgttcaaatacacacacacacacacccctgcccacccccccacccacacattgcactatgaataaaaagtgttgcacccctattatttagaaactcacataatccatttggttacagccaaatatttatttaacttataaactccataatacataaagccgaacttacagaaataaaaggtaaagcatttggaaattaagaatacaaaacatatcattaggaaacaaaatataaacacaaaactcaacacgtttgatggtgacaataatcaatatttaaaactcagcttctattctaatgaatctatgaagttaactacatcatggaatggtctatatttttctgctatgattttgtaaaatatgtatacccaacagaaacttcctaggtctacccaccaagtaatttaatttcccgatcctgtttctatgcagtgggggtttatttgccctccccaggatggactagaggatgggcagtgcctggatttatcacaggacagacactcaggataccctgctctgggagagtggaaggagcaaaatatgggcgcagtggctcttcaggaaaaactttcgtgaatgtatagatgtgggatccatctccaaggtggtaaaaggagatgtctcccatgcctctatccaaaaatatccccactcgctctaaattggggttcacccagaggggtgttggagggcttgtgttagcaaagtggaagcccccagccatcaaactcacaatccagaatccatcctctgtggtcatttggatgttccctttgcggttggcagattctctgcagactcccagattccattatttgcttgttcctaggtccacctcccagtagtggcggccagaggtgaaaccaggggagcccaggacagcacctgccaagttgaatctctcagcactgtttggccgattctgatggatcctcccacatcggacgctcctgaggtcttcagaaatgaggaggaggttgtgagccatgtcaacatccaaggtcacctccactgcgaaaacaaaaacaagtagctcagcaaatgcacagaagccaagcccatttcactcctctactgcaaagtcccaaatatctcattgactttggtttctgtcaatctgctttttttcctgaagtcagagcttttctcgaggcaacttccctgaatagttgaaattctcagatatacttgttgtaatatgtggctcttattcatagtagaagtttttattttacattatgtcatgtgtttgtttatgtcatgtatttcttctgcttaaaggggagggtctcaagacagacaccatgaccctctttctacaatactgatgagtgaaaaatgactgatagttaagacaatgcaagttagcaatattaaatgatatgtttcttttttcacattttattggtccaatttaaatagtgtctagggcatgaatccaggcttttgttctccatatttgtaaccaattaattttgttcagttttgacaggagacgggatatctctgcagctgataatgtgatgacagaggtcccatgcctggacttaagagaatctaaggccaagaggaagataaggacctagacggaaggatgctcttcatcctatgggggagttgaggccttaagcaagacaatattaatgggcttaaatttaagagatgagataaaaggtatttaaaaattattagaatgagcactttacaacattgtgtatgcggttgaaaagcgaagtcaccaactttagtggaagaggaagaaaggaaggggtgggatctggcctaggaaaatttattgtctagaccattctggaaaaaaaaaatctatagaacctgttatccttcaagtccaatgtacattatttgaatgatggataccttaaaagccctcacttgaccactgtgtaatcaatgcatgtaaccaaattgcacatgtatctcataaatgtgtacacatttcttttaagttttgagaatcccttgtctaagccacgacatagacatgggtatattttgctggagatcaaaaaataaaaccaggtgtttctacatgttgtcagggctgagaatcactgatgccagaggaacatttcagtttcaggtgccagacatcagctaattaccctatggtacggagagccaattgcacgaatactttttcctcttttggtagtgggaaggggcagggtatacagattccttaccttggaacttccgcatccttgggttcatcttcagaatctttttcagcttgggctccagttccttaatgtgcgaaaccagcctccccagctgccgattgagcctgatgttgtttttctgagaagcctccaggcagaagggacacaagacaccttccccttggggctccttctgcagtgaattggtgcagctgaggcagaagacacattcacactccaaggacattggcttttctaagtaagctgtgcagatgggacatctggttgcttcttttaagagttcatctgtggtcactgccaggcaaaaaaaaatacacagggaagtgaattttcatgaaatgacagcctcttagtgtgtgacaagtgacaacctttccatgcatagagttactctgctccagctttatagtccttagaacaagaccgtgagtacaaacactccagcacatgcccatgtcttcagagatttgaagttctattggggaagacaagtcccaaatggtccctgtgctttgagctgagttggaggaagagtcgattctcctggtgacccagcagctgtgccagcagatgagcctgagcccatgacacagcggcacccatgtgaggagcaacgagctggggtcatttcttctcctctgaggggagcccaagcaagagattcattaatgagaataagaactacatccttcctgcagccttgggactgaataccaaactgactgccaccactcctagagtgaggggatccagggtgactgatttcaactccgaggcagcactcagacagcctttgttgaaagcattaattactaatttctttcattcatccccctatgttataaccccaattctagacatctgagaaggaaaagcaaagcacacagatgtggactcacctcttccgctgaaatctttgtacgccatcctcttccaccaagagctcaggtatggtggggaaagggcataggagagccttttattggcaagattgcccaaccctccatgatcacacccttccactccctctaatcctccatgatcacaccctgccaccccctctaacctaatcaggcgtttatttaattatatcgggaatgaggtttttattggtgataaatctgcagtccacaatattcttagtaaaacccttcatcctgataatatttaccttgaaaaagaagataagattaaattgccatcactttagattagattagacctaacctactaatattataagcctattttagggattattccagcattttttagtagcaatggttttgctgatatatactatacacatcaagctttgcttagaatcctaaaatagattatcagtgtgattgcatttgcaattttacaaagttctataaatttatatacatcagactcaaaggtaataggtgcatgcatctcaatgagaaaattttagagagtttttatttacttccatctttggaagtaaattgttcatcttttatcctaaaaatttttgataaatagtaggaataatttaaattgtgaaaaatgaccattaaactctgggtattaggcacttcatagtgttaggatacaagccagagttgaagaacggggaatgttttctctgctgcttatgttttcaagtagaaatcattaacagtgaagtaaatcgtacttttctttcccttgaaccagccttgagtcttttctttttaatccccttctgtgtataaaaatcccctactgagatatttgtagtttcgtttcaaaattcaaatgattctaatatcatcttgctatttttcccatctcacattttatcacagattaaataacttttctctttctatatacttttttaaagagaggcctagttctggtcctctttaaatatgattcctcatggcatcagatgactcagagagactcagatcttgagcaaaaggaataatgaatctacagatatcatggaagaggctaggttaatttaagtgattaatgtctacttaatttatagaagaacagcttcattttcaacttttagataactattttttttttaaacaaagtgtcgctctatcgcccaggggctggagtgcagtggcaccatctcagctcacggtaacctctgcctctcagttcaagcaattctcatgcctcagcctcccaagaagctgggattacaggcgtgcactaccacgcttggctaatttttgcatttttggtagatcggggttttaccatgttgctcaggctggtcttgaacacctggcctcatatgatccaccagcctcggcctcccaaagtgctgggattacaagcatgagccactgtgcccagactcaagttttaaataacttcaataaatataatcttactatttcccccactaaaagtgtatcacatattaaatgaatattctttcattctttgtatatatttttgaaaatacctaattttggaactactcaaatatgatttataatgggatgagatgagcctcagtgattcagtgtctagacaaaggaaatgaagtctcgggaaataagatgtaggattgatgtccaatgattggatcaagttggattttgtttataaagtgatcattttgtagtttatgttttgctggattctaggtcattcctcacccaaatataaagacagggtccagccctcctatattctctaagggggaaaaaaaaactgaaaaagacacaattcaaactaaaacttgcgagtaggattctgtgagatcggtgtgtaatttctcatgacagaacaaaaaatggtggaaacgatttatcttgagctttaaaaaagcttatataggaagcagccacttagttgggctttgagtttacgtaggattttgtcagccagccaggcccatttctgagcagaaagaagggccggtggctatcacaggaggcatgaaacgacttaggctatttattgatcctgtacatttaccttgtagggaatttgggagtcctgatgaccacgttaatgagcaaatgctcaagattcccactagatgtcaagaaaacaatattctataacctgctgcataatgtatttatctgcagtagtcccagcaggggaatgagaatgtcgtgttgcagaagatgcccggtggtgcacccagcattgagatggtcatggtttggtaaaaaagcagaaaactaggagctgacaccctagagcaatgatggcaaagcgctggcagctctcacgagaaggaatgaatgcacaaagccaatggtgatgggaggaacagaccccatctaaggcgtctgtccaggcagcagcgtgacccctggagaggctggctccagttacggaagtagagcgcagaacattcagggaattggcacacataagtttgtggatgaggctgggtggggtggctcacgcctgtaatctcagcactttgggaggcccatgcaggtggatcacttgaggttaggagttctggcctatcctggccaacatggtgaaaccctgtctctactaaaaatacaaaaattagccaggtgtggtggcatgtgcttgtagtcctagctactcggaagactgaggcaggagaatctcttgaacccaggagccaggaggcagaggttgcagtgagccaagatctgcactccactgcactccagcctgggtgagacagtgggactccatctcaaaaaaaaaaaaaaagattgtgggtgaatgtccatgattctccaacacccactaagggttgatggagtccaagggtgaggccctgtcaggtctcacctgcccagagccagcagtgatcaggccagtgatgcgctgtaaggtgcgatcagggacaggagacgtgcaacagcagctgggtcacactttcagattttggttactactttttctcactaattttgtgatttaaggggatattgatgtcattttcacttaagagtcactttagacaacaatggctttacaatagcccatagttgatctttccaatttattacttaaatattattaagaaacaaaatttccaaattgtgttacaattttacatgatattgaacttcacatttaaaaaggcatttcttttcttgagtgtttgcaaatctcacagcccattgctttggctactgtttattaaggatgcttttacttctaggagaaggtttatataaataaattaaatctagatattctacttcattattacttagattatgtattattatatatattatatattacataattgtatattatgctatattatatttacatattacttatattagtacattttatataagtatgtatatataggtactatatatattatacaatatattatagtcatacatgtgtgtgtaaagatttcatgtttaatcttcagtcaatacaatggcaagtttaaaaaaaacctctcagtttaatttaattaatattgatggcttctctatcatttaaaactttcagtgttgtgaatattcaccctgaactaattcatgatataaattctcacttattttagctaaagcacttagaaacaggtccaggaagatggataagcagaatgtttgctaagcaattattaggccgtactatgttctaaagtaagagaaaagaggaataaggagagatttgccagaagatacaaagttacagtgaccatgacaggaggaataagttctagtgatgtataccactgtaggatgactatagttcacaagaacatattatatagtttcaaatagctggaaggaggatattgaatgttcccagcataaagaaatgataaacgtttgagatgatgaatgtgttaattaccctgatctgatcaccacacatcatatgtatcgaaaccccctaaacgtgttgataattatgtgctaataaagaaattagaataaataaacaaaggggagacagaatttggccatgttttattcccatcttatgagcaagatttttctccttggtattattgccaaacagtgataagaaagaagaaacgttactgttgacttgttttgtctctcaattaaatgtaaaatagttaatggtcaaaagtaatgaagctaattttaaatagttttgagattcatagagatgaggaggtcatatggataattcacaagttgcagttatattttatttatttagaaatttctggcctgggccagacacagtggcacaagcaagtaatcccagcactttgggagattgaggtaggcagatcacttgaggtcaggagttcaagaccagtctgggcaacatggtgaaacccccatctctactaaacatgcaaaaattagccaggtgtggtggcagacgcctgtcatcccagttactcaggaggctgaggcaggagaatcgcttgaacccaggaggcagaggttgcagtgagctgagatcacaccactgcactccagcctgggtgacagagcaagaccctgtctccagaaaaaaaaaaaaagaaagaaaaagaaaaagaaattactgggcgacctttccactatgatttgaatggtttgtgcctaagatcctgtggaggttttacttagtgacagttgcagaccctgttaacatgccactcatttaggatacaaataaaacctgcagccacccccaggaggcactgagttgagattcaaaaagggatctggggcgccccggtgctggtacaggtccaccccttcctgaaacacccaccactgagccaggaccaacacgacgccgtccatgctcagttttcatgacatttacatctctcgagacctgagattttcctccctcttccttaggaggttaatggaaatcaccatggtttaaattcctgggtcaatttgcagccaacattttcagtagcctccacgcgtctacactacccccttccttctgccttgaaaccttgaagcctgattgacctggagaaaacccgctaaactaagcccccacggagttgtttctccctataggaatatttccataagtactgagacaaagctggttctcccagagagaatttctgatcacttctaaaagaaccggttattaatttacttatattcccgtgttcttcaacttgccttaagatgcccattcttgtgtttaacttaccaaccatggtacaatgtggaattgagaactgggactgcaaccctgagtatggatccaaaatatatggttttgaccaaataaataaataaatgaatataataattatggttcaatttaatatgaaataaatataatttcttccacattttctcctttttttaatcctaatattttaactgtagtaggattatatactgctgatgtgagggtctatgattcctggtcctggaaatcagccttggggacagctgcctccgtgtagatgtttaggaaaagccaatacccaagaggtgagtggcaaggttagctgtgccattacctgctgtgagatgcgtctagatctttcaatggcagaaagcgttgctgagttccaaccttcagaaccaaccagctaccttctgcagattagggatgtttggagaggttgacgaggaatatgatggacagaaaatctggcagaggctcccagttggaagaggtcaggaatcagggactctggaactccatcttgagttgtcccaagattaaataccccagaaggcatctcacgggtcacccagagaagggcagcaaccctggctggcagccccttcccctggcaccaagccaggactggactgggtggagtcaggtcattcctcagatggaatgtggggctgccaccagataaaggaggtgtggttcccgggcggccaaaagcacagtgtaagttccttacactagggcttccaagaaacccttcctgctctagtccctggggaggggcctcagcagccctggtctggatgtttggacacagctcccccgcccccaacctaggcacctccaagggtatggggagcctggctgaaggacagttcagggtcccagataaatgaaaggcagagaaagggttccagtttaccagatgagggtggcagacccctccatcttccagatcttggttttccatagcccaactcagtgaccatttatttatcggtttgctagaccctccattttacttactttacatttaatcatggatttgattatttcatctctgagccatcactccatttctttaaaaaaaaaaagcaaaatgtcacggttctaattcagcggaaggcttaaaaaatagagggagtcaccagaagtggtggctcatgcctgtaatcccagcactttgggaggtcgaggcaggtggatcacgaggtcaggagatcaagaccatcctggccaacatggtgaaaccccatctctaccaaaaatagaaaaaatattagccgggcatggcagcgcgtgcctgtagtcccagctactcaggaggctgaggcaggagaattgcttgaacccgggaggcggggactgcagtgagccaaaatcgtgccactgcactccagcctgggcaacagagctagactccgtcaaaaaaaaaaaaaaaaaaaaaaaaaaaaaacagagagtgttagctctctcctcaatttcctcattcgtcaaaatggagacaatctaagtaaaccaccttgaacgcagcacaccacatgggtaggggctgaaataaaattctatttattctgcatctttatttctttacagtatcagataaatacacagtagcaccaaacccagaatctctacatttctttttttttttccagcatattctatccgcaacatttctcagtagaagctgacatttaaagagtttcctcctactaggccctcaaaatactgagaacctggtttgcagtgagccctccgtaattgaatgttaaatgaatgaattcctccattaatgacttgcttatttaatcttgataaacatactttattttgttctttcaatagcaaatatatcccaagggctacagagaaggtcagtggtcgtgctctgagctgtgcaggtggggctgtatcggagtggtgggagcgtcagatgggcgtttccgacgtgggcatctttgtccagaggagcagaagtggacacacgcccacccacaaggcttttctgctgacgtgagttggcgggaggggctcctgggttgtggctccgtttatgatctacagctgatcaatgaggggactggagggacctttctcaggtagtggaatctgtcaaccagcacgtggcgccagaggtcgcagggccctgcctgggtgtgggtctttttggttgacaccccaggttcttgcgtggggactctcacccctgagcactgaatgcagttcctcagtccgagaccttctcactcgcagaatgcacagttgcacacatgagcccctcacctgtcacccatgctctcttacacaccctgccactcccacccatacctcccctctcagatgtgtgctccaggattttctctccacccacagccgcagatgcccctgcggtgcttgcaactgtgcacactcggtgcagcggacccccgtctcctgctctcagccttgcatttgtctcacgcattttcctacctagagaccccatttcagacccacagaccctctcagcttcttcccttgcctcctatccccttaaaacgaaaatcctttatttcctccagaatgtgtctgctctcttcccagaatgtccgtccgtcttctagctgatcctctagggaagtcctttcctgccccttgattccaacagctcctttcatgccagtttttgtcatgtgcctcttgccatgctgaagcgaaaccgacacagcgcatcgcagaatgcccagactcaggtctgcaaatatgactcattgataggctgcctgttttggtaaataagttttattggtgggtttcctagggctgctccatgccacagtgacaacattaaggtggttgtgacagagaacttacagtaccttccacagcctaaaatatttacagtctggtggctcaagcctgtaatcccagcattttgggaggccgagttgggaggatcacttgatcccaggagtttgaggctagcctgggcaacatgatgaaaccttgtcattacaaaaatttatttaaattagccaggtgtctgtggtcccagctacttgggaggatcacttgagccctggcggttgaggctgcagtgagctgcgtttgcaccactgcactctagcctaggtgacagagtgagaccctgtctcaaatttaaaaaaaaaagaagaagaagaagaaatttgctgatccctggaactcctcacacttttcaggacttctagtgcctgctacctacagcatctcaatgccaacagtggccccaatccctgtgacaagcacacactccccatgggtttccaaggtgctccccactgagaaactgcgctgctgcctttgtttcttaataaccacttcttcttgtttttattctgtttttagagatcactcttccaaaagcacttaaggccatgtgggaagaccccatggcccatgacatgaaagcatcttgaagattttactctaatttttttaaggttttttgatgttttgttttgtttaatgcagcagttttacttactgctttaagtgtaggtgacactctggttttattcctccctttgtgatggattttgttttgttttcttttttttttttttgagacaatcttgctctggtgcccaggctggagtgcagtggtgtgatctcagctcactgcagcctccacctcccaggttcaagcaattctcctgcctcagactcccaagtagctgggactacaggcatgtgccaccacaaccagctaatttttgtatttttagtagagacagggcttcaccatgttggccaggatggtcttgatctcctgacctcgtgatccgccttcctcagcctcccaaaatgctgggattacaggcgtgagctaccctacccagccatggatttccttttaaggcttcttttttgttgcaatgccttcctctgtgaaagcaaaagaaaaaaaaagagatcattctttatctttcaaatgaaaactgaaattactatatttattttgcatatttatagttcaaatgaatactatgtactgattgtgtgaatgtgtcccccatatttcacgtgcggacttaatctccagtgtggcagtattgagaggtggggcctttaagaggtgattgaaattggaagagacaagataagtacccagagaaaagtcaccatgtcagtaagggcctagaaactgtatcatttcctcagcttcttctttcttttctcttagtatctaagaagcatgttactgcaccaaggaccccgcatctcctcttcctctttctggagggttctgaccacagttgctctcaataggagctggcaagtaatggcatgttttccctattatatattaaaagatggggccccaagatgcctacctcactggcaatcaccctgccacaaatggatgctgatctcaaggtgaatgaatgaatacgtgtaattaccctattttttccattctttctttcattcgctgttttaatagaaaacatctcttgagatctgcgtcatcagactgtgcgtggacagctctggaccacatctggaatgaaggggaggggtgtgtgtgtgtgtgtgtgtgtgtgtgtgtgtgtgtgtgtgtgtctgaatggagcatctttgtccagaggagctgaagtcagaaaaatgcccccaaccaacaggattccagccctggctctgatgctgaaggtctctggagctcctctgctgaagtggggtatgtgtggggtggggtggagagcatcagggattttaatttaattttttttaacagagaatcaaaggtctctgacagggtatcaactctaatgttgagaaatatggaaacgttctctgtgctgcacaaactgatgtaaacagctacacatctcggttcagcacttgaaatgtggatagtgcagatgaggagctgaagttttttaaataaatgctatcatgtatatttaaattatgttatgggatacatctagtgaaatgttactatagtgaagcaaattaaagtatctgtcatcttacagttaccacctttttttttggtggtgggtgtgggttgtggcaagagcagctaagagttagcaggcatctcaaatgtgtgcagtcgtattccctgtagtactcctgttgtgcattagatctctagacttgttcgtctcatattccctgtagtgctcttgctgtgcattagatctctagacttattcgtcatccatagctgctactttgcatcctgtgacctacgtctctccattccctctccccacctccggcccatcagccctgttttattcactatttctgtataactgacttttgcgtttttagatttcacatgtgagatcatgcaatatttttttctttctgcatctgtcctagttcccttagcataattaaggactgaatttctaatcttaattcattttcatttaacaaactacatgcaactaattgttaccaaatggtgtagcacagctctagggcgctagggaaggaagccgaaaagaccttttcttgactttgaggtctatggtacagccagagaggccgatggggcagatggggccctgggaactggggtttggggacagggcaggagcaggttaggtttgatgggacatggctgggatcccttcccatgggagacctcttcctctgtgacacacacaactattaaataaaggaattcactttctcaaaaacacatttcctttgtctctagccttttctcccttaaagagacatacccactctttttctaacacacacacgcacacactcacaccctttgtcacagggtcttgtatacactttcacactctctcctccagcctctctcacacacactcttatacctcatcccggtctctctcgtccacgctctgccccacggccaacacacacacactcttttatcacaagtgagcctacagatgcccttctcttggcccttttccccacctgctgagacacatgtattctggtgcattctctcaacagagaaatgtggagtcacgcacagcatctatggaaatatgtacacactttctttcccatcctgcatgctcgtgcaccacctatactccctctgttgagcatactcacagttgttccataagcattccatatgttttggtattttatgttttcattttcattcattcccagaatgacttatttcccttataattttttttctttgacccatcggttgtttaagagtgtattgtttaatgtctgcatgcttttttaattaactagttttgcttctggtattgattcctacctcctttcattgcgtttggagaatataattcatataatttcaatctttatgaatttgttcaaacttcttttgtagcctaacatgcctcattctggaaaatgttccatgtgcacttgaaaaaatgtgtattctgaagttgttgggtggcacgttctagagaggtctgttaggtctagctggtttttaatgttgttcaagtcctctatttctttattgaccttctgtctggctgttctacccatcactgaaggtggaatgttgaaatcagcaactgttattgtagaactgtctatttcttacttcagttcattcattgtttgcctcatatgttttaggaccccattatttggtgtgtatatatttataattgttatatcttatgtatgaattggcccttttattaatatataatgtcctctatttctattgtaaaagttttgatttaaagtatgttttgtctaatacaaattaccgacaggtacatggaaaaatgcccaacatcacaagtcatcagggaaatgcaaattaaaccacaatatcacctcacactcattaaaatggccattatcaaaaagactaaacatagtaagtattggcgaggatgtggcagaagggaacctatgcacacattggtgggaatgtaaattactgcagccattatggaaaataatgtgaagtttcctcaaaagattgcaaatagagccatcacatgatccagaaatcccattactgggcatatagccaaaggaaataaaatcagtatctcaaagagatatctgaacgcccatgttcaatacattattcacactagctgagatatggaatcaaccaacgtgtccactaatggatgaatgagtacagacaatgtgatgcacagtcatttgccacattatgacattttggtcaatgacagactgttttatatgacagtggatgcataagattattgtggagctgataattttgtatcacctagtgacatcatagctgtctcaatattgtagtgcaatgcattacttacatgtttatggtgatgctgatgttaacaaacctactgttctgtccatcataacaaaagtctagcacatgcaattatgtacagtacataatgctcaataataaatgactgcattactggtttatgtatttactatactatttattgttatttggggtttacttctacttattttttaaaattaattgtaaaacagcctcaggcatgtccttcaggaggtattccagaagcaagcgttgtcatcacaggagataacagctccatgcatgttattgcccttgaagaacttccagtggggcaatttgtagagttgggagacagtgatattgattatcctgaccctgtgtaagcctaggctaatttgtgtgtgtttgagtcttagttttcaataaaaaaaattgaaagttaaaaataaaatgtaaatagaaaaaaagtttacaaaataaggatatatgagaaagtatttttgtacagctatacaatgtgcttgtgttttaagctaagtattattacaaaagaatcaaaagtcaaaaaaattaaaaatttataaaataaaaaagttacagtaagctaagtttataattgaaagaaaactttttataaatttagtgtagccagcctaagtgtatagtgtttgtaaagtctacagtagtgtgcagtaatgtcctggggcttaatattcattaaagtaactgaacttatagaagcagagagtagaatggtagttgtgagggtcggggggcaggtaggggagagaaggggagatgttggtcaaggggtacaaagcttcaattagacaagatgaataagttccggaaatctattgtacagcaaggctactgtagctaataataacttattatatacttgaaaattgctaagagaatagatttttaaatgtcctcaccacaccaaaataatgatatgtatgtaaggtgatggatatgtcaaccagcttgatttaataatttcacaaggggtgtgtgtgtgtgtgtatatacacacacatatataatgtatatatttaatgtatatataatttgtatatcaaaacggcatgccatatactataaatatgtatatataattttttaaaattttactttaagttctgggacacgtgcataatgtgcaggtttgttacataggtatacagtgccatggtggtttgctgcacccatcaacccatcatctacattagatatttctcctaatgctaaccctaccctagcccccaccccccaacaggccctggtgtgtgatgttcccctccctgtgtccatatgttctcattgttcaactctcacttatgagtgagaacatgcggtatttggttttctgttcctgtgttagtttgctaacaatgatggtttccagcttcatccatgtccctgcaaaggacatgaactcatccgtttttatggctgcatagtattccatggtgtatatgtgccacattttctttatccagtctatcactgatgggcatttgggttggttccaagtctttgctattgtgaacagtgctgcaatacatgtgcatgtgtttttatagtagaatgatttataatccttggggcatatacccagtaatgggattgctaggtcaaatggtatttctggttctagatccttgaggaatcaccacactgtcttccacaatggttgaatgaatttatgctcccaccgacagtgtaaaagcattcatatttctccacatcctctccagcatctgttatttcttgactttttaatgatcgccattctaactggcatggtatctcattgttgtggttttaatttgcatttctctagtgagcagtgatgatgagctttatttcatatgtttgttggctgcataaatgtcttcttttgagaagtgtctgttcatatcctttgcccactttttgatggggttgtttttttcttgtacatttctttaagttcttcgtagattctggatattagccttttatcagatggatagattgcaaaatttttctcccattctgtaggttgcctgttcactctgatgatagtctcttttgctatgcagaagctctttagtttaattagatcccaattgtcaattttggcttttgttgccattgcttttggtattttagtcatgaagtctttgcctatgcctatgtcctgaatagtattgcctaggttttcttctagggtttttatggttttaggtcttatgtttaagccattaatccatcttgagttaatttttgtatgaggtataaggaaggggtccggtttcagttttctgcatatggctagccagtttttccaacacaatttattaaatagggaatcctttccccattgcttattttttgtcaggtttgtcaaagatcagatggttgcagttgtgtggcgttatttctgaggcctctgttctgttccattggtctacatatctgttttggtaccagtaccatgctgttttggttactgtagccttgtagcatagtttgaagtcaggtagcatgatgcctccagctttgtcctttttgcttaggattgtcttggctatacgggctcttttctggttccatatgaaatctaaagtagttgtttctaattctgtgaagaaagtcaatagtagcttgatggggatagcattgaatctataaattacattgggcagtatggccatttccacaatattgattcttcctatccataagcatggaatgtttttccatttgtttgtgtcctatcttatttccttgaccagtggaacagtggtttgtagttctccttaaagaggtccttcacatcccttgtaagttggattcctaggtattttattctctttgtagcaattgtgaatgggagttcactcatgattttgtgtctggaattggtgggttcttggtctagccgatttcaagaatgaagcgacagaccctcgcagtgagtgttatagttcttaaagatggtgtgtccagagtttgttccttcagatgttcagatgtgtccagagtttcttccttctggtgggttcgtggtctcgctgacttcaggaatgaagctgcagaccttcacggtgagtgttgcagctcttaaaggcagcgtgtctggagttgttcgttccttctggtgggtttgtggtctcgctggcctcagaagtgaagctgcagacctttgcagggagtgctacagctcataaaggtgacgcggacccaaagagtgagcagcagcaagatttattgtgaagagcgaaagaacaaagcttccacaccgtggaaggagaccagagcgggttgccgcagctggctcccggtggcctgcctttattcccttatttggccccacccacataatgctgactggtccattttacagagagctgatcggtccattttacagagtgctgagtggtccgttttgacagagtgctgattggtgcgtttacaaacctttagctagacacaaaagttctccaagtcccctacctgattagctagacacagagcgctgactggtgcgtttacaaacctttagctagacacagtgctgattggtgcgtttacaatcttttagctagacagaaaagttctccaagtccccatccgtcccagaagcccagccggcttcatctctcactggcattggcagggcagcgggactttgcgacacctagcccgggcactccagcatcccagagggagctcctcccagacaatcaagagggaaagaggggaagcagaaagagacggagacctgctatcttggccaacgatcccgtgaagagggaacggcggtctacgcagggaattcagcttcctatcaagcctagcaggtgaggccggccacgcctgagtgcggggcttgcggagccgcgctcacctggaacccgcgcctgcccgcgagcgcggcgcccagcccgggctccctcccgcgcctctctcttcacacttcccctggagcagagtgcacagaggccggctgaagggctccacgagcgcggccacagggaacgctgaggccgaggaggcgccggcaggcgccgagagcgagcgagggctgctagcactttgtcacctctcaatttggctctctgtttatctattattggtgtgtaggaatgcttgtgatttttgcacattgattttgtatcctgagcctttgctgaaattgctgatcagcttgacgggattttggcttgagacagtggggttttctaaatatagaatcatgtgatctgcaaacagagacaatttgacttcctctcttcctattggaataccctttattactttctcttgcctgattgccctggccagaacttccagtactatgctgaataggagtggtgagagagggcatccttgtcttgtgcaggttttcaaagggaatgtttccagcttttgcccattcagtataatactgtctatgggtttgtcataactagctcttattattttgagctatgttccatcaatacctagcttattgagagtttgagcatgaatggggtgttgaattttattgaaggccttttctgcatctattgaggtaatcatgtggtttttgtcattggttctgtttatgtgatggattatgtttattgacttgcttatgttgaaccagccttgaatcccagggatgcagccgacttgatcatggtggataagctttttgatgtgctgctgcatttggttttccagtattttattcagtattttcacattagtgttcatcagggatattggcctcaaattctctttttttgttgtgtctctgccagcttttggtatcaggatgatgtttgcctcataaaatgagttagggaggagtccctctttttctattgtttggaatagtttcagaagaaatgttaccagctcctctttgtacctctagtagaatttggccttgaatctgtctggtcctgggctttcttggttggtaggctattaattactgcctcaatttcagaacttattattagtctattcagggatttgacttcttcctgatttagtcttgggagggtgtatgtgtccaggaatttatccatttcttctggattttctagtttatttgcatagaggtgtttattctctgattgtagtttgtatttctgtgggatcagtggtgatctccacttttcattttttattgtgtctatttgattcttctctcttttcttctttattagtctggctagtggtctatctattttgttaatcttttcaaaaaccggctcctggattcattgattttttgaaggattttttcatgtctcttcttcagttctgctctgatcttagttatttcttgtcttctagcttttgcatttgtttgctcttgcttctctagttcttttaattgtgatgttagggtgtcgattttatatccttcctgctttctcctgtgggcatttagtgttataaatttccctgtaaacactgctttagctgtgttccagaggttctggtataatgtgtctttgttctcattggtttcaaataacttatttaattctgccttaattttgctatttacccagtagtcatttaggagcaggttgttcagtttccatgtagttgtgcagttttgagtgagtttcttaatcctgagttctaattcgatctcactgtggtctgagaggctgtttgttatgatttccattcttttgcatttgctgaggagtgctttaataccaattatgtgatcaattttagaataagtgtaatgtggtgctgagaagaatgtatattctgttgatttggggtggagagttctgtagatgtctattaggtctgcttgttccagagctgagttcaatccctaaatatccttaataattttgtcttattgatctaatattgacagcggggtgttaaagtctcccactattattgcgtgagagtccaagtctctttgtaggtctgtaagaatttgctttatgaatgacgttgctcctgtattgggtgcatatatatttaggatagttagctcttcttgttgcatttatctctttgccattatgtaatgcccttctctgtcttttttgatctttgttggtttaaagactgttttatcagagactaggattgcaacccctgtcttttttttgctttccattttcttggtaactattcctccatccctttattttgagcctatgtgtgtctttgcacatgagatgggtctcctgaatacagcacactgatgggtcttaactctttatccaatttgccagtctgtgtcttttaattggggcatttagcccatttacatttaaggttaatattgttatatgtgaatttgatcctgtcattatgatgctagctggttattttgtctgttaattgatgcagtttcttcatagtgtcgatggtctttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaactgtaatgacagatggcctgtagttggagttggggtggggattgactgcaaagaaaatttgggtattttgctctaaaacctgattgtcatgaggattttatgactatatatatttactaaagtttgaataattcaaaacacttaaaattagtgaatttaatgcatacaatatgtgcctatgaagccataaagcaaaagagttaattggtcccttctgtaaatatggtgatattatggtaattatatatttatttttcctttaattgtataccaactatgtgccagatacccttctctctgcctttgcatgacactgttgaacaaaagtcatcattcctccaaccacttaaagcaggtggtcggactcctcaggatttctctctaataatttggtgaaaagtctgagatggtcatttggatccatgctgtcttgctgatgttatccagccacttcctccttttagcctcatatcttcctgctgcatgacctgcaaaatgtatcctctctcaacctcagtctcttcttcttcaaagtgcagatgataacagaatttacctctagagttgttctgaatagtacacgagtttaacatttgtaaaaattttagaacaaagtcaagtacatagtaatctatgttaaatgaaatcattctgaaactccttctcacagttatcccagttgccattgcttgtagtacttagaacaatgttcaatatcatatcaagtgatacaattttacttggcaatttagaaacagttattgacttcccattgctttcagagaaaagcctaaatttgttatcatcatatacaagaacttcaacatggcccttatgaccctctctggtctcagtcagtaagtcaataaacatttattaggcattctctgttgtccttctctatgccatgcactggggatatttttgagctactgtaaatagtaatgtttttcaaatttcagtttccagttgttcattgccagtgtgtagacatacaactaattttttaaatactggccttgttttctaaaaccttgttaaactcacttatttgttctaatagcttttaaaattgattttacagaatttttagtcatgtcatctgaaattaaaggtggttttatttctttctttccaatctgtatacctttccttttctgtttctcactttattgcactggctaagttgatgatatgatattgaataagaccgctgtccttgtcttgttccagatcttagtggcaaaatcattcaatctttcacaattaagcataattatagcagaagaatcttagtggatactctttatcagattgaggaagcttccttatattttctctctctctctctctctctctctctctcgtgtgtgtgtgtgtgtgtgtgtgtgtgtgtgtatttattgcatgcttaataatgcatattgtaatagatacattatttgagactttggttaatctttgtttcttagacctctttattgaatttccaattaattaccagactcttgcgtatttttctcctaggagttatcttatttattactgcattcataaatgaaaaacatttgcatggacccaactgattgtgtggctaattaaatgttaagagcataaaatctcatgtaaagcagaagataaatttgaatgcaataaaaaaggcatagatggacgattgacttctggaattgaaaacacattgtgggccgggcacagtggctcacgcctgtaatcccagcactttgagaggccgaggcaggtggatcacctgaggtcaggagttcgagaccagcctggctaacatggcaaaaccccatctctactaaaaatacaaaaattagctgggtatggtggcgagcacctgcaatcccagctactggggaggctgaagcaggagaatcgcttaaacctgggaggtggatgttgcaatgagccgagattgtgccattgctctccagcctgggagacaagagcaaaactccttctcaaaaaaaaaaaaaaaaagaaaaagaaaaaagaaaaagaaaacacagtgtgctatgattgcctttatgaaggcttttaatgaacacactttaaattgaaaaccactttagttaataaaagatgttctcttcccaatgcaccactccattctggattcccctgggaatcagagatttttataaaggatactagtgttaagcaactgaattgtggccgcacacagtggctcaagaggtcaagagattgagtccatcctgcccaacatggtgaaaccccgtctctactaaaaatacaaaaattagctgggtgtggtggcgcacaggtactcgggaggccgaggcaggagaatcgcttgaacccaagaggcagaggttgcagtgagccaagatcgtgccatgcactcccgcctggtgacagactgagactctgtctcaaaaaaaagaaagaaactcaattgttcccatgtaaaaatgaggcaagtctatctaggtccacagtagattcaaagtgcacatcatggaataagacacgaaatgcatatgtaacataattatcatcagttttcttcataaacacaagagattttaagctttgtgccaaaaacctggatgatgtgctgttttctttcactgaattcaacatgttttgacattgacgcttttcaaaaacacgttttgtacactgtcaaaaaataacattctagagcccggttagcacttccaggaagatatgcacatacagccctaaatacttaaagcaagatatggcacaaaaataatgtatgatgtgctgttttctttccctgaattcaacatgcattaactaagagcagttttcaaggacacatcttgtcaaatctcagaagaaaaaattgtgagcatagtaaccacccacaggtaatgtaagtatctagtcctaaaaagtaaacacaaggtttggcccaaaaccaaggtgatgtgctgtttcctttcactgaaataaacatgttttcacatcggtcactttaaaaaaacatgttttgtagaagctcagaaaaaaaaaaaacattttgaagcccagtttgcacttccaggaagatatacatatagagacctaaatgctaaaagcaagatatggcacaaaacatggtttcaccatgttggccaggatggtctcgatctcttgacctcataatattttcttttattgaatttaacatgtattaactaagagcagttttgaaaggcacatcttctttaatctcagaaaactcaattgtgagcataacaggcccacacagaagatgcgagtatctagacctaaacggcaaatgcaagctttgtgtcaaaaacctagatgatgctttgttttctttcactgaactatacatgttttggcattggtcacatttcgaaatcatgttttgtacaagcacacacacaaaaaatgttaaagcccagttagcacttccaggaagagatgcatatatagtcataaatgctaatagcaatatatggcacacagataatgtatgatgtgctgttttctttctctgaactcaacacgtattaattaagagcaattttaaaagacacaacttgtcaaatctcagaaaacacaattatgagcacagttcacccacacgaaacatgcaagtatctaggcataaaaagtacatgcaagctttgtgccaaaaacctagatgatatgcagttttctttcactaaattcaacatgttttgacattgatcactttttaaaaatatgttttgtacacactcagaaaataacatttgggagcccagttagagcttccaggaacatatgcatagacaccctaaatacttaaagcaatatatgacacacaaataatgtatgaagtgctgtcttttttcactgaattaaacatgtataaactgagagcagttttcaaagacccttcttctcaaatctcagaagaaacaattttgagcatagtaggcccacacagaaaatgtatctagcacttaaaggtaaatacaagctttgcgccaaaaatgtagatgatgtgctgtgttttttttctttgaactcaccatgttttgacgttgatcaccttccaaaagcacgttctgtacaagctccccaaaaaaacattttaaagcccagttagttcttccagaaagatatgcatatacaatcctaaatgctaaatatggcacacaaataatgtatgatgtgctgttttctttcactgaattcaacatgcattaactaagagcagttttcaaagacacatcttgtcaaatctcagaaaacacaattctgagcatcgtgggctcacccagaaaaatgtcaatatctagccctacaaggtaaacacaagtgttttgttaaaaaacaaaatgatgtgctgttttctttcactaaactcaacatgttttgacattgatcacttctcaagaaaatgttttgtacaagctgaggagaacaacattcagagcctagttcgtgcttccaggaagatatgcatatagagccctaaatgctaaaagcaagatatggcacaccaataatgtatgatgtgctattttctttcactgaattcaaaatgtattaactaagagcagtttttgaagacacttcttggcaaatctcagaaaacacaattctgagcacagtaggctcacaaagaacatgagagtatttatccctaaaagttaaatgcaaactttatcccaaaaacctagatgatgtgttgttttctctcactgaattcagggtattttgaaattgatcacctttaaataacacgttttctacaagctcagaaaattacattttggagcccagttagcacttccaggaagatatgcatacacaccactaaatgctaaaagcaagatatgacatacaaataatgtatgatgtactttgttctttcagtgaattcaatatttattaaccaagaccagttttcaaaaagacatcttgtcaaatctcagaaaacactattgtgaccatagtaggcttacacagaaaatgctaatatctagccctaaaaggtaaacacaagatttatgttagacaactagatgatgtgctgggttttttcactgaactcaacatgttttgtcattgatcacttttcaaaaacattttttgtagaatctcaaagtaaaacatttcaatgctcttagtgcttccaggaagatatgtgcatatattcccaaatgttaaaagcaagatatggtgcacaaataatgtaagatgtgcttttttactgagttcaatatgtattaaccaagagcagttttcaaagacacagcttgtcaaatctcagaaaacacaattctgaccacagtaggctgacacagaacatatgcattccagagctgaaaagtaaactcaaggtttgtgcaaaaacaaagaatatgtgctgttttctttcactaaattcaacatgttttgacattgatcacttttcaaaaacacgttttgtacaagcccagaaaaaatatttccgagcacagttactgcttccagaaagacgtgcatatagagccctaaatgctaaaagcaatgtatggcacacaaataatttatgatgtgcccttttctttcactaaattcaacatgtattaaggaagagcagtttctaaagaaacaacttgttaaatctcagacaacacaattctgagcagagtaggttcacacacaacatgcgagtatgcagctgcaataaataaatgcaagctttgtgtcaaaaacctagatgaagtggttttctttcattgaatccaacatattttgacattgatcactttttaaaaagacgtttagtacaagctaaaaaaaaaatttcgcagcccagttagtgcttccagggagatatgcttatacagtcctgaatgctaaaggcaagatatggcccataaataatgtatgctgtgctgttttattcactgaacttaacatgtattaactaagagcagttttcaaagacacctcttgtcaaatatcggaagaaataattgcaaacataacaggccgacacagaaaatgtgaatatctagtcctgaaaggtaaacgcaagctttgtgttaacaatgtagatgatgtgcttttttttcccaagtgaactcaacatgttttgacattgattacttttcaagaaacgttttgtaaagctcaaaaaaaacttttaaaagtccagttcgtgcttccaggaagatatgcatatacagccctaaatgcaaaaagcaagatatggcacacaaataatgcatgatgtgctatttctttccctaaattcaacatgtattacctaagagcagttttcaaagacacatcttgtcaaatctcaggaaacacaattctgaacatagtagtttcacagagaaaatgcaaatatctaaccctaaagggtaacctcaaactttgtgccaaaaactcagatgatgtgctcttgtctttcactgaattcatcatgttttgacttttatcatttttcaaaaacacgttttgtacatgcgcagaaaataacatttgaaagcccagttagtgcttccaggaagatatgttttaactccttaaatgctgacagcaagctatggcacaaaaataatatgtgatgtgccgttttctttcactgaattcaacatgtgttaactaaaagcacttttcaaagagacaccttgtcaaatacaagaaaaaacaatggtgagcatagtaggcccacaagaaaatgcgaatatctagccctgaaatgtaaacgcaagctgtgtgccaaaaacctagatgatgtgttgttttattttactgaactcaacatgttttgacactgatcattttcaaaaacacgttttgtacaagctctgaaaaaaactattcggagccaagttagcccttccaggaagatatgcatatgcagtcctaaacgctaaaagcaagatatagcacacaaataatatatgatgtgctgttttctttcactgaatttaacatgtattaactaacagcagttttcaaactggaatgcagtgacaggatctcggctcactgcaacgtccgcctgctgggttcaagagattctcctgcctcggcctcccaaagtgctgggtttacaggcatgagccgccttgcctggccaagacattttgtcaaatatcagaaaaaacaattttgagcttagtaggcccacactgaaaatgcaaatatatagctttaaaaggtaaacacaagctttgtgccaaaaacccagatgatgtgctgttttctttcaatgaattcaacatgttttgattaagagtagttgtcaaagacaaatcttgtcaaaaattggacaaaacaattctgagcatactaggttctgacagaaaatgagaatatctagctttcaaagctaatagcaaactttttccaaaatgtattatgatgtgctgttttctttcattaaattaaacaaattcttattaaagaacagttgtcaaatcttagttttatagaagataaaaaaatactttatcccaggcagccctcattaaaagaggtgaagtccagctctagtaacaaaagcaagctttgtgccaaaatcacatatcatatgcagtattctttcactgaattccacgttttgcctttgaacagttttctttctttctttctttctttctttctttctttctttctttctttctttctttctttctctctctctctctttctttctttctttctttctttctctctctctttctttctttctttctttctctctctctctctctctttctttcttttttttttttccgagacggagtctcgctctgtcgcccaggcgctctgtcgcccaggctggagtgcagtggcgcgatctcggctcactgcaagctctgtctcccaggttcacgccattctcctgcctcagcctcctgagtagctgggactacaggcgcccgccaccacgcccacctaattttttgtatttttagtagagacagggtttcaccgttttagccaggatggtctcgatctcctgacctcctgatccgcccacctcggcctcccaaagtgctgggtttacaggcgtgtgtcaccgtgcccggccgcctttgaacagttttcaaagcaatgttttgtacaagctcagagcaaacacttctgagctaggctagtctttccaggcacatagacataaccagctgtaaacgctaaaaataagatatggcacacatatatggtatggtgtgatgttttctttcacagaattcaacgggttttgatttgaacagttttctttttctttttttattttactttaagttctgggatacaggtgcagaacatgcaggtttgttacataagtatacttgtgccatgttggtttgttgcactcatcaactcatcatctaggttttaagtcttgcatgcattaggtatttgccctaatgctctccctcctcttgcccccaacccccctgacaggctctggtgtgtgatgttgcactccctgtgtccatgtgttctcattgttcaacttcctcttatgagtgacaacaagcattgtttggttttctattcttgtgttagtttgctgagaatgatggcttccagattcatccatgttcctgcaaaggacatggttccatgtccctgcaaagtccatgaaaggactgctccatttatttaaaaattacataagcaaacattattctgtttgggctgagttacagttttgtagcctctatgccaaattttgacactttatagcacttggcagagatgagtatgaaattgcttgattagtaaatgcaaacaaaaatgtatgctggcaactcttaagacgtttctaatcttactgtaccagtaatctttaaagattaaagtcacataaactgaaaggtcccacagcttttactttttacttaaaaatatttgatttaaatgcttatttttaggccaattaattagagctttttaaatagacattacatgcataacacatataaacacatatatagccacacagacaaccagaagaagatacagtagttataattttttttctgctaatttcctaattggattattggcctttgggtgagaccctttaagagcaaggccaggaaaatagtttccagggcctaataaataagcatagctggaagacaaagacattttgaaaggtacttatttacctctaattccagtggttccataaggaaaacagagatttttcccaaaacgggatttgtggcaccttttctgttttcccaaggagtcttaggtcaccagaagttattttagggtttttcatacatgcaccaagagtggcaagacagagtggagaagagtaattcagctgactaggaaaaaaccttttccggccgggtgcggtggctcacacctgtaatcccagcattttgggaggccgaggcaggcagatcactggaggtcaggagttcaagaccagcctgaccaacatggagaaaccctgtctctactaaaaatacaaaattagccaggtatggtggtgcatgcctgtaatcccagctactcgggaggctgaggcaggagaattgcttgaacccaggaggtggaggttgtggtgagccaagatcatgccattgcactccagcctggatgacagagaaagaccctgtctcaaaaacaaacaaacaaacaagcaaacaaaccaaaaaaccctttccaggaaaacaagatttcttaaagagaaaaacataaaggcctttttgaatatgctcgtagcttggatattcattttaattcagctgagcgctctctttgattgggttatgtgcaggaattccctgcaataatgagagggatttttagagaaagttcctcgggactgtttcatctgcaacaaatcagacatggagaaagggacatgaatgtgagcaatgccttcagccccagccacttccaggatagggagaatagcatgggtggtttgagcagtttttggacaggtaacaggtggagaagaaggaggagcagggtttggggctggagaatctggggcaggagggaccaccagggcggagggttaggatggatgaggaacagatgcagtgggatgggaatatggaggaggttcatctgcaaagtcaaaaggggttttggaggaaggaggaaatcctttctcgagaagaaggatttcatgacgagtgcaagcttgatatagggaagggcgagatctaaggtagaagaaagcctgaatatagataacctcttgcatttgccattcctggttataaatttgtcaaggtccctgagaatttgcaactcagaagtgccatttttgggccatcagatgtcattatctaatgtgtatttgggccaggccatgttgcaataaaagactaaatgctttggctttatgcttccatgtaagccatgtttggtgagtttatgaaggaagcagcccagtgggggtattgtaagaatgtgagattgtttggcacccatgtggactggtgagaagaagctgaaggtgtctgtttttgttctaagcatccccagacaaaagacagagacccaagagacccagagccctctttctaaagaggatggtcaagctgagaagaagctgggcatccctatgatttcttctagtttagtcctgctagtcctgaaaggacaaggacagcagacctgactttcccaggtgctgtgagaaaagcaggggagggcagattttactagttggctggattagtgtccaatgttggatgttccagttggaattggcaaagggccccttagactggagccgcacaagggagagacaaagagagaagggaggatgagggaagaggaaaggagagagtgaaatacccgttgtgggtggttggaggtggattcctgagacctgagggttttgagaactctctggggagtatcaccacccagagcctcgcaatccctttcagggattaagcaaatcgctagaaaagtgaagtgagagaaaagatggggcaggtagccaaagaccctcaggatccaggagttaactcaggataagctgccattgtccactgtttcctgggttgcaagagagcctctgcccataacacccatcccgggtttcagcaccaaatgtaagagttaaagaacgaggaaagaaacacaaaatgcagcttaacagttaatgacagatttattttagagaaaataaacctgagaggggcatctgggccgattttagtcaggaacattctctcttacagactaagagtatatattggttttagggtgaaggggcttatcacaagcctggattgtttctgtgtgggggaggaatttatggtggggttggaatgtcacataacattgtggaatgtctctgggcagaggggaggttggttatcttggggctgacctctttctggctggaggggtgttattttggggctagcatgtctctggttggggacaagtttggaatgtttctggctggagatgttatatgtggtttatggtcatgctgaccttaaccattaggctgatgccctttggatttaggtggtttttgagtaaggtgaactttagaatgagggcttgtccaagatggtgatgcttctcctctgtcaattacaatactaacataaaagatcactcatcacagatcatcataacagatataataataataataatgaaaaatttgagctactacgagaattacaaaaatgagacactgacaaaaagtgaacacatactatcagaaaaaatgtcccaaatagacttgctctatgcacggttgacataaaccttaaattggttaaaaaaatgcaatatctgcaaagcagaataaaacaaagtgcaattaaacaagatacacctgtttagtgcatgaggaaagcagggactctgttttcttattcaaacttaaattgagagtgtttgtctcatttaaagtatcagtgggctggtgtgaagcaggcgaggagcctgcagtgggtggcatagactgaagccagtgactccaagctgaggccagccttgagcctgtgaatatagggaaggaaatggagcttcccttggtgtttcctgggcagcctgccctcccctgcacgtagcctccagctatttggaacagctaaggggtgtggattctggaagctacagagacctggaaagctggagacctgcatgcagatgtggttgtgggggctgagaacggagcaagagagcatgttgagttctgtcctttctgaggctttacctccagtgtctgggaccatttcctggacaatgttttcattttggtattagaattgcgggagtcagactgtagtttgtaatgaaaaagaaaaaaaattaaagttcctttaaatcaggcccagagaggcatttaaaatgtaacaggagtcatatctcactctccacttgagctaattacctcttgaagccacttgttctgtgggctctaaattaatgctaagtagaacttttacccaatagttcaacaatgtaatgagtcactaaccaatgttatttgtatgaaccaatgagaattcctggacaacttttgtaagttctttgtgatttgtccttttttcttaaaactcaagcctctgctttattctccagagcactccccaaggccaattggaagtgtatcctgggaagttgtcctcaacctcaggccaaatgaaccctctattaattttgccccagcttctgccattaggttgatgcataagtgaagaaaatctgtgaaggtcactcttacagcttcagactggagaaagggtttatgaatttgacagtttattcaggtcagaatcctaaactgatgccatgtgagagcttcttgctggtggatgttaaggcactaaaggagggagtgttgccacgctgaggatggtcagggaagcatgttgagctcacagttcaatccttaggttcctggtctgttccaccccaggctcaatgcgaggggtcagagtctgactcccaagcttggaatactcttagcctcccgaatgcgggttttccttgctaactgtaggtgcagggggctgcttctctgatctagtttaaatgtttgcttttattctcctttagttcctttattgaatattgctgtcatataactccagtttttccatgcatttaataatgatgttcttgttggtgtgtctatcttcttggctgcgaatgaatagattgaaagatagggtatgagaaagccttggccttgccccacagcagcctcatcccagtggccctccctcctgctttctctctctctctctctctctccctctctgtctctctctctccctccctctttctttctttctttctttctgaaggagtcttgctctgttccccaggctggagtatagtggcatgacctcggctcactgcaacttttgcctcctgggttcaagtgattctcctgcctcagtctccccagtagctgggactacaggcatctgccaccaaggcaggctaattttcgtatttttagtagaggcagggcttcaccatgttggcaagtctggtcttgaactcctgacctcgaatgattcacccacctctgcctcccaaactgctgggattacaggcgtgactccctcctgctttagtcttgcctcaccaggcctgggcacccttgctgctctgaggcccggggattactctctccattagactcagtgtggagtttcctcctcctacttgtgacccaccctgcccaggaggaaaaatcaggaagggcccactgcatacaggcaatgccagtgtctacttggcaaagcctgaagaaagtcctgtataaatgcaaatatcacgtccgggcacagggaggatgcgtgccctgtagccatgaacctgtcattcccactccactcagcctccagccagggcggggaacctgagtcagtgtccaatcaggggggctggggaccgtgcacactgttcagtcaggtgtgaagctgtcacccgcaggtgctgggcttcgttgctgtttctggcagagtcctgcttctcgcgcccgctgcactgggtttggcgtctctgctgttcgctgagatctgcacactccaggagccatagggaggacgccaggacagccccgaagacgagaatggtgagtgaaaggggcaggcgtccccagactggggatgggctggtggagccggcgggatgcggctggcgggccgcatatggagctggtggccccgtccctcccgcggtcagctctggggctgtgacctgggaccccggtcatggcttgccccccagggttccctccggccgcagagttggctgggcgagcagctggatggggcgtcctgccagtctcccgggtctcctggatgttcagggccgcgggaggatcctgggagaatcccactcggagtccggggctcatgctcagtccctcctttttcccccggcggggggggtgacgggtttccaagttcacaggaagccagatctcaaacctaccgccctgtccccagcctcgctcctcctaggacgggaggaaaatcccacaaatcctgtctactccaagcagccgcgcccctcgggagaccaccccagttggaggggcccactccagccaccgctacaccgggacgcgctcctcctccccctgtgcccgccccttctcgtgagggaccaccaggaggcccctcgattccccaggtatgggaactctaacaccaatgcctctgctccctgggcggtgagcgcagcgcccacgggtccttcggccaggggctgggctgcctcgatttccatcccggacccgaaaaagggccggacgcggtggcttacacctgtaatctcagcactttggaaggccgaggcgggcggatcacttgaggacaggagttcgagagcagcctggccaaaatggcgaaacccccatctctactaaacatacaaaaaaatttgcgcaccagcatggcacatgtatacatatgtaactaacctgcacaatgtgcacatgtaccctaaaacttagagtataacaaaaaaaaaaatttaaaaaaaaaaatttgctgggcgtgatggtgcgggtggcgggcgcctctagtcccagctactcaggagactgaggcaggagaatcccttgactgcttctggagcccttgtcccccggcaagcacaaccggcccgcagactggtcaggcagcgcggcgtgcgcacgcccatccttgggtccatagctccgtagctgagaccccgcccttcgtctgctctacagtccggtatcccgcccgtcctaggctgggcagtctgggaccctgccaccaccgcgttcctgcgcacctgtgccgcgcgtcttcgccccccagcctccgcgggttctcaggcagccccggcacagccagaatcggcacggccccctcctcctgcgggcctcaagtccctgcccgccatgccccagggccctcagctccaccaccagctacgggtctgccggagagcccgcgacaccctccaccgccagacttcccacattagagtcgttgggtggacaccgtggtggcagcagcggcggcggccaatccaggcggcctgccggaccgcggcagagacggcgcagaggctgcagctcaggcgcctaggtgggttggcggggcgtgctctgggcggcctcagtatcctgagtgcaccgcctcctcagcgcgagagcctgcctgaccacgctgctggctgtctcctcctcagcgggcgcacagagctgggggttcgtagcgctgggcagtcctaacccgcagcctctgcgttgtctctgccgcggtctggcggaccacctggattggccgctaccacgttgtccacccagcgtctctgatgctgggagcctggccgggcagggtgtcctcgctgttgttgcccgcctggagtgcaggtgacgactgcaggtcaggggcaccgaggcaggcggggtaggagtgccctgggcggcctcaggatccggagtggacagcaacagccagcaacctcccaccccgccgggctcccagagacgcggacagagggacagatgcggcagctggggcagccaagctaggcgatctgccgggctgtggcagcacaggggtgggggtaaccagacccactcggccagatctctggtggctgcagagcgccaagaccccagcgctcccagcctgttctggcagtccggcactggaagcccagcgccagccgcgcgtagcctgggagcggcttcctgggcctcgggctggctgtggtgcccaggcgtgggcctaaaggctctgcctggctcactaggtccgagaggtcggaagcggcggtttcgctgctaaaggctttggtgccccgggcttagctaattgtgactggactccggattccgcgaaaaggcgaaggggagctgcagggtagctgaggcttctccgaagctgccgcgatgaagaagctgtttggctccaggaggaagaaggatgaggtggccctgggctccatccctgaccacttctactcggattcctggtagcaccgccgagattgagagctcggcaggatccacaagacggccagagagggagatacggccacagtgcagcagtgccttctgctcaagagccctgcattgaaggagggggacaacaggaacaggagatgggagctcccagccgagggtggcggcgggaagggtgggtctgggaggcgcccctgtccttccgtgcaggccccgcagcccctgggacagggacgccttggagggggcgctggggatctccatgagcagcaaaaccaaaacaaaacgttagctggtttcctatcctcttactcatactgtcccgtctagagcacattatagacaattttagtgatttcactaacaagtatataaagaattttattattattattattttgagacggagtctcactgtcgcccaggctggagtgcagtggcgcatctcggctcactgcaacctctgcctcaggggttcaagcgattctcttgcctcagtctccggagtagttgggattacaggcgctggccaacaaacccggctaatttttgtatttttagtagagatggggtttcaattttagccaggctggtctggaactcctgacctcaagtgatctgcccgccttggcctcctaaactgctgggattacaggcgtgagccactgcgcaggtccaggattttacttttagtgcatacatttaaaacatgatgttatacacatgacaaaaaggtgcataatgagagaaatggttcccgtaatataaatactcttaaaatatttttagtaggctaaaaattctttggatgaaatccaatatccattttatatcaatgtacatctatgtaaatatgttctttactgagggaacttagaaggaaatgttgaagtaggaagagagctgcatgttctttgataggaagaccgatttttcttaaaatgtgagccctttatgtgtttattaattttttataaacctaataaaatatcaaggttttaacatgttatctatatacaaaagaaaacatgcttagctttcctgggaagagaaggaatttaaagtaaaagaggagcgaaatactgttttctattcccaattttgtgatgatgaagagcagtggtgcttatactgctgcttaaagttaaaaagagtctgatgacttttcaaatggataatttggtggtaagtgccgtatttttaaaaaatatatgctctttactcctcaattccattatactaaaatagctttaggaaacagacatatatgcaatttggttttctcagcactgcttaattttaggaagaacccatagaatggattttataaatttcagtgcattcatagcatggaataagtgattgttgaaggtggcaacagataccgaagaatgttgatgtacaaagatgtattttggtatactgagtgagaaaaaaatcagtttgattatatacccatacaggttgtgatcttatgttaccaaaaatatgtacaatatataaagttttttcctttttcttacctttgattttggcaatgagtatgcataaaagttgtagtgaaagtttattattaatagaataatgcttgggaagagaagaatataaatcttcaaagttaaaaataatttatcattttctgtttattattattatttttgtgtagattggtgtcttcggtgaacttttgacctcttcagaataaagggactttttttatctgtgcttgtagattttattatgtatatattttattatatatgtgtgttttcattacatgtaggttcattacatatgtgcaaaaaattaatagggtaatcattttattttcattgtgtccttatgaaaataaaaaatagaagatatacatgattattacttttgcagaagtattggtttactttataggagttttattcaaaaaatattgaactcctcaactgtatttatccattcttaaaagaatttattcatcaaacattacctgaatatctattaggtagcagaaatattctactatctctcagaactcttccatcctgaaaaaatcacgttttccagcccagtctgagcaaacggagagatttaaaattggagtattaggacttcatttcactgaagctttccttccctcctttcaaacaaaagcatttctgggtagaaaatagtaaacgacaaccttaactgcccttttgaaaatgtattagtcttaaatattcatataaatcattgcaagtatgtgatttacatatattgtataaatctaagtattgaataaaatgagtcatacttgctcatttgaatcccaagtttcctttggcttatagtttttttagcaatcaaagtaagaagttgtttttaaaaatttgttgttgttattttagccctctttcctcatagtattttaagaactaactggccaggcgtggtggctcacgcctgtcatcctagcactttgggaggccaaggtgggtggatcatgaggtcaggagttcgaggtcaggtgttcgagaccagcctggccaacatggtgaaaccccatctctactaaagatacaaaaaattagccaggcgtggtggcgcttgcctgtagtcccagctactcgggaggctgaggcaggagaatctcttgaacctggaggcggaggttgcagtgagtcaatatcgtgccattgcactccagcctgggtgacagggcaaggttctgtctaaaaaaaaaaaaaaaaaaaaaaaagaactaactttttgttaagtgccaatcatgcctagagctgccctggaccctttgaatagaccacattctacttcacgtaaggcacaatggattgtgtgatgcttctttattttatgctttttaaggagtttttaaaagtggtagtcctgcctttgtatatgaaggaagtaaagggaaatgaaaatagaaactgaacctcaaaagaatctgagattacaccagtatttgagaaagccagtttactaagtggtggtctgctacaactgaaggatgacagcagtttaagtgaaatagatgagaaaggaaggtgacatctgtaagttctgtatttccctctgaaggagtgttagcagtgattcctttttctggaagtagaatagtgtagtcagccaaagccagggagaatactcagctgtatcaatgttgctgaaagatcaattaagatgaggactagtgactttgacaaggagcagtttcaataaatgtcaccgtgaaaccctgggtgagtcacagagcatgacttagttttcacaacttttgagagaacttttacagggaaaggcaacattgagggacagccaaagaaaaatgagggattcaagggaattttctgtttgtaattttaaaatagaagcctttagagcatgtttgtaggctgatgggaatgatccagtggagaaggacgtgtttatcaaatttaattttgtttgcaagttaaacattagaaagcttgatgcattatcttttaaagacttacaggaaactaattgtccttagcacttttattcatttatagttgtgtgttaagaggttgttccttcagaattggcccaggaatggaatattctagtctaattgaacctgaaaatgataacctaaatattaaactctcatagtagattttttaaatgatgtgatattaaacatacaaacacttaggccaccctgaatagaatgtaaatattccttgaggatgtgtatatattacaataccttttacagtagtattatgaatagctatgatttagtaaggtacttgaaaatatcaggtgtatcaacgtcataatggtttagattctagggagaaggggaggattttgtttctgtacaatagtaaggcaaactattgacaatctgttgtgaattattactttcagattataaagttctaaagtatcaaaatcatttccctggaccaaatgtgtcatcaacatgtattgtgtgcccattaagtatttgttgcatgatgaataaacagttgagtaaatgaataaaatcctgttgctcaaagtctttagaaaacataaactatagttgattgaaagtacattttaaaaattgcctgggtataaagtatttttatttaaaaaatggtaagattcagaaattgttatttatagttatcgccagaaatgggatgataatatgaatttatctgccaccatatcgcctaaaaacacttgaaaataaatgttactttcccttcacagcaaaacacaggttttggagccagagtttctgagtttgaatgtttggtctgctactgaccaactctatgggcttgggtgagttacatggcctttttgtgcctagtttcttttgtgtgtgtgtgcagatgtcaagtacctagtttcttcctttataaaatttctaatatgttacctacctcacagaattgttgtgagaattaaaatgagtttaacacatgtacagtgcttaaaataacacacagtacttgcatagtaagtcctgaaaaggctaactaatggcatcattaaaaaaaggttttcctcttataagggcatagcaatattttgcaaataggtttaagtgctgataaaaacttgtttttattgaaaagggcaataaaaatacctggtatatttctagcaaatgatgcaagtaacattacgtttgtcctttcactttgtttgccagaaagcttgctctaaattgaattcttcattagatgattattagaatagtggtaagagaatattttctttgtccctaaagctactctttctttttatagtttaatcccctctgtaaaaattattgtactttacattacctgcaaaaaatagtaactgcaaactttatgaccaggagaaacaaattataaagcagagatttttatatttaaaaaaacaatagttttagatattctttatattctacatatttactatttgcctaaaaattttttttcttttaggcctgcaaagaaaacatcaaagaagaaggtattgtaaaacatacactatcaaaaatattactgttgaaaatacattataaaacataaaatgaaaaaacaaaagtattttgccataaagacatctactttgaaaaacaattaagaaacagtagccattgataattatccttttaacaaaactcagttcttttaagaagtacctatatttttgcttatataaaaatatggccaattgccacttctgtacacttagtatatgcaataaatatttgggggatgctttaaaacagtattatttattttgtaggtcaaaaaccaattacattctaggagtgaccttgatgacttaactctgtaatctgcagcaacctcagaggatcatgggatgcattatgcacgtcatggaatggattgtaatggtaggaccattacataaataggcctttttgtgcttcctactgtaacgtatgcatgtattgtttagcactgatgtgttatagtgatgttcatctcagaaatctaccttatgttaaaatagaatgagaactcttacatattgtacactctcagccaaagacctagggttattccactgtacttttctcagtgtgaatggcactcccagtgtttctgttgagtctgcatctctcctgtgccttcgtccagctcaggttaccatgtctcccatctggaatatactacaataaccttagatgtgttttccttgctaacctgcctcctaaaaccatggtctactctgccatcataatcatatatttttaaaaattcagatctaattatattaccaccttgcttaaaactgagctattctcattgccagaaggtgaaagatctcagtcctcccgctttaccctgcatcatttcattttcttctttctctgtgtccagccactgtcttagatgtttgttcctgtaatccatagctttagtgaggcataattaatagataataaactgaacaatataagatgtatgatttgataagttttgaaatatatgcaaatatgaaatcatcaccgtaatcaaggaagttaagatattcatcatccacagaagtctcattgtgccactttatgttcttttatcaggaaactgctgaattattttccaaagtatatgtaccattttctgtttctgcagctgtatatgacaattccagttgctctgtgtgtcatcacaaacacttagcatcagcatttattttatattttgagtcattctgaagggtgtgtgttgtgcacatcattatgtttttcatgtttgttacctgaatgactaataatattaagcttctttttatgtgtttatttgccatctgtatatcttctttgctgaattgtcatttcaaacattttgctattaaaaatcaggtttcttttttcttttttctgtttcttttaaacatttcctgaaaattttcagtgtaacatctatgaaatcaaaggatgaagaagatcgtgcccaggtaatacccactctctttgtcttctaaagaaatgttgctttcctgatttcctcccttctcaatttagatgtgaaaatctaacaatacacataatgtacaacatatacaattctctttgtgggggtggtgttcagtgggactctcctcccaactgacacctgataccctaagacattttaaaatgacagtattcattatcaagtgtaatgtagaggcattttcctcagcatcagttttcctccttggagctttgagtgtgctgtgtttgtgatcatcttttcttgctttattatttaaagttgatttttctgagaacaccggcttttttctgccactgctactgtaaaatagcaatgcttttggtttggattagttagcaccccatggggattctgtgtgagatgttttgggttgggtgttttatgttatctgtgatggaaggagtcttcaggacacaactatctcaccggtgcttccttaatcctggagacaaaattctcctactgtatgcccaagtgtttaccctcaccctatgaacttttaggacttgtagcagcacattaatttctctgtccttactgtttacttctgatttaaagagctctccttgggggtggatgacagaatgaacatttactctgggctcactggaaaagctccaacgtcttggaaattgagtgggtaagcacaaccttgagcacattgtcagcattccatttcttttttgaataagaatatgcagttttaccaatatcattggttcaagaggctttcctttcccagttgtgtattcttggcacctttgttgaagatcacttgactgtgtatgtgtgcatttagttctgggctctcttttctctcccaggggttctaatgggtgcccttatgctaggaccatgctgtctaaatttctgtggctttgttgtaaatttgaatcttatgaatgtctgtcctccaacactattctttttcatgttatcatggctatttgaggccatgggaaaattcataaaaataattttaggattagcttttccatttctgcacacatggccattaccagttcgataatagttgttttgagtctgtagatcatttgtgtaatattgtgtattagtaagatttagacttcctatccatgaatacaggatgccttttcacttatttttaccttctttgctttctttcagtagtctttctttctaatcactctacaagtatttcacctccttggttaggtttattcctaagtatttagttattttagatgttattataagtgggattacatttgtcatcttcttgttggatcattcactgttggtttgtattaacaaaccaatcatttgaatattggccttgtaccctgcaactttgatgtaattattaacactaatagcattcttggagattatttctgattttctatatgtagaatgatagagaagttctgtttcacacctattttctcaagatagtctatattgatactgtaaagatatgttcatattcacctactgaatgatgtccttccaaaaggccttgttagattattcaaaaaatattttgtcattacattccacaatttaataaaaaatagtaattcattgtccataatgttgtctttttctccatttagtaaaatgcagtatttctcattacattctgcacacctaactttcctgttagatattatctggaagaatacagaatctattttccttctgttttaagatcatcaatgaccctttaaattctcgatttcattaatctgaagtgaatctgaaatgcagaaatgtgaaggaaggcatttcacacagaaaagaattctaacatttcttgtaacaaattggtgcaaaagtaattgtggttttttgcctttacttttaataacacagcttccttctcttcttcagcctgaaatgtgtatttagtttaccatattggagagcatgttgcttcttctcatatcacaagtttttccaaatatatcataacttctgtgtctaagtcagtttatctaccaaaacatataaattttaaatatatttttgtggattttacaaaattttctctttacagagctattaattatatactttcacccaacctatgatctccaggtataaggaatgcacaaattagttttcctgtgacagcatgcagagcacttttccaaggtgaggctatgggcatctccacaactgggaaacaggctcagtttgagccacttctatttaggaggagtaaatcatacaggatgatattatgtcatatttttagaacaccaagatgttatagaagacaattcatctccccaggtaaactggtgttcatcttatttgaccaggtatttgttgatctttggtcaggtaactcattcattttgtagaaaatataatttttaaaaaattgtaagtagtcactgtgtagaatcaggatgtcaccaaaagcatttttgatacctgtgtctgattccttcaacatcaggttggggttaagttaaagtggttattttggtacaaagcagctgtgtcatggcattagccctgacttggaagcttatctcctgggtttgagtgcccctctggaacttgctaagctgcgagataccaagcaagttgatacacctctactttcttcaagatatacaatacacattttatttaattaacccattcaaccctcacggcagccctcacctgagttgtggttgttcactatctgtactcctcagatgaagaaactaaggtgctaaatgcatatgcccaagcatacaagcccctaaggaaaggaggtaacatgtgcctaggcatgtggccctggtgttaatacaatcaattattgaactgcagttatcaccccaaaaagggtggctcacaaccctgccatcagttgtaaccataaggtgattcccttacccatgccagtcctaggtttacatgggtctacagaaatcccaaacatcgtctacaaggtggctacagtagtcacagagcttagggaaaacatcagcatttgaaactgcaagatttaacatagccattggtgataaaaggacatagaaggcccgtatacctctgatactagggacaaatacaagtttctgaatattaggaagcagcacttagaaatattcataaacactttgggatgcccaggcgggtggctcacgaggtcaagagattgagaccatcctggccaacatggtgaaatcctatctctactaaaaatacaaaaattagctgggtctggtggcatgtgcctgtagtcccagctactccagaggctgagacaggagaatcacttgaacccaggaggcggaggctgcagtgagccaagatcgcaccactgcactccagcccggtgacagagcaagactctgtctcaaaagaaaaaaaaatagcagtttaaaaataatgttatagttgatagaatttgtgaggagggatgtgtaagggacatgtaaggatttcaattgttttgggactttgtgactatttacatagatacatcacacaaggagctttagaacacactttacaagttataaacataaccaatagacaaatggaaaataatgatgatggagctaataagagttttatggtagagacaagtgggagaattttgtgataaatagttgactttttaaaattatgaatacagaaagatgaattttaagcatgttatttagaatcttaggaagtaccagaacaactaataacagaaacaaaaactgtgcctatagccgagtgggtgtggtaggagctcttttctgtattatcttgctcttctttaaattttgaattctttgcaccacacaataaatgaacgtaccttgtattattgtaaatattcccccatcactaacatatttgtgtttggtttctgttcagccccgtcacctgtccttagttcctctgaactatacagaggaacaaatcaatataaatgcagaagagaaaagatgagatcagctgattttggtgttgatatgggtaatatctgatttacattcagttttcatgtgggatctctgtgcctggcttggtttaatgattcaaagtgacaatacagtcaacttctgagaaaatgatctatggaaaattgaaagtttaaaatattttcttcctcctaactttgaagaggacttgtttcatatcaaatctgcctgttcatctgcctgtccgtccactcactgtttatccatggatcttggtgttagcttctgaggtggtaatgaattcaaaacccttctgttcctactctcatattaaaggttcaaaaatcaaccttgattgcgatgaagcactaagcccacaaccacaactcaggtgagggctgccttgagggttgaatgggttaattaaataaaatgtgtattatatatctcgaagaaagtagaggtatatcaacttgcttggtatctcgcagcttagcaagttccagaggggcactcaaacccaggagataagcttccaagtcagggctaatgccatgacacccatgatttatgggtggattggtggcaggacaagatagaaaggaaccagcggtggctcagggttttgacctgagcaaccagggagaggaggtgtcgtgtagacagataggaaagacacaattctttgaacacatttgggactcagatagtcaaggcagcaaggatgaagatggtttgtctcatcacccgtcttccaggtgactctggtgggctccctctttgaaagggtgccttctgggggctgactttcaggctagcggttggcttcttttgactgggggtcaagtgggcctccagacaccctgagctgcatggagaacagcaagggccttttgctcatctgcagtgtacagcactgcctctacttcatcttgatgctgctcctggtcagtcttctcggcacgctggggacctccttactcacagacccaattcctgttaaacaagttaagtgctgccaggtagggtgctctggggtggaccctgcagttctagggagtcactgaagaatagggaaattcctgcattgtctttggaaaggggagggtttgggggagcattggggtgggcagaaacaggcaggtacattttaaagggctcagcagagtgaaacaaagctgaactcaaccagatgtcctgcagcgatctgccaggtattcctttagatcgagaagtttggcttttaaaatgcaaattttccttggaagttttaaatccaccaaccttagtatgaattaatacaatcagggcactcccagctgttacccacccagggggaatgaagccaatggacattcagcccccactgtagtgcagtaggtgagagcatggcaggctctggagcagactgccaggatgccgatcctagccttgcccttactagtgtgtgtgatcccggatgaatatttaacttttctgtggctcagttaaatggatgtaataatatctacctcaaagatcagttatgaggattaaatgagttaatcaatgtaaagcacttagaacagtgtttcgcatatgtacgcctcatcttagtattagctgctgttattgttactattaataaacaatccttgaagagcaagaaccgaattatctgtgccccacaatacccagcatcactccattactatgacagacctgccacatgtatttcttggatgggttactcaatggatctctttgccacttctacatttttcttcttctactttgttttatagcagaggaggggcagaatttaggtggagttcattgctcagctggactgaaaaagctgaactggaataactttcagtgaacatgggcagtgggtaaacattgggaatttgcagactttcaaatgagtcctctctcgagcacacatcctctaagttagtagcaacaccattaactctttgaagactaggaaggcacagtcttattgtctctgtatccttagtccccagcacaggggttcgtagaagaggaatgactgaatcttcaggtgtctgtgggctgccaggaggacacttggccaagaactatgtctcatcttgctttctgagacctcttcccctcttttacacttgttcctgtcttttgaataccaggaagcccaggttgccttctgaccttcagaggccctcacaccacctattccgggggctccagtaccatctttccctgtaaatgaggcagcacagactttgaatttaggcaaacctgggttcaagtttcagcttcactggtatcttgctacactcataaccgtagacaattttacttatttttgttaagtctcagtatcttcatctgcaaaatgtggataatagtaactatctcatggaattgtcatgagggagtttcttaaatgtagttatgtacagaactcttttaaaggaactcctaaaatctcaatgtttatccaaatgagtttttcaataatgctacttggatacatgcaaatataatgttctataatatttagctataaattcaatgtttttatacaacctaaacaaaattacaaactaaatacaaataaaactataacattaataaaatacaaattaacaattttaatgtaacagataatgttttgctgaaattaaacgttgctgatgttgagtttaattgggtgttaaatgttttacttgtcaacttgagtcttgattttcatatgagacatcatgattgccttattatttgtccttttaaacaatatatttttaactactagtccattattttaatgggtcaattgatttatagtgtgtcccccacacaaacacacacaaattttaaatgttccttactacaaaagtcttttcttttctttttttttttttttttgagacagcatgctgctctgtggcccagtctggattgcagtggtgcaatcatggctcactgcagcctcaaactccttggctcaagggatcctcctgtctttacatatgtttattgtggcactattcacaatagcaaagacttggaaccaacccaaatgtccaacaaagatagactggattaagaaagtgtggcacatatacaccatagaatactatgcagccataaaaaaggatgagttcatgtcctttgtatggacatggatgaagctggaaaccatcattctgaccaaactatcacaaaggcagaaaaccaaacactgcatgttctcactcataggtgggaattgaacaatgagaacacctggacacagggtggggaacatcacacactggggcctgtcgtggggtggggggaggggggagggatagcattaggagatctatctaatgtaaatgaaagttaatgtgtgcagcacaccaacatgacacatgtatacacatgtaacagacctgcatgttgtgcacatgtcccctagaacttaaagtataaaaaaataaaaaataaaaaggtgaaggagaggaagcaggaggaaaccgccaagcagacgctgaggccaaacttgctgccaggcgggactttcctccagaaatacccatggaaggacccctggtatggagcaaccccctccaggaagttaagccccagtattccccaactgaaccagaattggggactttcacaaggacatagttttctcccctcagggtggctaacaacagaggaaggaagggtggtcatacctgaagccagccagtgaaaatacttaaaactctccaccaaacttttcatgtgggtattgaaagtacccataagatggccacatccctatttatggggtcaaacctctcaaaaccatccggcaagtaatgaaagcctgtgaagtgtgccagaagtataaccccttagcccatcataaggcctctccaggcagacaaagaacaggacattatcctggagaggactggcagttagattttacccatatgccaaagtcaggaggatttcagtacttactggtctgtgttgatacctttacaaattgggtggaagccttcccttgtagaacagaaaagacccaagaggtggttaaagtcttagttcatgaaataattcctagatttggacttccccaaagcttacagagtgacaatggaccagctttttttttttttttttttgagacggagtctcgctctgtcgcccaggccggattgcggactgcagtggcgcaatctcggctcactgcaagctccgcttcccgggttcacgccattctcctgcctcagcctcccgagtagctgggactacaggcgcccgccaccacgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctggaccagcttttaaagctacaataactcaaggaatttccaaggcactaggaatacaatatcacattcactgtgcttgaaggccacaatcctcaggaaaagtcaaaaaggctaatgaaacacttaagaggcatttgagaaagctaacacaagaaactcatctcccatggcccactttcttgcccatggccttattaagaattcgaaactcccctcacagaatggggcccagtccatatgaaatgctatatggatggccttttctcacaaatgacctcctgcttgatcaggaaatggccaatttagtcaaagatataacttctctggcaaaatatcaacagaatcttaaaactttacttgaaaagtgtgacagggaaaaaggaatagagttgtttcaatcagatctagtattggccaagtctctcctgtctacgtctccatctatggatccttatgggaaggaccatactcagtaatcctctctacccccactgcagttaaagtagtaggagtggaatcctggattcaccacacctgagtcaaaccttggacacctcctgaggaacttgtaggatcatcacctcaggagtcacgaagtcagccagaccagcctcgatacacctgtcagccaccagaggatctgcatctcatatttcggaaagaaaaacctctgagcagaaaaactcctgcagttaatcctgaaaaggaacttttttctacctaaaggaggataagtagaaaacctactgatctttgacatctccccttgctctctttaatggaatccttctactgcttcattacattattaagcagtacagtaactacactttttgcagtaggattatatactgtagctccagccgagacaaaaatcttaatcacatcaggttatcacatcaacccttcttctatcgtccttccttctaacagcaatttactcctttttccctcctctttcctacgaccattccacctacaacacgtcttgactccttttacgtttcctgccatcctcttcgtacttatgtccctttctccaactgcaacacaccccccatgtcagtgtgcctcccttgggggagtcaaccagcattccctcagaaactcttggggattaggtagccccttccaagcacccacatcttttgccgtgtatacttacatgagaacaaaatgttgtaaaactgcttctctctgttctcacaatggccgtacatatcgccaagaaaaaatgatctgatctgactgccctgagaaatggggggccaatgcttgttggacatattatacccatataggtatgtctgactgagggggcctccaagatgaggctaaagaatggcatatccaacaagatatttgtggggaaaagaaagagagatcatactgttactgtgtctatgtagaaagaagtagacataagagactccattttgttctgtactaagaaaaattcttctgctttgagatgctgttaatctgtaaccttacctttaactttgtgctcgcagagacatgtgctgtgttgacttaaggttcaatagatttaaggccatgcaggatgtgctttgttaaacaaatgcttgaaggcagtatgcttgttaaaagtcatcaccactctttaatctcgagtacttaaggacacaatacactgcggaaggccacagggacctctgcctaggaaagctaggtattgtctaaggtttcttctcatgtgatagtttgagatatggcctcataggaagggaaagacctgaccatcccccagcctgacacctgtaaaaggtctgtgctgaggaggattagtaaaggaggaaagcctctttgcagttgagataagaggaaggcatctgtctcctgctggtccctaggaaatggaatgtctctgtgtaaaactcgattgtatgttccctctactgaggtaagagaaaaccaccttaaggctggaggtgagatatgctggcagcaatactgctctttaatgcaccaaagatgtttatgtatgtgcacatcaaagcacagcaccttttctaaccttgtttataacacagagacatttgttcacatgttttcctgctgaccctctccccactattaccctattgtcctgccacatccccgtttctgagatggtagagataatgatcaataaatactgaggaaactcagagaccagtgccggtgcaggtcctccatatgctaagcgccagtcccctaggcccacatttctttctctatactttgtctctgtgtctctttcttttctcggtctctcatcccacccaatgagaaacacccacaggtgtggagaggcaggcaaccccttcatctggcacccaacgtggggcttttctctaaggtgaaggtacgctcgagtgtagtcattgaggacaagtcaacgagagattcctgaatacatctacagtcagccttgcggtaagcttgtgtgatcagaaggacctaaggtagcaatagagcaaactaaaagtaaatatgcctcttatctcagctctattaaaattctttgaaaaagagggggagttagagtctctacaaaaaatctaatcatgctatttcaaacaatagaagaaaatagtctcttatgtctacttctttctacatagacacagcaatagtctgatctctctttcttttcccccacaaaattaaaaacttagtccagccctccagtactcccagtccatacaagaaattagacctttccaggctacaggaagcccttaactctcattctcatctctggagcctctttaacaccacccttacaggaatacaagaagcctctcctggtaatccaaccaactgctggatgtgtctccccttgcattttcaatgtatgtcccagtccctgtccctggacagtggaacttatccaccccagtactaaacatcaccaaatcaatcagtcccatagtcaccaatttaccagccacacaggcctcaaatctcacgtgcataaacttcagcatggctgtcaataagaacaccttctgatgtcagtcctgtatatcagtaaccccaggtttcacctaacttcaggcatttttttttcatctgtgattacacagggtattgatgcctaaacagcactctgaaagaactatgctttcactcctttctagcacctcccatgtccatatatactgaacgagagttacaaagtctccttataccccaatctcgccacacatgagcctttattgtagggaagtaggtggttttctgatagccataaacttcctttggcacctcgtatgccatttacatcatgagtagtccagacagtgagatcctttccttgtattattttgatagcctctgacactaagacaaccaccgccgcaactacccttaaacagtgaggccagccttttgctactacatcaatttccttacttaggtatgccactggttgtggggttgtcccacgagtctgagtaaggactccaagagctaaccctgctctctctgtgacgtataaagagaaattttgtcctgtgggaaggcttaaagctggagcttgtactagggcctgctttaaggatttgaaggctgtttctgcccctggttcccattctactagatgagtatttgccccctgggtatccttgattagagtatagagtggtctggccctctcactacatcctgggatccatagttggcaaaagccagtgattccaaggaacccccacaacagttttaatgtcttagggcaaggataagccagtataggctatattcattccttgctgagggtcctggttcctctggctaagattaggcctagatatttgacctgctgtaggcaaagctgggccttcaacctagacgacttgtacccttgattagctagaaagttcaagagatctagagcagcctgctggcctgaggcttctgaagttgtagccaaaagcaaatcatccacatactgaaggaccagagtgcctggacttgagagtggcctagatcttgggccagtacctgaccaaacagatgaaagctatccctaaaccactggggcaagactgtccatgtaagttgggatatgtagcctgtgggatcctcaaaagcaaagagaaactgggagtcagagtgcagggaaatacagaagaaggcatccttgaagtccagaacaatgaaccattctgcttcctcttggcccctattatagaacaccaaggttgccaggtttaataatgcctccagattttgttcagggcccagggctagcttttggggctttctcctgatatctgcggctgattcggtaataaacttatcttttaggatcaattgacccttgagtgagtcgggtgacaggggagtatattttcttaaggcctcctttgccactcaaggaaggcagaaggattttcttcctttccctgagttatggtggacatcattgaataattcatgggctttttcctaattctccttagtccttctagaacacaggtcagcaaatgtttacgactccagtccccatgatctgagtctaggtcccagtggggatccacgctggagatggcttgctgactggtagggaattgtccctttctttagctcttattctatcatttacttgactaagataccaggatgtccaaactctcaggctgcagctaaaaccacattcttttcattaaaggccaggatttgatcttaacaatagcatgatatctctccaagtgagatcgaaggtttgccctagaccctgtaggacatctgtgtacctatcaggatcacctgaaaactcccccaggtctgccttgatctgctttaaatcagagagggagaaggggacatgtacccaggttgggccaaatttccctccccctacagcttgatgggaacataactgatagcccggggggttttgtggtcctttggagatttctttgcttgtttccttctgggccggggagattagaggaggcttatcattaataggaaggggagctatagagggctaggatatgggggtaagctgagaggtccttctgtgggatgtaaattgcaagctttgcatagttgtggattctccttcaatgaaaagaaagcttggacataagatatttcacttcttttgccttctctcttacagcaaaaggtcaagctgcaggatagtattgtaatttatacttccctcaggtggccattttcccccatcaaagagagaatactggggccaagccacagtgcagaaaaaaatgagccacctctttttcagggtttgcaggtcaaattggtcccaatggcttaggatgcatttcaagggtgagcctgttgatgcctgggtgtttcccatctgaaaggcaaaatcgcccacagttttggtttgtttgttttgccccctgcccaagaacccacaacggtccctggaccctgctgatgaaaatagttgcgctcactgacgcagcagcagaaatacctcttgcccgagaacctgcaacggtccctggaccctgctgatcggaatagttgctcttactgacgcagcagcagaaacactagttttcctcctagaccacaaggaggaccgaggaatgttgtatttagtggcccttaccgatgcattctcgaaaacctgcacctttgcctgtcctcctagaccacagagaggactgagaaaaatcagatttattggcccttaccgacgcattctcgaaaacctgttagagtcctaagcattcttctattagtattgggactttactcgtgtcctataaagatgttatgccccaaaaatgaagtgaagggccataccctgagggagggaagggatatccagggttggaagagtaacgccttttgtcctcacttgaataggaaggatatcatttctgaagctccccatatcctagcttcaggaatagcttttgttaggcctgctggtctgagaagggatcctaaaattccagatagtcccctgcccgacggggctttgggcaaaaattatgtctttctgattggtgagtctgggtgcctaaagaaggtaacacagtcctgaaatttatactagaaatcattcttataggaggaactaggaaagcaccagagacagggagtggtttttagaagcaggactagtctcagagaaaagaggcgagaggaagtttgtctgacaggcgctaggacccaggaggcaagggtcaggataaataggatagatgggcgagtctcgcttgggcgacaaggctttgagagttctgctcatggctgcagggtcaaccaacttgttttcgggaccctggagctgaatgacttccctctctgttgatgctcggctcagcccagaagtacatgaaaagtggaagctggttctaggcaaaccaatgctgccagctctgaagagtcaggggttgttagccctttcccagaaagcttgacacccgtgtctgtagtccagtggccacactagtcgctttcaactggctgacaggtgcaggtatttagcccccaaattctaaggaaaaataggacagaatagcaagcgaaaggggtctgatggtactcactgcttggagataggcgataaccccttcgtggttgccaaaatgtgtccggaattggttccttctggtgggttcttggactcactgacttcaagcatgaagccacagacccttgaggtgagtgttacagctcttaaagatggtgtgtctggagtttgttccttcagatgttcagatgtgtccagagtttcttccttccagtgggttcgtggtctcactgacttcaggagagaagccgcagacctttgcagtgagtgttacagctcttaaaggtagtgcatccagagttgtttgttcctcccggtgggtttgtggtctcgctgacttcaggaatgaagttgcagaccctcacatcatataaaaaggtaaattctaggtggtctagagatataaatattgaaaaaaaaacataagaaatgttaaaagaaaatttagaataatatttgtaccatcttacagtggcgggaaacattgctaagcaagccaggaaatctaggagatagaagaaaaagagagctggctttttaaaatgaacaaaaatgtggccaggcgtggtggctcacgcctgtaatcccagcactttgggaggctgagtggggcagatcacctgaaatcaggagtttaagaccagcctggccaacatgctgaaactctgtctctactaaaaatacaaaaattagccaggcatggtagtgcatgcctgtaatcccagctacttgaaaggtggaggcaggagaatcacttgaactggggaggtggaggttgcagtgagccgagactgcgccaattcactacagcctgggcaacaagagtgaaactctgtctcaaaaaaaaaaaaaaaagtgaacacaaattcaaatgacaaaaggacaccaataacagagtctagaccagtggttctccaccagggtgatgttgtcccattccccaaggggacatacggcaacctggaaatgtttggttgtcacaactgggtaggggtcagggttacttataagcatcctataatgcccagagacccctcactacaaggaattataatgctgaggttgagaaaagctggtctagacaagcggtagtttcggaaaaccacattagccatccatgaatcagatcagacagctctaagttcaaatttgaaccccatcactccctagctgttacttaacctctttaaccctcaggtcagatgacagtattattcacagcacagtgtctgagggtaggatgtttgtgagcgcttgcataagcgctcacatttaatcctgggtagttgtggctattatggccaccattgtgatgatcctaacaaggactccttatgaaacagcaatcaggttccaggcagccaagctgtgtgttcgttattgggtttgggagatgtaaggggtaatggtcaagaacgtctttactgctgaggacctgcaccgactctggctggaagtgtagggagcaggtaggcaaggggaggatggagagggccccaggacaccaggtgggggccaggtactggcaggggggtgtcaagcccatcccagtatcattatcaattaatattatgaaaagtttccatttctatataaattcttatactggctagctaggtcacaagtaagctttttctttctttggttcttatgtagctcattcatagatagtacatattaatgagaaaatgtaagcacagactgccaggtaaaaaatgtattaccatctatttctttcagtaatcatagctagcgcttacatagcttttgttttatttccataaaatgatgcttcatagaacttgcacatatatactgaatgattttagcaactatatccatcaattatgtttttcatagagtctgctgtcaaaattgagcacaatattttagaatatgtatcatggagcagactaaagcaataaagggaaacatcagtctattgctttaaaatcccattaaatccagaattttgacttaacatagccggattactgtccatcatgataaaactattttttttacatttaactggaattgttatttgataaatgtaaaagattaaaaatatctatgtcacaggtttgatcttctaggctaaaaattggcaacatttctttataggtctggatgtcctttgagataaaatgtattttaaattattattgaacagtgtctcatgtcacatgactcaactaaaactaaagaaagttacttgccaattttcaaatttggaatccattaatttttcatcagaaaggcgttgtattttcactctgtcacccaggctggagtgcagtgatgtgatcacgactcactgaagccttgacctccagggcccaagcaatcctcccttctcagcctcccaaatgcctgggaccacaggcatgccccaccacctggctaatttttttttttaatttttgtagagatgaggtctctctatgttacctaggctggtcttgagctactggcctcaagtaatcctcttgcctgggcctcccacagtgctgggattataagtatgagccactgtacctggccacttgcattatttctgtgagaaatttgctgtcatttttacctttgttcttctgtataagctgtaattttttttttcttctggccacttaaaattttctcttagatgagttggttggagaaatttgatgattatgatgtgcctcagtatggtttttttcatgtttttgtgattatggtttgttgaacttttctccatctcccacttatctttggaagaagatatttttatttgagtttgggttttaagtcaattatagcaacagttgagagatgaccctttttcctataccatcttttgatactgagatatttgtcaatcagggtggtatcaggagatgaaccacaccagtaatttaaacaggaaacatttcagggttgttaaaccgtaaagagtagttagctcatgaaaaggataaaaaaagactgttaagcctttcacgagtagcagattcagaaagcagctactgactcatgctgagggaagccagccagcgaaggaactaagagcttgggaatgagactccaggcaaggctgaaattcagactttcccaaaagacctcgactctgctgtgacctccagcctgccagtggccaagatgcttgccagagtgtgtgagccggcgctggtccacagaagggtctgtcattgcccaggggcatgtaggtgggctgaaacagttcggtaggatcagctccaaggtggggagtcagttgcctgaggatgcagcaggacctcatctgtagaagtgtcagccagggaatttatgtttgaattgatcatctttcccccatttcctttttagggatctggaaaattgagtcctaggctaaacagatgccttctttagcagtatagaatgtaggccagacatggtggctcatgcctataatccaggtgctttgggaggtcaaggtgggaggaggtcaggagtttgagaccggcctaggcaacagagtgagaccccatttctacttgaaaattaattagctgggcatagtgctgcctacctatagtcccagctacttgggaggctgagctaggaggatcactgagccctggagtttgagattgcagtgagctatggatgtacctctgcagtccagcctgtgtgatacagcaagaccctgtctcacaacaaacaaacaaacaaacaatcaatcaatcagaaaagacaaagaaaagaaaaagaaaaaagaatacaccatggaaaaggagatgaattttcggtgctcagcagtctgttgctgccataagggggttttggcaaccaagtgttaaatatagtgaaccccaagtttctcttcaaagaatcagtatgtcagtatgttcaactcttttattctttgattctccattttaaagtttaacttcctggttctcttctcccccttgcttctagtttcagtaaacaaccttccggccagtcctaatcagtagttcacctctgttcccctggccacctgctccatcctgactcatcccagtcacctgctttgacctgagtcaccctgctcacccactctgacctaagtcaccttgagttacttgatcctaaccatccttcctgccaaactactcaccctgccactttggctcatacccctgctctccttaaaatagccaatcagaattagcttagactgtgtggtccaaccctagccgataggggaaagacacagcagtgggggctacctgcatcaggaataagaactcctttcccttccctgtccaggtgtgctcttgccattactctattcacgagtgctacccttctatagaagtaaaaattgccttgctgagaaaattaaatttatgttcgagtgctatttcttcgtggcaccagggaacgagcatttctaataattgggctaagtgtaatggctttgctcttgcaggggccaccctcatttcccacctattataccataggttgtgatatttaggctgctgagatttgggaaacaaggctcacacatagaatgagagggaagtcgaccaaagaaaggccctgagatgtagggccaaattccaggacccaggaggaagcactcatggtgaacaagtgcctctggtcaagctagctgagtaactgttgttctaggtgtgaggtggtgactgctttcggttgggggacccttttggtaattctcaaccagggagcagcccagtggtctgcagccaggcagtgggaattactgctctatgaggtcactgcttattccaaccccatgagccaagccattccacctcagccaccacaggaagggaggcctgcagggtgcccctataggcactacccctcccagggttagctaattcctagagatggcaaagagtgtgcctttcatgtgcaaaccaaccaattcagagctcatagcctgaagccctttctttactgggctctcacactctgggccactatccacctgccctcatcattccaagtccaggtaccagaaaactaagtatctagttgtctgtccctgtgcctacgagcccaccaaaagtattcaaactagccaatcctaaacctgcttgctttgcttcccctgttccttcccaggggaaaccacaatacagattcctgtcttccgcctcctgaccacccttgtgcttccctgtatggccttgtgtggcacagtatgtccccttttcttgaaatctatgagtataacaagcttttttctttataccagtcatttctgtgtctgcctgtcttgccatacctgtttaaaaacaaattcgaggcacccttaaaacactgtgccacatcatggtcttgattcaaaacatagactgcatccttaagacaagactcccatatgtcagggtgctgtctctcaataattcatgccataactgagtcttcagcaagtcactccacctttaattaggccagccacttccaggcgatgggtacatggtgagaccagttaatttcatgctgcacttcttttacagtggaatgagttccctgattagacacaacactgtgggaaatgccaccgtggtgggtaaggatcgcaggaacttagagatggtgatgctggaagaagcattacaagcagggacagaaaatccacatcaagcattcatgtcccttccacgatagaagctgccaatggaatcaatctgccagcaggaggctggctggtcccagcattagtgctatataggggactccatgttggtctctgctcttggcagattgggcacttggtgtcagtggtagccaggtcagccttgggaagagggagattttctgtcttagtttatttattgttgttataacaaaatacccaaggctgagtaacttataaggaaaagatgtttatttggtcccctgttctggtggctggaatgttcaagagtgggtagctgcatctggtcagcggcccaggctgcttcaactcatgacagaagacggaaggggagcaggcaaagtgacaacatggcaagagagaggaggcaagagagaaaaactgaggaagccagactcttcttttgtaactacctgttcttgagggaacaaatccattcccgtgagagcaagaactcactccaatggaggacattattcccaagggatctggccccatgagccaaatacctcccaccaggccccacctcccaacattgtcacattgggaattgtatttcagcatgatttttggaggggacaaaccacatctaagccatggcagccacgctgatgagctcatgaacagcctctatgtgtgccaccatgactggccctctgtccatgagtccactgggcaaacacagggatgactgggggacaaggctgactgacatctatggaatgtgtcattttgtccacctgattattgaaacctcctctgcagagagtgttcttgtgccatgtggtgagcgtttatatggaatgtaggggtctgctcataatgtccattctgagaggcccagccctatgccccttcccactctttcttgtcattaattttctttcttttttttcttgtcattaattttctttctttctttttttttttttttttttttttgagatggagttttgctctgtcgctcaggctggagtgtagtggcacgacctcagctaactgcaacctccacctcccaggttcaagcgattctcctgtgtcagcctcctgagtagctgggattataggcacacaccaccaagcctggctaatttttgttatttttagtagagacagggtttcaccatgttaagcgggctggtcttgaactcctggtctcaagtgatcttcccgtctcagcctctcaaagtgctgggattacaggcatgagccaccgtgcctggctactttcattatttttcaaatctgatcgttgatctttctgaggccctgattatccagccaaacctctagcaactcctcatgagtcactgtggtccatatttcttgcggtctctcaacccagaccaagataccagtgaaatatccccctcagtcttctgccccaggaaagccgaccttccctgttgtcgttcagggcaccctgagtggggcagcagtgctgcagctggccaccttcaggtgtcaccagcacgtcttgcagacccagctgtaaacaggctcagattgcttcttcctcagtcaattggtcctagggagcagcccaggtggccttaggctggatggggagacctctgggttcctgtaagcccttacaccagaggcctgggacctgcttcctgccacatctccccagagttctgccgaatatgttctccttgctagaatttttgtttggttcttgggtggtgctcactcaggaatcttcactgtccctggcctgggggttaggggatgggtgagggggcggtggtcagctgctgtcctaggcttgaggcctgcaccacccatcctctggtagtgccccaaggaaggcagttaggcctgggtcctggtcctggtcatcaggaatggacctctctgtgtggtccacagagaagacctctctatgtcttctgggatcctggtctcagcctcctccttcattggatggcattgagtgccggggtgaggctctgctctgccggagctgtctgcctccaggagggaagccagtcaatgcgaggtcaaagatagggcaaatagaaaaggggccgggcctctggcttcaggtggccctgagcaccccacacctggattccatgttattcaaggtaataattctccccttgtctgaggccattcaagttgggtttctgggacctgcgtggggctcactgacatggtctataacagacattgcatgcgtgctctggaagtgtggggggaggggcacccagcaatgctgtcttggccccagatactgtgcagtggacccgtaaacaatgcaagggttggggcaccaaccaccacccctgagcctttgtaatttattgagcattatgtagtatatagactactcttgcattttatttgatcatcagaatgtttcgagttaggtgtaatataggaatgatacttgtgttacataacagaagactggttctaagaagcatatactgagtttttcaaggtttgaaaaaattagactcagtagatcaagaaggtaaattctagatatatggcatacaaaactagaatttataaaacggtgcatatgggcttctttgcatactacctttttttaactttcctttagtgtattaaagtaattaagcctcaggattagtgagaaataaaatggagatacttgtaacccagtaatgctttttatttttaagagacaggttcttactttgtcacccaggctggagtgcagtggcatgatcatagctcactgcaccctcaaacacctaggctcaagtgaccctcccacctcagctttccaagtagctagggctacaagagcacaccgtcacacctggataattaatttttttttttgtagagatgaggtctcactatgttgctcaggctagtctcaaatttctgacctcaagcaatcctcctgcctcggcctccaaaaatgttgggattacagccatgagccagcacacgtagcccagaaatgttcctaaaagccagaaaaataaagttaaatgctattaagaaaaatttaaagggataaaaatatactatgatatatgaaatgtcacagctcagtcacggtcactaaaatattgattaaaatgtaaaacagttcaggcaagtctgagaactgagagggaagtacagaattggtttggaagccagaattaggattgtcagagctgagaaagcagaagcaatgcatgagtgtgcacaggactggggcacataagcagctccatggtatactgtgtgtcctcttatatggcaggccagctccaggccagcagatgagaatcacctgatgggtggaaacagtggatttagataaaacctcagaccatgcatcataactaagagactttaaatgtttgtcttatgggccataaaactaataaaagcaacagcacaggaagaatagagcaggtcggtaagtgcagtaagccaactgccacctcttccagggcatcagtcatcccaaagaaatattggagcagcaagatttgacaaatcttgtgagaagagctcttggttcagagtccaaggcatgatctagaggactcaggtgttcaggggtctccatccccagggaagcaactacattcttttcccagatctattactcttcactgtggtaactctgggaaagtcactcaaaatgtctacattttaactcgctgatttggaaaatataagttgtagcccctgctctgcccatctctcggggctgatgtggggatcatgggaaatcacagatctcctccatgagctggaaagcatcatgcccacacaaagggtgaagtcactttccatccgcccctgcccaggagccatgcaagctccctctctgtattcaaccactactgagtatctggattattcttccagacattgaatgattgggcatttacaaggcatgagtcttctgaaggctttatctgtatttcatccattttagccctatgccatagcatagaccatactaacatttccacatttcagaataggaaactgaggcacagaggggttcatatctctctcccaggtatgtgcagattctaagtaggatttgaacccaggccattcttggtgacttggatctgctgcctttctatattgtctcatctaaataaatgcatctgcctgcacagtcagtctggctttaagtgcaatcaaccttgcaagatcttcctagcatccaactctgcttcaggtgacattgaaaagcagatggtgaaaaatgggatcaaaagtttgatctgtgaataagtttttactaatttctctgtggtcatctgccagcaagatgtcaagagctgtctttattataacacattttctagcatcttgaaatgaagatgcaagaagctgtccacattggcttcaaagatcagttgccacttcaaatagtgggtgaaaaaaatctgcctatgggaaaaaattctccctggtgaacatgaaggtagtgtgaaaatttaatcattaagttcatttaggcaaattatttcagcttatttattcagtgccccatattagagacataactcaataaatgctataccatgttcttcatttattttatgcacgccaatttaaatgtattaagtcaatcaatagtggtacaactacacaagtaaaaatatattgacaacttaaagtttggttcacttttttgtttgtttgtttgttttttggaagcagggactcactcagtcaccccagagtgcagtggtgcaatcatggcttactgcagccttgagctcccaggggcaggtgatcctcccagctcagcctcgagaatagctaggactaaggcatgtgccatcatgctcactcaatttttcttttctttttttctttttttggtagagatggggtttcaccatgttgcccaggcttggttcacttttttttttttttttttgagacagagtctagctctgtcgcccaggctggagtgcggtggcgcgatctcggctcactgcaagctccacctcccaggttcacgccattctcctgcctcagcctcccgagtagctgggactacaggcacctgccaccacacccggctaatttttttgtatttttagtagagatggggtttcaccgtgttagctaggatggtctcgatctcctgacctcgtgatcacccgcttcggcctcccaaagtactaggattacaggcgtgagccaccgcgcccggccagttcacttttaatagtaaagaacatcttaaatgtttagatatttgctttcagtttgggcaagtatgaatacagatattataaaccttcctgtatcatttttgtaaacacaatttttaaaatataaaactaaggaatacctaggattttatgattacttgcttgcatggtaagactcgatttttcttggtaagaatttggtagaatttaccagtgaaacaatcaggatgtagtgttttttgtttttattttgaaaagttaattattattcaattttttttttttttgagacggagtctcactctgtcaccaggctggagtgtagtggcgcaatctcagctcactgcaagctctgcctcccgggttctcgccattctcctgcctccgcctcccgagtagctgggattaaaggtgcacaccaccacgccctgctaatttttgtatttttagtagagatggggtttcatcgtgttggtcaggctggtcttgaactcctgacctcaagtgatccacctgcctcagtctcccaaaatgctgagattacagactggttcttaaggtgactatttcacatggatgaagttgccctcactagaaagccaaggttctgtcttcatttctttctgactctctcattttccttccttcaccaccaaggagaatggcccgggagcagctcagtccatgcttgtcaaccacccacctccatatactccagccctggtccacatcccccaaggctccttttgtaggattcctcaacagcacaaatgcaccaactgtcactctatgttctcctagacctacaggaggagtgtgcaggtgataatccagaggaggaagtgtcatctatcaaggtaagttgcatttccttgtctggaaaagaaatgttttttcaggggcttctttccttattaatgaaatgaagataggaaaatctgaccatggctgggcatggtggctcacgcctgtaatcccagtacaggccgaggtgggcagatcatttgaggtcaggaatttgagaccggactggccagtacagtgaaactctatctctactaaaaatacaaaaattagctaggcgtggtggtgcatgcctgtagtccaagctactcaggaggctgaggcaggcaaatctcttgaacccgggaggtggaggttgcagtgagccaagattacatcactgcacgccagactgggtgagccagcgagaccccatctaaaataaaaataaaataaaaaaataaaaaaatctgactatgtacattatagatgacaaatacaattttcttggtgagggggaatatcaagtgaatatcatttgcacttgatattcatcgttcatcaggccacagttggtcatgggctctagtgacctttagtgacctttagctagagtccatgaccaactgaggcctgatggatgacagagtcaaaaatgacagcaccacttacaaactgtctggtagtgagcatatttctcagtagcaactttttcttcttgagaaaacgttttgtattttccagtcaacatggacttgcaaaacattccatgaaaaccgactgccttttccacaagcatcctctatactttatgatagggctggtgcctaggccactttttgccatctggttctctaatgtcaccaagtgaataaaagacctgtgcaaacaggacatggcatgatctgatccacagggtgttttcctttctcccattgcaggtggagttcacagccaaaaaacaccgtacgtattctaagagtactcccttgctgacaacaaatctaagtgatgagaaaggaggaactctcttgcctgcttttgtctggagacccttcctggcttcagcttcctgataggagtgaggatctggggtgtggtgtgagaaacagaagtcccaataaagaactatgaccatccactatagtctctggaaacagccatatcatttagatggtgtgggtttgtatgcaggagggttgggaagtaactaagggtgagttaatgtgtggtgattgtgaatgtgtttgtcaatgtgtgtgtttcccccaggaaatgtggacccacatgcacagcacagtacaagtgtcacttttcttgaattcctgtcctatagtgaccctcaaacctcaatcatgtcatttttctaataaaaaaaaaaaaacgaacaccaccatacacttcacataaatcacctctttcctccctcaccacagctgtacctgaaggtcagtttaatatctctactccttaaatggagatggtgcagaaaagaataaacccagattttgacacctgaatagaggaggaaaacatgaacccagaaatgggtcccagtattgacgccctgttcctcaacggtgtgatcactcaggcatgggataaggtgttcccacaacagggagttctaggatctatgagtacacctggaactgtgacagcctataaacatgccaagcattgcccatcatcataaggtgggcccagtggtcacataacccagggtagcaaaaggtacagggaaaaacagacactggcatggtcattactgtgaaatacacatagaaagcccacaggcttctggtcagctcacagattctgagaagtgtatggccccacatagaacagtgtaggtcaacatctgtgcgtgctggggtcattcctcagcacttggtcaaagcagggaagaatcaggaagatactgtattgtatttaataacatgaccacctcaagccaaagaaatgctccaatccatagcagatggacaaggtccactgcatcagaactcagacacaaccttgttgttagcctggtgcccatcaccctagctggagatctcccgcacagctaggttagtgaggctcagcactcaccatgtgctgaaccccaggatggactgtcccactgtcaggggctggtgtgagcatgaccagccactgactcgatggatgcacacacagtgagagtggagcagggctcattcctttgtggttagaccctggcacagcaacatgcaacacccaggtctggtaggaaattgagaaggaggtctgcaggcagagttgggggatatcactccaactgtccctgatgacatctaacatttatcttcagataatgttgctaggaataggaaatgccatgttcatgtgaaaactcagtctcctgttacttagactagtcatggtttcttggggaaaccctttaaaatggaaagggtacaagaggttttcttgagggactgagcatcagagtgagctcttggcttccttcctagggggatgaaggagaagtcaagcttcacaaggtggggaaagacaaactcagctgtgggacaggagaacctcagaatccctccagggccaccaagcaccccctagttacctctatggtgggattttaacaaatcacaaggtaatgtggccccaagcccacccttccccacatccacactgagcccagctctcccaggcccttgctctggtctcttgaatggaggtgtttcagggcctttggccataggagggcagggctggggaggaagcctctgctgtcttgatgtggaggcctccagctgggagggaggatccctatcctctgaaccccagcagcccctccatgtcacaggcttactcgccttctacctctgcaccctcatctgagctctctggaagtttcactcctgggtagccaccttaaagatccctacctgccaggtcagggacaaagacagtgaggctctcctctcctcccccagttatgccccagccaccttgcccttgtaccataggggactggcttgagccagctggcacagtgctcccactgcccccagacagctctgattttagattcaggctcagctccacactcactgggtgtgtcactgggcatggagcccgggcccccctgagactgttttctcatctgtaaaatgcgatggaaacaacaactacctcatagatcatcctgagaactcagatttctgtagctatcaccattgttctcaccatcatccctctgaagaagagccaggcaagagcaccctctaattcctctcctcccttcaacctcatttccaccctgtgaggcctgcactacaggctatgtcatctttgtaataactccatggagtgggcttgtggttcacatacaggaacacaatagttgcagtagcctgcccaggctcacagagctgggtgtagagccctctaggtttaaggttgctaagcctttcatagaccatggacatttttgaaaatgtgatgaggccaggcgcggtgactcatgcctgtaatcccagcactttgggaggctgaggcgggtggatgacctgaggtcacagttcgagaccagcctgtccaacatggtgaaaccccgtttctattaaaaatacagaaattagctgggcatactggtggatgcctgtaatcccagctactcgggaggctgaggcaggagaatcgcttgaacccaggaggtgaagtttgcagtgagctgagatggcgccactgcactccagcctgggtgacaagagcgaaactcctactcaaaaaaaaaaaaaaaaaaaaagtgatgaaagtcaccaggttttcccccagaataaagctactcctcacactcatgtatgaagttgtccataattctcggggtcccacagttaagaatactcacattagacatggaacttggtgagcagagggggcttctcccattcatttttgcatccctggtgtgtagcactgagcccagcacacaacaggtgctccaaaggaccttccaatgggcatgtggagggatgaagtagtgaaggtgaatgacagacacacggccaggtgtcgctccaatcagcctcagccctgaaacctgtgtgaccccgagggcccctgctctgctccaggcctccagcagccaggccttggggtccctgctcagggagggccactcacagatcctgtgcccggtccctctctgtgtcttggcccttctctcccacctacatgactcttctctgtgtccccctgaccacctgctcccttctctaggggcacccaggtctcattggactgatcgggcccccatgggacagggagagaagggagatcagggctgccctgggcagagagtgagaggtgtatcaagggcctgatcctgaaaggtgcagggatgagggcagggattcagattgggggtggggaagtgggagttgacactcagctgtcggggagggatccccgggacaggccagcacagcccctcctgtgggtgtcacacaggcagatgcaggtccctctccccgggaaggggtaggtttgagttcagtccgcagggcccctcgtgggaactgacgaggggtggggatggagtgggggtagcactggtccccagggcccctgcctgccttctagggagcccagtgaccaaggcagccctggtgggaaccgcgtgtgtctgagcccctagcaaggccctcaggctctcacaggacggatgcagacacgaggccggggaagccctgctgccatcgtgggactgcccctccagcacccagctttccgtggttctctgggtcccctctgcagtggggccaagacagcccaccctggatcctgagggaccgagattgagggaccctccccagctctggccaggctgcttccttttgtggatggcgaagctgaggtccagaggagggcaggggcatgtcctgggggctacccagggaaaaggagccgacctcaggagtggggtcacggggagcgctcctgcgacctctagggccctagaacccgtcaggatgggatacccgtggccttttgtccactcctgggactggacagaggttcagccagtgccgcacaaccagaagctgcctctggcaagaccaagtcctcagccccttttttttttgagacagaggctcgctcttgttgcctaggctggagtgcagtggcgcgatctcgactcacagcaacctcagcctcccaggttcaagccattctcctgcctcagccccctgagtagctgggattacaggcatgcgccaccatgcccagctaatttttgtatttttactagagacagggttttaccaattggccaggctgatctcaaactcctgacctcaagtgattcacctgccttggcctcccagagtgccaggattacaggtgtgagccactgctccgggccttgaacatcttttctcttacctgttgttcaattttatgtcttctttgcagaattgtctattcaggtgtattgccaaatattagattggatttttttgcactttgaagtgttttctgtgtgtacacatttcacaacccctcataaactatattattgcctgaaattttcacctaatatctaggatgattttttatttgaaaggtagttttctttgctgtgcagaaacttttaagtttgatgtagtccacgtttctttttagtgcttgatacatgtgattttggtcacccataaaataaagtatatgtcagcagaaggaaaagtattcagttgccaaagagatttttctcccaaggtgttttttgtttgtttctcttactctttgcaaaggtgagcagagattcgtgtggctcaacctgtgttttagttacaaaagttttatggtttatggtcttttgttttggcctttaattttggggggctgattttctttcattgtgtgaaataagcatcctatatctgtcttatgcatatggatatcatttttgtcaaagttctttttttttttttgagatggagtctagcactgccgcccatgctggagtgcagtgaggtgatctccgttcactgcaacctctgcctcccagttcaagcgattctcctgcctcagcctcccgagtagctgggattacagtcgcctgccaccacacccagctaattttttgtatttttagtatagatggggtttcactatgttggccaggctggtcttgaactcctgaccttgtgatctgcccacctcagcttcccaaactgccgggattacaggcgtgagccattgtgtccagcccaaaattctttattgagcagcctctgccttccacattgtgtctttgtggtatcctttgtcaaagtgagttgactatgtataggtttgggttgataattaatttttttttgtcctccctgttttcgtccctagctctaggcttttgtttgtatgcaaacaccacatattttgtgtaaatacagcttagcaatgtaatctgatattgaggattgtgggtcctcatattttgactttatttctcaggattcctttggatattcaggacttgttgtgggtccttgtgatttttagcattgtgtattcataagtgttaagtttcatgtcttttctttttttttttttttttttgcacatcatgaagcctgataattagggctacactgggatatttggatacgtgtatatgttgagtaatgaacaagtcagctacttagcatctttattccttaatacatatattatttttgtgtggagagaacattcaaattcttcccttttatctcttttgaaaactacaaaatttttttgtgtgtgtgagatcgagtttcactcctgttgcccaggctggagtgcaatggcgcgatctcacctcactgcaacctccacctcctgggttcaagcgattctactgcctcagcctcctgagtagctgtattacaggcacctgccacaacacccagctaatgttttgtatttttagtagagatggggtttcaccatgttggccaggctggtctcaaactcctaacctcaggtgatctacctgctttggcctcccaaagtgctggtattacaggcatgagtcaccgtgctcagccaaaaactacaaaattgttaaccaaagtgactgagctgtgaaatagaacactagaatttattcctttcatgtgagagtaactttgttttcttaaccaatccttcctattccccatctatcccccagcctctggtaaccaatattgtcccttctgcttctttatgataatcttttttgtagatttgagtgatatcatccactgtttatctttccaggcctggcatatttcatttaacataacgttttccaggttcaaccctgttgcttcaagtgacatgatgtcattattttgatgacggaagtgttttgtcatatatatatatactagagattcttgatccatttatctgtggatagacagctagattgattccataaacgtagcttttgtgaatgatgctgcaagaaacctaggaaggcagatttcagaaaatacagatttcatttattttgaatgtatacccagaagggagatggctaaatcatatggtatatgtattttcaattctttgaggaacctgtaactcttttccacagtttactaatattcattcccacctacagggtatgagcacccctttctccaaatccacaccataattcttatttttagaaaccttcattcatttagcaatatttatttcaataatagtgaaatattatctgaatgtggttgttaattacatttgtggaattaatagtgatattgaggtccttttcttttacctgttggtcagctttgtatgtgtgtgtgtttatttgtttgttttttcaaagtggtctattcagtttccttgccaaatattagattttttttttttttttttttttttttttgccactgcatagcgtttctttctgtatacaggttccagaagaactcctgtgagttatatacttgcctgaaattttggcccattctttgggatgcttttttatttggaagatagttttctttgctgtgcagaaacttttcagtttgatgtagtctaacatgtttatttttacatttgatacatgtgattttggtcaccaattaaaaaatatatcagtgtcaaagcatcccattgacaatgagtttcccccctgaccccgccaacttcaggatgttttttgtgtttcttttccatttttccaggttgaacacagattcacgtagcccaaagtatacattcaacctatgttcctgttaaaggtattttattgtttaaggtcttgtgttttggtcttagatcttttttgggttgaattttgtacatcatgtaaaataagggttctttttctctcttctgcatatggatataatttttctcatagtcatttattgagcagactctgccttttacattatgtctttgcagtgttccttgtgaaagtcagttgactatacatttgggttgattatttgcctgtttgtttgtttgttttttgcccatggctgtaggtttttgcttttatgcaagtatcacatattttgcataactatagatttgcaatgtaatttgatatcagagattgtcctcatactttcattgtacttctcaagattcctttagatattcagagcttttgtgaatccctgtgatttttagcaactggtattcacttatgttaacttttgctttttttaacatcacaaaggtccacaataagggggtatgctggtacattttgataaatgtatacattgggtaacgatcaaaccagggtgcttaacatctctattctttcatacaggtattaattttgggtagaaagaacattcaaaatcctcccttcatttatcccttacatttatcataatgttttccaggttgatctgtgttgctccaaatgacataatgctattagtttgatggctgaagagtattctttgtgtatatatactagaatttctcaatcctttcatctgtggatgatcaggtatcctggcttttgtgaatggtgctagaagaaacactggaaggcagctgactctcaaaaatacagatttcatttgttttgaatatatacccattagtgggactgttagatggtatggtatttgtagtttccattctttgtggaacctccaactgtttttcatagtgtgaacactaatttacattcccatgaacagttcccctttctggaaatccccaccagcatttgtcttttgtagtatttttatctttttgtaacattcattccagttagaatgagataaatctgagtgtggttttgatccacatttttctcatgatcagtaatgttaaccacatttttgtaaacattgggttagtttcatgtcttctttgcacaaatgtctattcaggttctttgcccaattttgttttggttattttctgttgttttgggttttgccagcttgtattgctactggcttgtgccttttcaaaaacaaccccttatcagctgtatgtttttccaaacttctctaataatttttaagatgcttttaaattttcctcattgtttcctttgttggacacaaactcttaagtttgatgtggtcccacatgtgtataatttctcagttgcctgtgatgttggttcctaatttaaaaaaacccaaaatcactaccaaagtattccatgatttttttttctttttttgttacttcttgcaaacttggagcatacatccaagttgccctagattttccttttttttttttttgagacagagtctcactctgtaggccaggctggagtgcagtggcacaatctcaactcaccacagcctgggttcaagttattctcctgcctcagcctcccgagtagctgagattacaggtgcatgccacgatgtctgctaaattttgtgtttttagtagagacagggtttcaccatgttgaccaggctggtcttgaactcctgacttcaggtgatccgcccgcctctgcctcccaaagtgctgggattacaggcatgagccaccgcaccaggcccctagattttctttataggagctttatgattgcaagttttgtgtattatctgccatccatattgagttgattattgtgtatttagctccataagggtcctatatcattcttttgcatatggatatctagttttgaaaaccattatagaacagactctctcatcctcattgtgtcattttggtgttgttttttaaaatgtgttcactataaataaatttgtgtttattattaagctctctcattttactatttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttctgttatgcccagtacagggcgaccagtagggctccttggtgtagtggtaatgccagcgtctgggaagacgctcgttgccaagcataccgtggtctagcggtagcgtaagcgtcaaggaaaaacatccactacttagcagactgggaaagggagtctccctttccccgggggagtttagagaagactctactcctccaactcttgtggagggcctgacattagtcagactcgcctgcagttatcaggaggcctaactgtctccctgtgatgctgtgcttcagtggtcacgctcctagtccgccttcatgttccatcctgtacaccaggctctgccttttagatagcagtagcaaattagtgaaagtattaaaagtctctagtaagcagaaataatggcataagctgtctctctctctctctctgtctcgtctctctctctgcctcagctgtcaggcagggaagggccccctgtccagtggacatgtgactcacgtggccttacctatcattggaggtggctcactctccttatcctgcccctttgtcttgtatccagtaaatatcagtgcagcctggcattcggggccactactggtctccgtgacttggtggtagtggtcccctgggcctagctgccttttcttttatctctttgtcttgtgtctttatttctacactctctcatctccgcacacggggagagacccaccgaccctgtggggctggtgcctacactagtcatcctgttgtggaatagaacaggagaatttattcctctcaggtaagtgtaactttgtatccatttgcaatccctgtctagtgccccctgcccccaagcctctggtatccaccattaaactttgtacttctacaagataaagttgtttagattgcacatgtgtgagatcatgccacgtttgtgtttctctgcctggctcatttcatttaacatcatgccttccaggtctctccatgtggctgcagataacgtgattttgcgaatttctatggctgaagaagattccattgtgcactgcagtttcttatcctttcatctgtgtatggacaagtaggttgattccatatcttggctactgtaaatagtgctttggtcaccatgcaaaggctgatagttctccaaaatacacatttcaagtgctttcagtgtatattcaggggtaggattgctacactaaagagcagttgtattttttttttctttttagaggaaactgcaactgttttttatagtgtacatagtaatatacagtctgattagtagtgttgaaaggtttatttctctgcaaatctacattggccattacctataaacattttgaggggggttgttttaggtaggattcattctaagtggatcgagaccccatctgaatgtggtttggacttacctttgtgggagaaatgatgaagttgagcaacttctttttgactccttagtcaattcatgtcatcttttcagaaatgtctattaagggcctttgcccatttttagctttggtattagtggatttttttgtttgttttgtttttttcaaacacagtggttttagtttctgggacatgttagataacaaccactttcagagatacagtttttcagatctgtctccaactctgcaggacatcttctctttcagttcattggtttcattccagtggaacacatctaaaggtttccatagtcctacatgtttatatttgcatgtgttcatggtgtttgggtgttccatcacaaaaaaaaaaggaaaaaagattgcattgtctatgggtttcttcctcctacttttcccttttgttttctttccttttggcaatctgtgtgcatagattcaggtttactgaagtaaatgctcaccctgttttcttctaggagttttgtgttttcaggtttgggtggagatctttaatatactttgcattggtttttgtgtcctgtgtaatgtgagggcccatttcactgttttgcaggtagaaatccattttactcaaagactattacagagcaaacttctctcttcactgttgtgatatttggtgttctcttgaaaaatgcgttcaccatatgtaattttgggctgcattttttggctttctcattttgtccataggttaatctttctgcgtgtttgccagaaaaggattgtttggataactacaggtttttcttatttttttttgtttatacagctcctaagcttgttctttgtgtgtgtgtgtgtaataatttctacttttattatagactaaagggtacacacacaggttaattacatctgttgactgcatgacactggggcttggggtcccaacaaccccatgacccaggcagtgagcagaggacccacaaggtgggtcttcagcatataatgccccctctctctcattgtttttgtgggggtccagtagtcactctcactgtctgttgttgccttctttatgttcaggtacattcatagtttagtttccacttacaagtgagaatgtgtggcatttggatgtctgttctggctgtagttcacttaggataatggcctgcagctgccaaagatgtgattgtctttttttgcggctgtttagtgttttatggtatatacgtatcacatctttatcttatgcactgttgatgggcacctaggttgattccatttatttgcccttgtgcatgacactgctgtgaacataaaagtgcctgtgtcttttggacagaaggatgcattttcctttgggtagatccctaggagcgggattgctgggtcagatggtagttctaagttctttgagaaatctccaaactgctttccacagtgtctgtactagtttgcatccccacctagaccacatcagtgtttcctttccttggctgccttgccagggtctgttctttgtctgcacagtcattgccattctgagtggtgtgggatggtatctcaacctgcttttgacttccatttctctcttaatgagtgagtttgagcatgttttcctctttgttggttgcttgcacattgtcttttgagaagtgtgtgttcacgtcccttgcccatttattaatgggtttttttgtttgtttgtttttgctgaatgatttgcaagggtccttgaagattctggatattagaccttggtcagatgcagtttgggaacatgttctcccactctgtaggctatctgtttgttgctaatttcttttgctgtgtggaagctctttacagtattaggtctgacatgtcaatttttgttgccattgcttttggggacgtagccacatagattctttgccaaaacctatgtgaagaaaggtattttgtatgttttcttgcaggattttaatagtttgaggtcttccatttagatcttttattcatctggagttcctttttgtgtctggcgagaggtcgggacccagtgtttctcttccacccatgactagccacttatcccaccatcattgattgaatagggcatcttttcccccttgcttattgttgtggattctgtagaggatcagtcgggtgtgtgagtttacctcttggtcctctctcgtgttccactgctctgtgtggaagcgggtctctaacttttccataaaatttgaaatcggtgggtgagatgcatctcacatagtctggatgtctcaggattgctttggaagaaattcagggtgtttcatggttccacgtgaattttagcatcatgtatttaagtttctttaaacaaatttgccgaatagcaaaggaatacaatgagagggtagagtgcaatgttttggtctttccttacattgtagaatgaggaaatcagggtatttagtgtctctgttattttgtaccattgtttattcttttgtggcaagaagcttcagtatcctcctttcaagctattttgaagatgcaaccatactgttaaccctggttaccctgctgtggaatagaagaacaggatttctttcctctcatctgtgtggaactttgtacccttttctaatccctactcactccccctcttccctccaacctctgataaccactgctatgctttccaggtctttgagatacagtttctcagcttctgcatgagtgaaaggatgcaaagtttatctttcttcctggctcatttcatttaccttcatgtcctccaggtgtaaccgtgtggctcccatgatgggatttcattgtgttcttctggctgaagagtattccagtgtctgcatgtgggacagcttctctctcccttcatctgcagatggacaggtaggtaggctgatttcttatcttggctagtctgcatagtgctggattccacctgcgaatgcagataatctcttccatgtcttgatttcatgtgctgtgtatatatacctagtagttgaattgctggatgaaatggtagttgtcgttttaaggtttggagaaaactccaagtggttttttcagtgtgtatactagcttatgtttccacgaactgtggagacaagttcctcctttgtggaaaacccacacatcattgttttgtcttttaatatttttcaactttttttgtagtatccagtccatctagagtgagatggaatatgagtggtggttttgattttgtgtgtgtatgtgtgattagttacatttgccaagttattgtttttgttttttgggtttttttgagatggagtctcactctgtcacccaggctggagtgcagtggcatgatcttggctcactgaaacctctgcttcctgagttcaagctattctcctgcctcagcctcccgagtagctgggactgcaggcaccaaccaccatgcccagctaatttttgtattttgagtagagacagggttttattatgttggccaggctggtctggaactcctgacctcaagtgatctgcccgccttggcctcccaaagtgctgggattacaagtgtgagccactgtatgcggcccactattgaactttctactgctaagagataaagttgtttagagataaagttgatctcattctcacatgaatgaggtcatgcagtgtttgtctttctctatctggttcatttcctttaatgtcacatcccccaggtttctgcacgttgatgcagatgacatgatttcatgaatttctatggctgaagagaattccattgtgtactgtggtttctgtgttgcttcatctgtggatgaacaggtaggttgattccatgtctttgctattgtgaacagtgcttcagtcatcataggaagcccgatatctcttcaacataacagatttcatgtgctttcagtgaataaccagtggtgggattgctatatgaaagggtagttgtaattttaaatttttgaggtaacttcaactgttttgcatcatgtgtacagtaatgtacattcccatcaatagtgtataaaagtttcttttggctgggtgtggtgactcatgcctgtaatcccagcactttgggaagccgaggtgggcgaactcctaagggcaggagttcgagaccagcctggccaacatggcgaaagcccatctttactaaaaatacaaaaattagccaggtgtgggggcacatgcctgtagtcccagctactcgggagactgaggcaggagaatcacttgaacctgggaggcagaggttgcagtgagccaagatcatgccactgcactccagcctgggtgacagagcaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcccttgaacccaggcagtggaggttgtagtgagccaagatcacaccattgcactccagcctgggcaacagagcaagactctgtctcaaaaaaaaagaaagaaagagagagagagagagaaagagagaaagaaagaaagaaagaaagaaagaaagaaagaaagaaaggaaagaaagaaagaaaagaaatctcatgtgtgaacatatttactaattcaaaagggtattatatcatttttctgtaaattgagcattgaaataaaagcacaataaggtactcttaaagcacttatctgctctttagcaaaatttgtaaagggttataaaaggtttttgcttttttaaaatttctgagtcgtcattttggcaaaataaataacttaaggtaatctggaattctgttttataacatgaagtattttaaacttctaacatatttaacaggcttcctaaaatcaaacttcagtttcaaaatcatttttcctgacacctggatattgaatgctacagcaggcccttggaacatccagaagagaggtaaacaggatcacctgacatgtttaggtacatgggattgccaaaatgatgtttaatcttcttcagcttatattttagggaataatataaatatttgctccaaaattgtatgggatttctaaaattttaatgtctgagtatatgctatcaggcacaattaaggatgttatgttaagttattgtaaaccacggagataaccaaattactctgtcaatcatgtttatgactgtaactaccctggacattttgttattcacagacaattgtcttgttttgattctcttcaaaagatggtttataatcaactatagaaatttgacagatgctctcaaatgcaggtttctgataactttggagattatggcattggaataaagtaaaaacatacaggactcatgaagagctgaaatcctcacaaatatcaagcaaaataagagttaaccaaatggactgaactagcagaaaactgaagtaatcttctgacttttgcttggaacattgctgatctttgtcttgtttttcagagtcaaggaaacttattttgagttatttatggcctttaataattgagtaaggtatattcctgtgaataaaattttgagcatatttgtctttctctctctgcctggcttctccagaatttagaaactagttgtgagtattcctaacttatggcaatatagttgtttgcatctgtgcaacaagaatccattttcttttgcaacagacaaatgagttgttttaccaaggctttgactggaagggtatgcttccctttaagaagtcaagcttgatttgcaaagccaataaaagccccttaggaaaattggcctcataccttgtctacacagtccccatatagggttcctggcctgtggtaagtaaagaatgtatgtttctttctttctttctttttctttctctcttcctttctttctttcttttctttctttctctctttttttttttgagatggagtctcattctgtcacccacactggagtgtagtggcacgatctcagctcactgcaaccactgcctcccaggttcaagtgattctcctgcctcagcctcctgagtagctgggattacaggaacacaccaccatgcctggctaatttttgtattttttaatagagacaaggttttgccatgttggccaggctggtcttgaactcctgacctcaggtgatccacccacctcagcctcccaaagtgctgggattacagacatgagccacctatgcccagtcaagaatgtcactttctaacaggcccaggaaccccatgttcttgggaccccaagaagaaaggagtttacccaactcacaggtattttgagggtacacacccatggctgggctcagcttggaaagtcctatttgagattccttgtggaactgagtttcatcaaaaccaatctcaggcctatataaaaataattattcttgctgcactttatgcaaataatcaggccaagtataagactaaagtctattttgcaaacaattcagtcctatcctgatttgtttttaacaagaatggggactggggctagagaaattatgtttcaaaacctaacatacatttgtcattaaattccagactcattagttgtttttaagtttttgcctacattttagactaaccctgcttattcctgtgaacctaccagcaatctccaactgcagctcagagggaacaaaagggatgggtaatgtaaaaatctggatcaatattctagttctgagcaattatcctgcaaatcctgcccaggtgatgggaacaaatagggtgctcatcacccatcaactttccttgttgggaaagtaagaccaagggagctaaccaaagccaagccccatgcacccaaatcttagcaagcataactatagccaccagttatctgggtgtgtaacaagacatccttttctctcccttgttgaaggaggactcaactccacagcttcactttagcatttggcttaagataaggagtacatataacccctcgcctgagacacatttttgtcctaaactcaattccaagctttgtgtcaaagccctagaaaagaaaactggatctgaaggatccagaggcagataataacataagttaaaaggcacagcacaggtgagcatgactaattcctgccaattaaaccaacctccccatttaacctccccatttcatggataaaagtcatgctagtatccatggtatacatgaagtctagggaagtcaaaggctcctgacagcaggggaaatagtgcgtatctgggtaagagcagatattcccacccccaaccctccttgttaacatgggtgaaagctgctttgacacccatgagcagcaagcacctgttgcagtggctgggactcagggatataagactggaagaaagaaagagggatgcctcactttctctccctcatgtacctcaggtatttgctaggaagagaagggaatctggatgcctcacttccctctttctagatgagtagacattcatcttcagtatgtaacccttttgaatgcatcctgaacccctgggactgctttgaaaaaaacaccttcttttttcctttttcctcctctgtcctctcttcaccgataggtctctgtattatgggacactctcctcagatccatcctccaaactagaaaaagttaatttcccaaaacttaaattggttggcttaggattgggcttgggggaagggaacccagtaggcagacatgccagcaaaagggtaaaagttttttttttaaccagtcggacttttggcctccctctctctgtgcaaacaagtaaaaggccttgggggtttttgagctgtccttaccgccccgttcatttcgatacttgctttctagtaacctggtttgtctcttctcgcgttcaggccatcaaacttcaaacgatcatgcaacaggagcctcagacgatggacccttttgtcagcaagccttagccaggcatctgagggagatctgactgctgctttcccaaatcagcacccgctgtcagcaggaagcagttaagatcagtcttcatcctaatccttatccttataataatggcattagatgggctttgttagaggacggaatgatagatgcaggaggcagatgagggaaggtcgctggaaaatctccaacctgcccgacaagtgtttacatcaaatgcttttgtgcagatgagagaacctgcccagggtcttgtctgcgcatgcctgcaatggactggggacccgcctgggagaatggggaaatttgtgccttgtgcagtggggaggagccctggcctcttcactttgtgtgtggtggcctgatagtcaatctgcgaggtgggagcctattgggggaccccttttcactttgctaagggtttttgttttccttttcgcccagtaaattccgctgtcctcacccttcaatgtgtccatgtgcttaatttttcctggtcgtgacacaagaactcggatttagctgaaataaggagcaaaaatccttcattatttacatatgaaaagtcaactaacacaggagctaacaatgatagagttacctaatgttgagcttgaaggaagctagatggcccataatccagctccccaggacccacaaggaaatgaggcccagtgaccccaaggaacttgccagcctcactcagcacattgctgagaagctgggtgactgtgtcttacaactgacaaaataaaaagcaagccctagttctgcccttagaaggcatttagaaatattcagtgaagtgaaatgaacaccagaaggcaattcataactcactgaagaggaaacaatgcatgctttggtttcaggagagaacaagatcacttcaggtgtgaaagaacaagatcacttcaggtgtgagggttctgggaccagcgtatattttcccatctttcctgaaagaaactaaccactgtcaaccatgtgggtggtagagagggagcaaggcagctgaggccatccaggtggctgttggacatctcccatcccagggctgcttacttcataagactcaataaacttccacctggggcactgcaggaattaacacctgccttctcacgatccaaaaaaaattagcctttttctcctttttatgtttatttttattagttctatagccagctgaactggaaattccactaggatattcaggactcagaccctgaggcatctagcaacagagcaggagaatcttccctaatatcttaataaccaacatatactgagcatttcctgtaagctagaggttgttttaggttggaggtaattaagatagtaagaaggctaaagcccctccagactacccaataattaacctgataaacaggagatctgaaagaatggccaggagtcccttgagatgttaatcaatggtccttaagtgttttgaggtcagggattttccctaagaatctgtgcatagctaggctagactgtttcccagaaaaatgcacacaaaagtttgcatataatacatggggttcactgaaatcatccttgttaagtcagtgtgtgtgtgtgtgtgtgtgtgtgtgtgtgtgtgtgtgtgtgtgtgttagagatgggggtcagggtggctgaaacattattttcttggcagaaaataaggaagtgttcaatgaatgatgaagacttgtcaaaaggaaccagcttgaagggactcccatggtcaaaagaagaacaatttgagcatcaaaaataaatagtggccaagggccaggtgtggtggctcatgcctgtaatcctagcactttcggaggccaaggcaggaggattgcttgagcccaggagttcaagaccagcctgggcaacatagcaaaaccccgtctctaaaaaaatttaaaaattagccacgtgtgtttggcgtgtctatggtcccagctactcaggaggctgaggtggaggatcacctgagcccaggaggtccaggatgcagtgagctgagactgtgctactgcactccagcctgggcagcggagcaggaccctgtctcagtcaatcaatcaatcaatcaatcaatcaatcaatgccaaggcaggaggatcacttgaggccaggagttcaagacctgtgtgggcaacatagtgagtatccatctgtacaaaaactttaaaaattagccagaaacagtggcacatgcctacagtcccttgagaggctgagatgggaggatcgcttgagcccaggagttcgaggctatagcagtgagctaggataaggccactgaactccagcctgggcaacagagcaagaccctatctcaaaaagtaagtattaatcaagcacaactcactaaatgaattcatgctggtgtgaataaatgaatcaatgggagagtagggaaagttcttccttacaagagaatgccaattaataaatatggaggaactcatggaaataatcaacattggacaaccactatggaggggactgattcatgtgggagctgttgatgaatactaagctagttggtggaagtgtgacaaagaacaggatattgccataatattggaataccaccccccaccaccaatactaatcaattacaaaggtgaaatggtgaaattaaggtagagaaatccaacagtcaccaacatgactagatgattaaggtcaacatcaccaatggtggaacaagcccgtccctggtgtgaagcactgagaggagcacatcgccatctctgcaatgttcctgccatgaatgagtgaacatcagatggacctgagttgagggttgtcctacagaatgtaaggcctgcatgcttaaaactgtcaaggaaatgaaagacagggaaaggatgatgacaaactgtttcagattgaagaaatttgaaaagacatgacaggctgggcacagtggctcacacctgtaatcccagcactttgggaggacaacgagggaggatcactagaggccaggagttcaagaccagcctgggcaacatgatgaaaccccatctccactaaaaatacaaaaattagccaggcatggtggtgctcgcctataatcccagctattgggaggctgagacacgaaaattgcttgaacctgggagatggaggctgcagtgacctgagatcgcaccactggactcctccctggacaacagagtgagactgtgtctcaaaaaataaaagtaaataaataaaaattcagaaacaggccaagcatggtggctcatgcctataatcccagcactttgggaagccaggagttccagaccagtctaggcaacatagtgagactccctgtctctaatatctaattgtaatttcaaaaaaagataaaaattcccaaacaacttatgataattagtacttacttatagagagagggcaaagaagaaaagaagtaaaatgaacaattagggaatgtgggtaaatgggagatgatcgttctctgtactgttctggcaactttagtgtaagtttgaaattatttaaaaatatattattttgaaacaaagaatgacacctcatacacaaaggacttatggtagatcatttgccaatggggtcacattttctcctattttggatgcttctttgcaatgttactttgtggccttccctatcaagagggagagtctattgtcctgccttttgaatttaggtagctttgtcccttgctctgaccaaaagaaggcagacattatgtgactcctgagccttggtcttttttttttttgagatggagtctcacactgtcacccaggctggagtgcagtggtgcgatcttggctcactgcaagctccacctcctgggttcatgccattctcctgcctcagcctcccgagtagctgagaccacaggcacctgccaccatgcccggctaattttttctattttagtagagacggggtttcaccatgttagccaggatggtctcgatctcctgctcatgatccgcctgcctcggcctcccaaagtgctgggattacaggcgtgagccaccgtgcccagctgagccttggtcttaaaaggcctcgcagccttctttcttgccctcctgctactctgagatcattgtggaaagaagcccagaactccttgaggatgaatgaccacatatagagagaaggccaaccatgagccatgtaagataggccatcttggaccatgcagccatttcagttgcattctgtcactagagacatgagcccaggggacacaagccaatggaccaccagttaacacagacttgggaggaataataaatcatttttgtaagttttggggtagcttgttacacaacattaaataatcttctacgttactataattaaagatttaatcaacatgactgaccatattgctttgaatttttctacatgccagagtactgtagttgtattttctctgcaaagctatctcaaacttccattagagaatttgtttgcacatgagttcatagtgataacagctctttatagagctcttttatttatgtaacctaatttcacttttaccacaaccctatgagatggaataggtgttctacttgacaaatggggaaataggttcagagaggtcatgtcacttgccaaggaaacatagcccttaagggggtaatatcaggactggaacccaggtcctttctactttgtcaaggttaactatagtcatgagctttctggagagaacactttgccctcccttcagatgtcaaaccagaaatatatcaggaaatgttctgaatcaacctcagttgctgtgaatatgaatgggggttaacaagaattccccaagcaaccaggaccccaaatccactttattccacctgtacctcattttattgtgtggatactaagctgtatgacaactataggtctcaaataagaagagcttacagggagacttaatgtcaatcttaaaatatgcttgattacaactgaaagttgtctagtcatttgaatgtggtcagcactgagcctcagaacagagacaggaaacagatgttggtggaaagtaaggattaaaagtcattaaacaacaaaaatcctctatttttctttttagccattatcattaagcttcctataagcaatcagtaactatttgctgattgacgaatggacagacagatggaggaagcccaaatgaatgacataatagaggcttagagcacaggttttgcaacaagatgtggtttactaccacttaacctgtgtgatgtgtctcaacctctctaagtctcagtttcctcaactttaaaatggaagtgaaatagaatacatggcttgtaggatggttgtgaagatcagatgggaatagtatttacaagggccaggcttggtgcagtggctcatgcccataatcctagcactttgaaaacccgaggtgggaggatcacttgagttcaggagcttgagaccagcctggacaacacagggagagcttgtctctacaaaaaaaaagaaatcttaaaaactagccagacatggtggtgcatgccggtggttccagctactcaggaagctgaggcggaggatcacttaagcccaggaggtggaggctgcagtgagctgtgaccgtgccatctacactacagcctgagtaacagagtaactttcaaaaaaaaaagtggggggaatggggcacagtggctcacacctgtaatcccaacactttgggaagccgtgatgggaggatcacttgagcccaagagttcaggcccaggagtttgagaccagcctgggcaacataacaagaccctacaaaaaaatataaaaaattcaccaggcatggtggcatgcagctgtagtcccagctacttgggaggctgaggtgggagaagtgcttgagcctgggaaattaaggctgcagtgagcatgattgcggcactgcactccagcctgagtgacagaacgagactctgtctcaaaaataaaaaaaattaaaaagtattaaaaaaattaaaaagtttaaaaaaaataaaggactagcctgccttataataggccctcaggaaatgttacctgatgggagaatctgtgtttggtggtcttttaagaaagaacagatatgcttctgtcctgcacagtttaacccttatttctctaaaattcccaggatcaaaggaggtcatttcccaaagccctctctagtcctgtgactctgagataggattcctccttcagatattttttttcatggtcagggagatgagaaacaacttcagaaatggccccctcaaggcctgctctgtgggcagaaactggtttggagagttttctcatccggacacacttccctctgcagcatctgaggtttcatttcggccatggtccatgacagtgagtaacccaacatgaaaaggccactgacagttcttcaccaaaggacgcagctaaatagctatgaaaggattaaaaaaccaatctcaccacccagacagcctgtgagtaaaacacacatacacaacttagcgacaataatcaaagagctagagacagtgctatggtttcatggtccaataaagaaaatataaagccccttcaggctgtctgccctctcccagcagcctgtctgtcttgatgtggagatgaaagagctggcaatggttgacagaagggtcaaaagagctcgcctaggggtacagtctgcctttacagtgatcactgtgagaaggtttccgtgggtcaacattgctatcaaaagtttcattcctagggtgaaaaatgggattgttaaccatttttggagatgatgacgataactttgaaagctttgaagaaaacctttgtctagacagaaacagctcagaaagcttttggcatgcacacccttctgaaacctcttaactgattatagctggagaatgctgacacagcctagagataccttccccagcctgatttgacttggctctcaagttcagtttaaggctttgtgatagtccctttggactgctatagcaaagtactgtagactaggcagcttaaacagccatttatttctcacagttctggaagctggaagtccaatattaggatgccaagatgatggctgggttctggtgaggggccttctctgggttgcagactgctgacttttcattgtatccttagatgtcacaaagaggatgagagaactctctaggggtcccttttaagggcactaatcccactcatgagggctccagccccatgacctcatgacctaatcacctcccaaagaccccatcacattgggggttaggatttcaacatacacatttgcggtggagggggacaaacatacagtccattgcaggcttatagcacttggagtcaggaggacaggaattaagtcccagggtccaggcttgaagttctgttgcccacagatccaaaactgctctgtgaaaggcacagaccccatatcttcagatctagatgaccgaagggcatctcagttctactctcctccaaaccctgttcttctttgacaagtttttattcttcttcccccatccccagaaattccacaaaggaaagaaagtaaggtactatttatttctctctagcctttaatctattgcatttactccgtattggtttctttgttgatgtttttgtacataagcagtgtatttttttaccccagaagccacagacaaaaggaaataaatgaattattgagcacctattatttgctgccagattcttgggcaaggtgtgtggcatatattatcacagtctcatataataaacactaggccaggtgtggtggctcatacctgtaatcccagcactttggaaggtcgaggcaggtggatcacttgagatcaggagtttgagaccagcctggctaacacagcgaaacccccatctctaccaaaatacaaaaattagctgggtgtggtggtgggcacctgtagtcccagctactcaggaggctgaggtgggagaaatgcttgaacccaggaggcggaggttgcagtgagctgagatcatgccactgcactctagcctgggtgacagagtgaaactctgtctcaaaaataaataaatgagtaaataaataaataaacactgcagaactttctggagatatttatagttacaaaaccttacactactaaataaatatgaatatcatttaaaatgtgccattatggagaagatctgtctcatttttttaaccaagtcattaaaaactgataacttaatgcttttgaaactagttagcacccaaggaacaatattaaacccacacaggtatacttttcatacaaccctcatctcattttcatctccactgtctgcaaatggcagaaccagctccatcttcttcaatgacttaaaaacctaccttagttttagtgcattaccttccaaccctctgccctcccagttatttaatctctccaattcctaagaccttcacctccacctaatttcagactccttgaagccttgtcacctctgagcctctgaatcagctagacctgtttacctgtaagacctcaggctcagaagtatctttggtatcccatcttttcctccatttgggtcacaccagcccagctctctttctcccttcactgtgaagtatccagaaaaggcagtcttcaagttgacttccacttctcatttcttcaatccactgtgctatttctgctcttacagaggtctctagcaatagacagtgctaaagtcaggacagcaatccaggccctgcctcacgcagcacattgcagagaaactggggccagagtgaagggctcaacccaataagatcccctcatacttcaaccatctgacacctctgattcataggatgctgtcactcattccctctttcttatacaattatatcctcatttaattgccacaatttcataccagcttgattctctttccaacttctctggctcctatttctcagctctcttcaaagacatttcttcttctgacacaccttcaacgcaggcctgtccctgctttcttctctttatttatttatttatatgtattttttgagacacagtgtcactctgttgcccaggctggaatgcagtggtgtgatcatggcttattgcagcctcgacctcctgggctcaggtgatcctcccacctcagcctcccgagtagctaggaccacaggcatgcaccaccctgcctggctaattttttgtagacagcggggagtctccttatgtttcacaggctggtcttgaactcctggctcaagtgatcctcctacctcaggctcccaaagtgctgggattacaggtgtgagccaccatgcccaattcttctctttttctcatcaacattctcctgtggagatcatacctacttctataactccccataagtgtgtggctcttaaagaaacagctacgcttgacttttctctttacctcaacctcagcattttcagttgcttgtgggcaggagtagcctaccagtattttacattcagcgtctccaaaacaagactcttacattttaaatccacttctctttctgtgttctcaatttcaaccacagttgtctttaacttctccctcttcctcatcccctccccctcctctgagttgccaagacctatcagttccacttgtcaatccatccctcccttcacattcccaatgatactgtcagagttcaggcccctactttgtttcctctcccttaattatggcaataccctattggtccgctgcttcctaccaccggagtaccatgatccttaaccacgtaccttctccaaaaccctccctcaatttttttttcagtagttccccattggttaaaaaataaactccaagctgttttagcctggctttcaatgtccctagagctgcctcagccattgtatgcagtctcctattactcagcctctctgcgctctccaaacagttcctgtctttgcagcaactttgttcctcttattccctctgcctggagttctcgttccattcttacctactaaacactgcatccaccaaagcctttccttcttgctcccttctcacttgaggctggaccaaatccctcttttctttggttcctcatagcatatcttccattttggatatcagttataccatttatacctttttcctcatattgaggtaaaaccggtctatttccctaccagcttgtaaagagtcttcaagttccattccataaaaaacttataaagcttttggtgattttttgtgctgttttgttttaactgggcgtggtaacagcaagaaaaaaaaaagtaggccgcagccccagggctggatcattctagtgggaagagggaaatacaggaacagaaagcaccgtgctgtgtggcaggaagtgggcatgtcttattacatttgcttccctcagctcggactttgcacaggtcggatgcatgatattttccagctggaagagtctaaaagataatgtgacactcttcatgtgttctagcatagaaaactgagaacacaacagttagggacttgctcaaagtcaccaagtcagtgagtggcaagagctggatccagccccagggccagggcacgctctgccacatcccaacgcagctcctgctttgcacgctcggggtggggtggggtgggatggggtgtcgcagcaattactcaggttgccaaccacagggagtattctaaaagcaatcaagtgtgatcaagggatatgtctgggctgagtgggaaaaataaaaaaagggaagatgttgaaggacatgaaaatctttctccttttatgaatgcttcattgccataaaactcccctccattcttgcttccacaaaattcactggaaatttattttgttccttttgaaagtcaaattgttctagggttaatgaagtgatcattcgccggaaaagaggtcaaacctttttaaaggtctcattcccggattggtgctcctcctgtaagtcatggggaaggtctcagaaaaactgcaagatttcttcttttaaaaagttatatgattgcggaaggagttcatttaattattactatttttttaaatagtagtcttactctgttgcccaggctggagtgcaggcagaggcacgatcatggcttacggcagcctcaaacacctgggtgcaaggaaacctccaacctcgccctcctgagcagttgggactacagaggcgtgccaccaagcccggatacatttttttaatttttgtaggtacaaggtttctatatgttgccaagggctggtctcatgctcttggcctcaagtaatcctcctaccttggcctcccaaagcgctgggactacacgcatgatccaccacacccagctgagagatggttttatttttatttttccaaaaggtttctcaaaatcattgcctcattctcaacagggctttaaataaaaccacgttaaggtttccagtacctgggctggtctcaaactcctgagctcaagcgatccatctacctttgcctcccaatgtgctgggattacagggtgagccactgcacccagccaattctatgttttaacatggattcagtgttcaaagcatgtatcctagaacattaccagaggaggtaagagagtgtggtcactctgtccctcttttgaaacactgaagaaatcataccaactccacctagagattttattcttaaccaggctttactctccataaactgagaaatagtattttccccaaaataataaaactactaatttatcattggttagtgccttgcagattaccaaggtctttcacatacacttctgtaaacatttctgtacaggtgagaaaactgagttgaagcaacatttgctctgctagcaaatgacagagcaagagacagcatggtaagggagaaagaaatccttggctttgggttcaggctcgggacttgatctcagctcaaggaatcctagcaacactaaactggtcaaggtatgtaacctctttgagcttcatattttttttaatcacaaaatatttgtcatacccaccccacaaatttatgacaattaaataggacaaaatgtaaaaagccacaacaaaattcctagcacataaaagatgtccactgaagatatagcctgccttagttgctacaactgtaaaagggggtaataaaatctaagtgaaatctacctggaggatgcacttccactgttagttctctttgtccatttccatttcccctccttcttcccccacaaaccaaagctgcctccatggaaaggataattcggcatattagaaaacaatcttagggaagttgatcttcatacatcagcaggcatttaacttatctactgaactcaaaattgtttcttagaaaaaaaatgacccaaattcaatattttaaaaaggcttttaacatggccaaagtcactacatcatttccatatactgtacctggaagccctaatggtgataaaaatatttgagaatgtaccaacttcaatccatccgtcttgtcccatatctttcccccatctggctcaacccgcaaaaaggacttccaagtagatttcttttttatttttaaagtcacagtgccacttcagtttatccaaaacttagatggagagctacacgttggggggcggggggtatgcagagaaaaggaaaatgaagaaaacagtggacaaaacaattgagaggaaaaacaagttttcatacaaatctgggctctcttccaaagagatcattaattctaagatattttactatctgctcaatgctacaaagcttccacgtggccactggatgaaacagtgtgtaccaagccacggattccctggcaccatcattcacacagtcaacaacagcacatgctggcaaattcgttctcaagtaccagcttacagtctccttcacccaaagcaggaggtcaacaattactttccattacattttgaatacaattcccgaaggaaggaatgcaagaaaatgttcctctcatttttaaggactgtttttggctgtttggggttgtttctgttttggtggcggtaaagttcttctttggttaaggtttaatgtttatgtataccatttacccacaccacggaaggtgggaaattccagttgttctcgccctttgagtttttagaataatcgtatttacaatgaggtgctcagaatctgaaacagtttgcattttagaagtataggaaaagagtctccttaataagcacctataagttgcaggcacgtaaccaataagggcaggggagaaattcccaaatgtcaaaacaactcccccatcccccaaaccccagcacccatttctttttcttaagatttaggcctggagaagatgccagattaagaatgcaaaccaccttcgaagaggaccttaggttgagcgcccggctgcgcgctgtgcggcgggcgcgggggtcctggccagttcgggcgctcgctagctgcccccctcctcgggctcgctgctgggcgaaggcgccgaagaggccttggactccccgtcgctgttgcattccgccctgcgctgggggacggcgccggccgcgccctcgagcccccaggcctggcgctccagcagctcctgcaggtgcttgatgtagtcgatggcagcgcggagcgtctccactttgctgaggcgcttgtctgccagctcccggggcaggtggtctcggaggcgcgcatagccctcgttcacgcagcgcacccgctgccgctcgcgctcgttgcgcttgcggaggaaggcgggctcgaaggcgctgtccagcggcacgggcaagtactgccatccccgtgcgcagccgctgcgcgcccactcccagcacgcggcgtccagacgcagggcgaccctgagggggtccctccgcgggagtccgggcagggtccccggaacgcccaggggcgcggtgcgcacgagtatggcaaggccagccgttccgccggtttacgcgtctccatcatttgccggaaagcacacaaatcactcaagaggtcaatctctcaatagaagaagacgaaacagaatcttagaagcagaggtgctggtgcagactgcctggctcagtgggtctgtctttgcagaagtttctgggtccagaagttaggttcctggacaggcttcagggaaacggtgcatgattcctgaagttcattgcactcctcgatctttttatgatttaggcagaggtggtaggcaaagacgtaggatctcctaatccacacttcaaaccccgtcttccccactgatcttctttcagaagataacaaagggggttcctctgcctggtcccccagcctggaaaggtgagctcacaccagagtcatcttccaaagccaccaaaagcttttcaatgcctgtaatccaccactctaggtcttcaagagatgagtcgttcgccaagagcctagcaatcttcaggatttgagaagagctcctcccaggaacctgcagatctggcggcggagggaaagtggaccagaggctttctccttgaaaatcacttgactgtcctttgtggtttcccgcgaccaggtctaatggaaggagcttttagagtgtttgcaaacttaaacttgctctttcatttctggggtcttagcctcatcaaaggaaaaactgctctcttgcggttataaaatgtgtcaagtcaaggaagacccggggcgaggcttgaggtttttcttcttccaaaccgaatcttttaaaaactcaatgaggcatgtttgaagggtataggaaaaatacagactgtagcaaagaatataagggtctgcatattatgttccaacatatgttgttttatggttgttgagggtgttttatggagatgcgactttttaaaagcacatcaaaagactgaacaataacaaacgcgcttagccggttatttctcacagtgcttactgtaaacacagcttaaatactgcttcccagcctcctcttctaatctcacccaggatataaggacatcatctttccatagcgcaaagagtgtttttccattggattcttcttctttaaaaaatgtcatttattttctctcttgggggcaggaaagcaacatttgaaaggtggagactccaagttccaaggagaaaggatgatgtctttgaagacttgtctttttaagacacaacccctccaaaatgaataattaatccatccgtgttggtaaacctttgaagattaaagtgtcattaaaaatccaactgtactggttaacgtcaaagaatatgttatcacactgaaaatcagatttcctcttctgcaaaccagtacattaaaggtgtcttctactttaaaagtcctacttaaaaacaagagaagcaaaaaccccctacatttatgatgagagcttttgcctattcctcagcagacaaggtgctgccctaacatgtttttctttttagtttggcaagtcctgttcttccctgtttgttctaaatgatccgcctgaagcaactcaaaaaacaaggcaaataaaatagaaataattattcctttcgggtataagttagtcacatttttaaaggtgtagcttggctgggtgcagtggctcaaggttgtattcccagcactttgggaggccaaggcgggtggattgcttgaggccaagagttcaagaccaacctggccaacatagcaagacccccatcttttaaaaagaagaaagaaaaattaaaagttgtagctcctgatgaggtttgtactggcaaatagcctaatatatcatcacaatttctcagtagaattgagaaagccctttctattaggagaaaagtccaccactcaggcaggtaggctgttataccacaaggtgctttttggccatgtcaaagattttaacttttaagagtgacaggaagataatgaaatattttaagcagggaggtgacatttgaagatttgtgtttcaaaaaagataactgtgtctgcagattgaggactagattggaagagagcaaaaggaagaacagttgagatgccatttctccttctcagattggcaaaagtttaaaagattgctaagattcaggggaggcaaggatttgaggaaagggtgggagcataaattgcttcaagaaactattaaaattattattattattattattattattattattattattttgagacaggtctcactgtcacccaggctggggtgcagtgatgcgatctcggctcactgcaacctccgcctcccaggctcaagggatcctcctatctcagcctcctgagtagctaggactacaggcttgtgcctccacatcccagctaaacaaactgttaaaattaatagtgcacatcacatcctttgattcagatatctgtgccgttttgtcctaccaaaataaatgtagcaatacctatttatgtgtacaataatctttattgcaacatttgtagcaatttaaaaaaacgaagactccaggcaaggtggcttatgcctgtaatcccagcactttgggaggccaaagtgggtggatcacttgaggtcaggagttcgagaccagcctagccaacgtggcgaaaccctgtctctactaaaaatacaaaaaattagtcaggcgttgtagcaggtgcctgtaatcccagctacttgggaggctgagacaggagaatcacttgaatcctggaggcggaggttgtactgagccaagatcacgccactgcactccagcctgggtgacagagcaagacccagtctcaaaaaaaaaaaaaaaaaggcgaggctgggcacagtagctcacgcctgtaatctcagcactttgggaagccgaggtgggaggatcatgaggccaggagttcaagacctgcctgaccagcatgatgaaaccccatctctactaaaaatcaaaaaaattagctgggcatggtggcacatgcctgtagtcccagctacttgggaggctgaggcaggagaattgcttcaacctggcaggcagaggttgaagtgagctgagatagcctgggcgacagagcgagactctgtctcaaaaaataaataaatagataaagaagaagaagaaaaagggaacagcctgaacagcctgaatgtccatcaataggaaaagagttaaaaatcttagaatattatgctattattaaaaataatgagtaaaatctgtacgtaagaacttgcagacatatccacaatgtcttaagtgaaaaaagcaaattgcagagtaacatatgcagcaggaacataaaaacaattctacatgatgtgtatgtcctttatatgtgtttctgtgagcatggagaatgaaatagaaagacacatactaaatggttttttgcattggttgcctaaaaagaaagggtggcattggggaggaaggggggatgttcatttttctttataaatctttctactgtttaacttgttaataccaacactattactttcttatttttataacccagtgaaacttaataagataaaatgtgtagaaagttcaaatgacaccccctgatctggcccaaaccaacagatttaccattagaaattagaactcttagaccaggttttctggctccttgtaaattctgtctctgaggacgaagtatctacaagactttctctctctctctctctctctcactgctaataccacaatcaaaattggtcaaggccgggcgcggtggctcatgcctgtaatcctagtactttgggaggccaaggcaggaggatcacctgaggtcaggagttcaagaccagcctgaccaacatggagaaaccccgtttctactaaaaatacaaaattagctgggcgtggtggtacatgcctgtaatcccagctacttgggaggctgaggcaggaggagaatcacttgaacccaggaggcggaggttgtggtgagctgagatcatgccattgcactccagcctgggcgacaagagcaaaactccgtcaaaaaaaaaaaaaaaaaaaaactggtcaaatcctgatcctacagtggtctttttataggatccaagtaatataatgacctaactgcatggtcacaaagaatgctgacagagcctttcctaaagaacaaaagcattgaaaataagtggcttttccagtaggaataggactgttttactcacatgatgtgcagggtatggggtgggggttaccttctttacataagagatcaaaagaagaagttttgactcctgattactctccagtcagttttgacccagataaacattctctccaacctaaagctgtcctaaggctggctagatcacgtaacacatatgctaacctgccaagagtaactgggctgggtttgtgtagtcctatttgggtctgctcatgaaagggggcagatgggcaggtatattttaatcctttccttctagcttttgtcttttctcccctgtttaaggctaccttctcctaccgcaagttttacaaggcctcctcttgtctatataacaccttggtgtgaattatgaagaggcaccaaactcaaggcttggagaatgaatggctgactctaaaattcatctggaagaacttttgggcaaggatttcccaaatttggaaaagaagacaaaagaacacaacgtgcacttttaatatccatgaggaagaaattaccacttgagattctaactgaggctgtgttaaatagaaagaaattgggccaggtgcagtggctcatacctgtaattccaacactttgggaagcttatacaggcagatcacttgagcccaggagtttaagaccagcctgagcaacatggggagaccccatcaatacaaaaaaatacaaaaaatagtcaggcatgatggcatgcatctgaggtcgcaacaactcaggaggctaaggggggtggattgattgagccctggagatcgaggctgcagtgagctgtgatcatgccacagcactccagcctgggcaacagagcaacaccctgtctccatttaaaagattaatttggtgagaattacctttttttaaaaaaaaaacattgcatagctccatatatgcacataatagaactcacttcttcaggtcttcttttttgttttttggtaaattttggccaggtgccatggctcacgcctgtaatcccagcactttgggaggctaaggcgggcggatcactaggtcaagagatggagaccatcctggccaacatggtgaaagcccgtctctaccaaacatacaaaaattagctgggcatggtggcgcgtgcctgtggtcccagctactcgggaggctgaggcaggagaatcacttcaacccaggaggcggaggttgcagtgaaccaagatcgcgccactgcactccagcctggtgacagagcaagactccatctcaaaaaataaaaattaattaattaattaatttcaaatatttttccatgtaggtcttgaacatatcttattatgcttatttcatgatgttttataggttttgttgctatagtgaataagatttttttctgttattcaaagctactgatttatgttaatctttaatctagtcatttcgctaaactctcttattagttctaatggtttttaatcatgataagatctacatagattaaatgcacagatgttaaatatacaacttaatgagctttgaatacatgcatacacttgtgaaataacacccactcaagatgacttttttttttttttgagagatggggtctcactctgacacccaggctggaatgcactggcagaatctcggctcactgcaccctccgcctccgaggctcaagccatcctcccagctcagcctcctgagtagctgggactacaggcatgaaccaccatgcccagttaattttcgtatttttagtagagacaggatttcagcatgttggccaggaaggtctcgatctcttgacctcatgacccacctgcctgggcctcccaaagtgctgggattacaggtgtgtgtgagccatcacacccagcccatcctggtattttaataagaaagcttctaatgtttccctatctagtagatattctttaccaagttaaggaaatttgtttgttattttcagaaagagctactaaattttatcaaattctttttaacatctataatcatgtattttctttttttatttgttattgtagtgaattgctataatagattttctaacattgagccaccttgcattcttagaataaaatcctatggagtcataattcttttatacactgctggattcaatttgttaatattttatttagaaatttttttcttatagtccccagttatattggctcatagttttattttcttgtgctctccttttttggtatcagcattatttcaaactcttaaaaataagttgagcagctttccatctgtttctaggtgttggaaccatttgtaaaagatgaaaattatctgttctttggagagttgctaaaacaaaaaacatatggcatatggactttttgttgttgttttgagacagagtcttgctctgtcacccaggctggagtgcagtggcatgatcctggctcgccaaagcctcaacctgctgggttcaattgaccagcctcctgagtagctgggaccacaaccgtgtaccaccacacccgattaatttttatattttttgtagagatgaggcttcaatgtgttgctcaggttagtctcgaactcctgagctcaggtgatccacctgccacagcctcccaagtgttgggatgacaggtgtgagccactgtgcccggctatggaccttctttggaggtaaattttcagttactttttcatttcttttatcattgctgttggaattttaggaggccattaacaaagacaatgatcttgtctttctttcttgagtttccagcttccttcaatggcaactactgctcctttgtttatcatcttagactcacagataggcagtttaatttttgccccttaaacttctaaaatgaatcagaacagtacatctgttaaattaaccccaaaatatggtggaccccaggccaaaaactcactcctgattttatttgctatttctaatgaaggccattccagtatagttggcctgaggttatgcagtcaaataaattacccatagaacaatcctccaaattaaaaaaaaatcctcattctcaaattgctaggcataaattaaaacccaaagcttaaataaccttatccttttaggttaaaattcagagatatcaacattaaaatttctttggctaaactcctacaaatcatttcccctctgtgatattatgatatattgggttttgtccacagttcctggcttataactcccttagctcttgttacagtctttcgttataatgttagggcactcagaagcaggcctcagaaaacagaactctctctgtctctgtgaacttcccctgcccttctttcaccagcccacagcagaactcttatcttccaccacctttgtaattgtgggtcatgagaccctcaattcaggagtcctgccccatccgctggaggaaggaatgctgcatggaagagactaggaagaatgtgaacagacaggccttgctgggtttccccactgagtttattagtattcgatcacatgcttttcgggccaattacatttctacatggtagtcagtcatgcctatccaataatgtctccgttaaaggcccaagaggacagagtttggagagcttctggatagctgaacccctgagggttcctggagggtggcacgcccagggagggcatggaagctctgcaccccatccctgtgccatgctctgtgcatctcttcatctgtatcctttgtaatgtcctttgtaataaaccagtaaatgtaagttaagtgtctccttgagttatgtaagccactttagcaaattaatgggacccaaagagggggtcatggaaatcccaatttgaagccaattggtcagaagttccacaggcctggacttgtgactggtgtctgatgaggaagggttggggggaagtctgatgggactgatccctcaacctgtgggatctgacgctatctccaggtagatagtgttggaattaaattggagggtacccagttggtgtgtgttgcagaactgattgcttgcttggtgtgtggggaaaaccaccccacatttggtcacagaagtcttctgtgttgtggtgttgatgatgttgtgtttatttctgctcactctttgatttctgattctgctcagtctagttagaggggtgttgttcaaaagactgagtagagtgtagattcattctgcgtgatcctcacagaaattagcagttccttcagatctgagaaactgaattagtttgaaaccatatgtgttcaccctttaaagtcctaagacttggtcgggtatggtggttcatgcctgtaatcccagcactttgggaggccaaagcagaaggatcactcaagaccagcctgggcaacatggtaaaaccccgtctccacaaaacatacaaaaattagctgggtgtggtggtgcatgcctgtaatcccagctactcgggaggctgaggtgggaagactgcttgagcctaggagtcagaggttgcagtgagccgagatcacgccatctgtactccagcctgggcgacagagcaagactctgtctcaaaaaaagaaaaaaatcgtaagagctaacagaacacacaagatcaccccagttctactaccacatacactgcatttagaaaacaagtaattctacagcttttagaggagttgaaaaagtacttgggacattaagagaaatactgttccaagtaccagtgcttaatcctctatacccctgtatcagtttcctaagatcagagcagagactcagaggtagccaagataaggggggcagcctcctcagaatggccgtcaataaaatgctaagcacttatttagctcttgagcctgaggatcagtgatttggcctgaccgcggctcagttcaagcatatgtcccacatggcaaactcagaatcaaggagcagaaaaatagactccacttcttcccaagagaaaaaaggctggctaccgagaggagtgaagaattggggctattgacaaaatctctctattttacttcccactctaaaataattgcacaatgtaaactaggcccatgtcaggggctccatagccacaggtgggtagcagctaccacactaggcaatacagttctagagtcactggtgtccttgcaatttctcaaatctgccaggcagtgtcctgcctcagggcctttgctcttgaccttctttctgattgagatattcttcctctagatgtttgcatggatcactgtctcctctcctttggttcaaatgtcaccttttgagtgatgacttctctgtctaccctattaaaattgcaggcccatccccaggcattttctgtccatttttccagccattcttttttttaatgttatttattgctatctggaatattgtgtattttaattatttatttctttattatctatcttcttccattataatgtaagctccagaggaactggtattttttgcctgttttgtttactatatactcccagttcctagagcaatgcctggcacagagtagacactcaacaaacatttgtagaataaactctatgcctctctgcaaatattaaataaaggaggtcagtccttacattatacattataattgtatcaaacttatgggcaggaatcccaagaatgccaaagagcaggtttacccacataaaaggtctttatttccagatcctccttaccataaggaataggaagcaagatttgaaaacttaattagggtcagttaaaagtaagataccctgatcagctaaatctggggccaagtttacccattactgttctcgtctttagtgctaggaaataatgtttaaaggtaatttgctctctgtgtctatccctgatgtccaggaaaaatcttagtggttgttatctggttgtcttcactgatattacctctaagctctacccttgactatactctccatcattatttcacagtcatactaatacagtcctgtgccatacaatgatgttttggtcaacgacagactggatatacaagagtggtcccataagattataatgaagctgccctatacaggcataccattttttaatcttttatctgtatttttactgtactttttctatgtttagatatgtttagatacacaaataccacgatgttacagttgtctggagtattcagtacagtaacatgctgtgcaggtttgtagcctaggagctataggccataccatctagcctaggggtgtagtaggttagaccatctaggtatatgtaagggcactctatgatgtttgcacaaccacagaatcacctaaggttgcattcctcagaacatatcctcattgttctgccacaccgacgctcttcatttctacctgtgtgattggccagtttctcccatttttgttgttgttgttgtttgaggaagtgtcttgccctgtcgcccaggccagagtgcagtggctgtggcctgatcacagctcactgcagtatcaacctcccaggctcaaagtatccttctacctcagcctcccaagtagctgggaccacaggcatgtaccatcataccgggctgatttttgtaaagacaaggtttcatcatgttgctcaggctgatcttgaactcctggactcaagaaatccaccagacttggcttcccaaagtgctaggattaccggtgtgagccactgtgtctggcctttccattgtctttattgtcttaacagcaccatggagtctccttaaaggggtaagtcaccctaaatcagcagttaaggcaatctttgagcaaacatttgctgtacatctccaagtaaatagatatatgagtcaatatgtgtggcttcaaattatgccagtttgactttccctcaggcatcagaaattcattgaatatctaatatatgccaggtatagtgctatgttgtatagcattaaataagatagacatgaatcttctccccaaaatttaaaatgtatttggcaaaatagaaaattaaacaattaattacaataaagataggtactatgagagagcatacagtgggcctagtctggggagtagagtcagaacacttcaatttttgttaatcttgacataattttttaattgaatttttgaggtatttttacatacaataaaattcaccaatgtcaagtttactatttgattaatttggacagatgtatacaattgtgtaacctctaccacaatcaagaccattttcatcactcctaaaagttctcttatgcccccactgtaggcaatctcatcccccaacccattcccaacttctgacaatcacttctctgctttctattactacagttttgccttttctagaatttctcatacctggactcataatatgtagtctattgtgtctggttcctttcacttagcataatacgtctttgagatccatccatgtatcaacagcttgttcctttttatttctgagtattccactgtatagatactgtacactatcattattcatttaccagttgatggacatttgggtcatttcctgttctggcctatgacagataacgcagctatggacattggcgtacaagtctttgtacatatgtttttatttttctttggtaaatacctaaggagtgtggagaattggatggtataagaggtataagaaattgctggccaggcatggttgctcatgcctgtaatcccagcactttgggaggctaaggcaggtggatcacttgaggtcaggagttcgcaaccggcttggccaacatggtgaaaccccatctctactaaaaatacaaaagttcgccaggcatgctggtgagcacctgtaatcccagctactggggaagctgaggcaggagaatcacttgaacccagcaggcagaggctgcagtgagctgagaccacagcacagcactccagcctgggtgacagtgaaactctgtctaaaaaaaaaaagagagaaagaaaaaagaaagaaattctaaaatggctgtggcattttttttgcattcccaccaacaaaatgtgagggtgccagttgctccatatctgtgccaacacttgttatagttggtctttttaattgtagccattctagtaagtgtgtaatatcacttcattgtgctttgatttgcatttctttgatacctaatgatgctgcacatctttttgtgtgcttaatcgccatccatatagcttctttggtgaaatggctgttgaaatttttgcctaagtttttaaatttaattgtcttcttattattgtgtttaaagggttctttatatagtcaagatacaaatcctttgtcagatatttgttttgaaaatattttctcccagtctctcacttgactcattttgttgacagtatcttttcaagatcaaccattttaattttgatgaagttcgatttgtcatttttttttttgagatagggtctctctctgtcacctgagctggagtgcagtggcacaatcttagctcattgcaacctcatactcctgggcacaagctatcctcctgtctcagcctcccaagtagctggggctacacgtgcataccaccatgcccagctaattttttttattttttgtagagacagggtctcactttgttgcccaggatggtctcaaactcctgggctcaagcgatcctcctacctcagcttcccaaagtgctgaggagagagccactgcacttgctccaattttttaatagtttgtgatttttttgtcctatcaaggtcacaaagatttttgcctttattttcctctgtaagtattatggttttagctcttacatttatgtgacctgatttttatgttcacctctcaacttaataaaattgttccaaaagaacagacatccaaacccaaacctagtgaaagcattcggccggtaataagatacatcatcattctctaggctccagatttgaagtggcatttcagggaatactgtctctcagttgagatgatgaccttcttgatttagatttctatttgttgtcaacagagagcaaaaccaatgtgacctgcctgccaatgttcagtgaagtttcctcatctggaatgtgctttccccccatgagaagtaaacgaagggaaacattatgggggttgacacccctcccagctctcgtccaaaaggttgcatgtgcctctaccctttcacattagactgaattttcaaaattcatcagttcccactagactgcaggcaggtgaaggtcagggcttgtgccttgctctgtatccctaggtttgagatgtaattcaacagacgctttgtgaatgacaggaagaattcctgggtctgctgttctgctggtgtaagggagccaccaggcagtgtggtgtaatttcaacgtctactgctcaggagcttgggaccaccttcctttaaagccatctcggtactcctagcgttaggcacagtgcctggcgcgcagtagagaactgagggcagagaaaaggggaaggaaattttgtttaaaatcccaaaccccagcatttacgacgggaagcagggaaactgggcagccttcaggtgtagcagacggccgaaaatattcaggatagaatcccaattcctcctgggcagcagaggcaaccctcggggccaaatcccatacttcgaattttgggggctttgtgtggacccatgcttctctagtaggggaatgtcatgaagacgaaatcctgagtctgcgggatttaggggattcaaaactcaatccctgcaggaacagcagccctggtcgcctagcaaccatgggccgatcgctcggcgctcgattctacccggccggatggagacgcggaactcccggccgagcctctcgcggccagtgcctctgccgtgcgcacgcgcggaggggcctgggctgggagaagggcgacgcggtgcgcgggcgccgcttgcgggccgcggcggggagggcgcacgcacgaggggcggagcggcgggcgctgagagtggctgaggatccggaaacgcgccgcagagggtgcggcccagaggaggccgcgggccgggaagggccgggcgggacgggaaacgttagggcagcggcccccggggtgagggggccgagcggacgggcagggccccgaggcgaactctgcccggatgaggaacaaagcagtggggcaggcgcgtgcgcccccagcgcagctggcaggtgggctgcgcgcgggcccggccggagcggggcggggcgcggcggcccggcctgcgggccgcgggcgggctaatccacagcccttgggtggcggtgtcggcagcgcctggggctttcgggtagctgggatgggggctgcgaccttgttgtggttttggtgaccgctcttgtccccactcccccaggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggtgagtagggaggtgggcttcagcactggtgacatcgttggaaactctggcgagtgagtgtccagggtcagtgccgttgtttttggtgccattgagaaggttacaggtgtgatttgcaaaggaaacaaatccagaaactagtgttgggtggaatgtaatctcatgcatcctaatttactccacatgtggaaagttgttcccagtagccacacgtttattgttggcttgttgacaccttttcctgtgtctttcagttatttgagcgtttaatatatttttccggattccaacgtgtattgttatcttattatgcttcaccttgagttttgctggtatggcagggacgatagtgagggaattaagttcttaattctgcaagcttcatgctgatgtttaagtacagaagcaggccacagaaattgttgcatttggctgttttttcaaggccctttcaaaggccgtatgtttagaataaggaagataaggcacaaattcattgaaattattgaagccccactgcatttttcaaagtggctgcatttcagttagtttattatattttatgcgaagaaaaaggtgtaaaatcagcaactggcagatggttgcataggtcagttagaaacacacacataaactgtagaactgtgtaggaaattattttaccctaaatgagtagggaagatagagcttagtatcttgattcttgccttcttccgggattgcttcttagaatctcataggagaaagaaaatgagaatagaactgcattttagaatgagaaagtcttatgaggatcatattgtacattcccttcatctgccttctctctgtgggatactcattacctttggtttatggctgctgaggtcatcacgttttagtgactcacaacaaagcagaaatctgctgagcctctcgcattaaactctggtttgaactggtttgagaaggcctaggagtcaacctagaaacaccatgctgatttttatcttgaaattaaataaatattcaggaattttcagaatgagagttgaaggtgcagacttgtagttgtacttttaaaaaaatattgtaaccaatttgttaagtaggctgttacagctgtagtgattgtagtgttttaattatggttgtagctataaagagttagggaaaagtctgttttaaaccaactcaagcccagcaactttcaaaattaaggtagatatgttttctttaggctacagggattttttgctttttttgtttttaagacacagtctcactctgtcaccccagctggcgtgtagaggtacaggcagagctcactgtagccccgacctccccacttcagcctcccctgtagttggaaccacaagcacgaaccaccatgcctggctaagttaaaaaaaatgtttagtagagacaggggtctcactgtgttgcctagggacgtctccaagtcctgggctcaagcgatccttctgccttggcctcccaaagtgtgggattacaggtgtaaatcaccacacctgggctgctttattttatagcataataaaaactgttattagcatgctgttcttcataaggtgtacctcatttgccaggtgcttctagctgtctttctggtaagggtgatgagtttgcatagctccatccgataaaataagaaaattcagaatgtctgttctatacaaggtactaggttggccttttacattttattgatgtcttagagcttagttttatgggatccatggccagggataagggtgaaacctaataatgcaagaaacaggtctatgtggaactttaaatatacgccacaatataagtagataggccctaatgtattgcaactgtgtaaaaggcaatatagttcttttattgtaattgtctttttcttactatagttaagagctttggtttcttaaattagttctgaatttaaatcccagctctccttactggttatgtgattctgggttaagtttcctagcatcattgaatcttaagtttcctcatctttaaagtgggattaagaataatacctacctccagcctgggcaacatagggagaccccatctctgcaaaataaaaacaaattagccaggcatggtggcacttgcctgtggtcccagctgcttgggggctgaggtgggaagatctcatgagcctaggaggtagaggcagcagtcagctgtgatcacgccactgcactccagcttgcagctactgagcaagaccctgtctcaaaaacaaaaaaaaaaaaaaaaaaaaagaagattaagagagatagttacatataaatcacttagcccaatacatagcacatggtaagggagccataaattttagctattattattttcaggttgattgataaaatggcattgccatttttcagaattaaaaacctatttagatttgatttcactgctaaggaatatgtaacctcatttgattcctcttctctgcttcaccccctcccatacgcagagaataaagcccagtgtaaggactggaggtcattagagagccccttttgggtaacctgttggctagcctagtggttctgtaatgtttatagtatggcagtctctaaattatgatataagaactaatactttttgataacaaccttcagtgctgttttattcaaatcagtattactcttattcgaaagacatttgtaatggcagtgcaagatggtttgcatagaaaaggtgattcctaggttcttcaccttgccaaaaatagtctgtagttaaaaaaaaagtttggtgcagttaaaaaaaagtttggtgcaatgaaaaactttttggcagtgttttgcagtttgatctgtgatctttcacttaatagctatgtgatttggggcatatgacatggcctctctgagccatagttccctcatctatcttacgttgcagtattggtgtgaggatttgaagtcattttaagtgaagtggtagcaaagcttacataatgaccctcaatatttggaggacattaatatactgatacagaatcttagtaaactgttgctgaatggggaaaatacgatgcttttcacatcatcgataatctggatctttaactcctattaaaaatgattagtaaaatttacttgagtaggttaaaatgcgctgcctaaaacactactggtttgaaataataagccatttggagaaaaataaatattataaaagatgaagcttgagtgatttaaaaaaaaactgtcattgccattgtgctctaagaattgcagactttgctttagatggtgtgcctagagtttcgaacaaggcagaattcaaatcctatttctgctatgtgacattgaattgagtttttaatgtctcaatctcagttttcttatcagtagaaagaatatggcactagctatctaagagaattgttgagcgtaaaagtgaactaatagttggccaagtcccatttccccatccccactgtttcagtttcttcagtatcttaatacagagtcattggagtaaatttttgcataactagttgtgtgtgctcttttctaggatgaatgaaatgaacctgagtccagtggggatggagcagctgacttcatcctctgtgagcaatgccttgccagtctcaggaagtcacctgggattggctgcctcacccactcacagtgccatccctgccccaggtgagtggtaagggagacctactgcatttcaacacttaactctgttatcaattctaaatggagtctagaagagatcagagcccctttaagggtagaaggtagaagggagaaggtaagcaggcctgaatggtggttcaacatgtgataggtaatggaaaataaggtttttgtagaggtagagtattagaattctagtggatagtagcagcaattttttctgatagtcctcttctgagttggtagctttttgtccagagctgtaattaacttggcattttatttagggctgcccattcatctggttcacacttcagtacccgttccctgggttaatagaagagaatcagttaaaattactctaataactattcccagagagcatggggaattgggctttatattccaccaggtttgaaattaaatggcaataactgcaagtgtaccaggtctagaattaatgtggaaagaagtgtggtacttttacctggggcttttacatggaacgcctcatgagcctccatacacagcaaaatcgtataggaaaaattcattcttcctatccttttttttttgaaatggagtctcactctgtcatccaggctggagtgcaggggcacgatctcggctcactgcaacctccgcctcccgggttcaagtgattctcctgcttcagcctcctgagtagctaggattataggcatgcacccctacacctggctcattttcttttttttcttttttgagatggagtttcgctcttgtcgaccaaggtggagtgcaatggcacgatctcggctcactgcaacctccgcccgcctcccgggttcaagcaattctcctgcctcagcatcccgagtagctgagactacaggcacacgccaccatgctcaactaattttttgtatttttagtagaaacggggtttcaccatattagccaggctggtctcgaactcctgccctcaggtgatccgccctcctcggcctcccagagtgctgggattttaggtgtgagccaccgcgccagccgtcactgtacttttaaaaccttttttctgcctagcttcattttcttattctattgaaatagaatataaatggaataaatattctattgattattacaatgataagctgtcagttctttaggatcaatgacattgttatgtattggactttctttgtcacagtaggagttagtataaataaatctatatattgtttaaatagttctctaaagagaattacttgcttaattaataaaatgcagcagttaaataagattcattgaaactagggtctcttcacatttgtttaagtgtccacaaaagaaatcttaaaaaattattagtggttaacccacttgattgtttgtaggcattccctttagtggacactcttgttaaggtggaaaagcctgttaaaaaatattgccagccaggcacagtggctcacgcctataatcccagcattttgagaggccaaggcaggaggatcacttgagcccaggagttcaagatcagcctaggtaacataaggagaccccatctctacaaagaaaaaaaaaaaaattagcagcgcatggtggcacacacccgtagtcccagctacgtaggagctacataggaggctgagaagggatggccacttgagccaggaaagctcaggttgcctgagccatggtcatgctactacgctccaacctgggcaacatagcaaaaccttgtctcaaaaaaaaaaaatattgcccctggcaaaaatatgcaaatcagcactgaccaagttggtgggtatttattatgatacttagcccagtaaaagtcacttcactttgcaagtacatataactcaaagtagatataatctcacgtttaaagcttttattaatcactaagtgtagcatatatacaaaagattgtatgaaggtgtacatgtacagttttacatctaactaaactacgttgttttccaggtagaaatgaaatattctcaccatataaaatggtaaatacaataaagtttaaaaataccaaaaaaatttcatactatcactacctagggactactcctatgaacattttatgtttccattgtttttttctctatataatttgttttcttgtatttaaactcggtttttaattctaaattaaatattttggctgggcatggtggcaatccccgcactttgggaggctgaggtgggcagatcacttgaggccaggagttcgagaccagcctggccaacatggtgaaaccctgtctctagcaaaaatacaaaaattagctgggtgtggtggtgtgtgcctgtaatcccagctactcaggaggctgaggtaggagaattgcttgaacccaggaggccgagattgcagtgagctgagatcacaccactgcactccagcctgggcaacaaagcaagactccgtctcaaatcaatcgataaattaattaattaaatatttttgtatttaagcgcaatacagacaattggagtatcaacttgccggtttagaactaacttaaaaactatctttgggactaagactactttctttaggcttatttgtggatatttgcacattatctaaggatgaaaagggctagtaggtgagatttttgcccatgtgtaaaaacctttctaagagtttagccagtggttgtagtgagaatttttaattacctattttcttttaactgagaaaaaaaattttgttttgtaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggtaagtgttacagttacttgagatgttagagaaaaagaacggcgccagcttttaaacttttatcctgaagatatgaataacacttttttctgtttgtcactattagatattaatctctaggcaggaaaagtatctttgtttatatttatgtacttttcctcttagaatgtggcacataacacattagtaatacagtttgactaagctgaatttcttaattgcacataatttttcttctttctcctccagtatctctttcatttggtgtttataattctacagctataatttcagtcaagcactatagtgtcttgttatagtgtcatgttttttaagttcattgaatttttattctgttataggagtattatatgcttattgcggaaaatttagcaaataagggaaggaaccactcagtcccatcatccatctttttggtgtacttccttcctgccatttgttttggtgtataggtttttaccaattttcataattaagaccacggtttcttctcttgctctcttttttcttttcttttttttttttttcttttaatggagacggagtctcaactattttgcccaggctggactggaactcctggactccagtgattctctcacctcagactcttgagtagcttggaatacaggcacatgcctgccttgagaccataccatatttcatttcttttttataaataacttttttaaaaaaagagatggggttttggcatgttgccgaggctggtctcgaactcctgcgctgaagccatccgcccacgtcagcatcccaaagtgccgggattacaggcatgagccactgtgccctgcccaagaccatactttctatacgattgtctgtctttacttttttcactttatctttttctctgctgttacatgggtattttcctttgctgctacgtggttttcataattatcctttttaatgatgcattactttctactgaatgggtatttgatggtttattatctttattgttggacagtttggtttttccagtttttattaccattgtaactaatgctcttatgaacgtctttatgtataatatttacaaaatggatttagagaagagtaccttaagtggaatttcttgtgcaagagggtattaacatttttgaggctcctaatatatatgcttcacaaagaagttttagcagtttacattccctctggcagtttagtaagtatcatttcaccatatcctcccaagcacaagtgttaatttttttttgttttaataaaacaggtacaattgtgacttgtattaaatagtttgtgttatgatagtttaattatattaaattatatttaattaagttttatttttcacatggaagatctgtttttaaatcattttaccttttaataattaggagagcaaattttacaccttaggactcaggaattgcaaccatatgtatattaaaagcagtgttttcgttagtgattcccagttagcttcaaaggaacatagttaacttttttaggattttcgagttttacaggaaaaactcaattacggtatatgtatgttgctatttataaaatagtgtgtatcgattaaattaaagaagcaggagattatttgaacttagttatgtttgtaaggaaatagcgtctagtgcttggaattctttaataatgtactaaaagtctctgatatctcatcttttccttttctcaggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttgtgagtgtgtttagcctttcttttttggaaatatttgtaaaaagggccaccatccctaacaagttaagtcgtaaagtttggcattaagggagtatagaaagcaactagaccttggaacttttctttgccttggtattgtcctttatattaatgtggtgccttttcttcaagtaagccaaatgatatacatacatttagttggttcttagagcatcctcctgaagaaatgaaatgtgaagtagtcatttttgtattttgcagataagcttagcacatgcggtagtgtgtgcctgtagtcccagctattctggaggcagaggcaggaggttgcttgagcccaggagtttcaggctatagtgttctgtgatcccacctgtgaatagtcccagctattctggaggctgaggaagagggttgcttgagcccgggagtttcaggctatagtatgctgcgatcacacctgtgaatagtactgcactccggcctgggcaacaaagtgagaccctgtctctaaaaaacaatcatagtgataatacaatatttttttaaaaaaggtaagtttagcccagtaatagttaaggtatttcccaaggtttcacaaatagagagttataggggtaaattctagtaaagctgtttgtgacatgccttgtgaaaattattcagtcacttttataaccccatggaaaaatgtaggtggatataaaccaatttttttctttgctcagagtgcatataaattattattcttgggcgtgtaaaagtttttcttattgggcaacaacaacaaaaaacaatataaaaacagttgatttactggtgtcactgtgtttcattcatgcaggaaacatgttgagtgcttattttaatttattgatagggtttctctgtcgcccaggctagggtgcagtggtgcgatcacggctcactgtagcctcgacctcctgggctcaagtgatcctcccactttagcctcccgagcaactgggaccccaagtgtgtaccaccacacctggctaatttttaaattttttgtagagatgggggtctcactgtgttgccttggctggtcttgaactcgactcaagcaatcttcctgcttcagcctcccagagtgctaggattacaggtgtgagccatcatgctgggctttttagtgcttactatgtggcagcctctgctagatgctagggatagaacgatctaccaagagacagtatgtgtacatacctttaaggagcttacagtctggtaggaagcataggagactgttacaatataggataataataagtgtgacgatggggtgaagtgcattggtactaaagtagcctgaaggggagcaactagccaggccatggaagggtcggggaagatttaaccaagggaagtaacatacatgttagcacagaccttaaggacaagaaagatgtgggcagttgagagtcaggaagacaggagctggcacctgtaagtgcctagaaccaaaagaatcatgagtgtttcagaattgctgaagcataaaatgagggtgaagagaggggtcatgtggtgagaggagaagtaggagccagaacacaaaggctcttttaagaccggtcaagagttttagggagtgagggttggggtagggctttgctgcaatgtgagaataaatttgttaagaggcaaggaggtgtggaagatatcataatttatgggaaaggtgatgattctcaccaatctagagtagaggtaattaggatgcagaagagtggaggacatttgcagagaacccagttgagcttatcgattggataaagttggaggagggaagcattaaggagaaaaccctggtttctggcttctgaaactaggtagatagaaactaggtaagtagagaaggccatgtgttggctcacacctgtaatcccagcactttgggaggctgaggcagaaagatcatttgagaccaggagttcaagatcagcctgggcagcatagtgaaaccctgtctcaggaaaaaaaaaaaaaaaaaagcaaacagaaactaagtaggtagggtagtagtgaaaggcagaggaggatatgattttgatttttattattttgggaggagtgacgatgagtcaagttttagacatgttgatttcagtgtctgtaagacacccagtagagatgtctaatgaaaagttgtgtgtggacctgagagagatctgtctggaaatatttaagaatcatcaacattaagatgttatttgtggctgtagaagtggaatgaaatcatctagtaagagtgtggactgagaagagggctagggatatcaagatatagcagaagaggagcttccaaatagactcaacgggagcatcaaaaataggaggaagcccagaaccattctgtgccacaaaatccagcccatggagagactagttttaaccttttaaagtctcaaatttagagttttaaaatgttttaatcgaagaatgtaatgaatataaggctaatttagcagaaggtaggaggtggcctaaataagcttattgatttttttcttaagagggcaaatggaacctcttctaagtgtgtgtggtttataatgagatataatttatgtatacattttaaacgtgcaatttagtggtttttttggtgtatttacaaggctgtgcaaccaccaccactgtctccttccaaaacattttagtcacccggtaaagaaacttcataaccattagtcacttcccattccctccttccgcgtattctcagcaaccactaatctactttctgtctctatggatttgccttttccagatatttcatataaatggaatcatgcgatacttggccttctggatctagtttctttctcttcgcataatactgttctgtctcatccatgttgtagcatgtatttgtacttcatttctttttagagctgaataatctgtaatatggatataccacattttgtttatccatttatcagttgatggacatttgggttgtttctgctttttggctactatgaataatgctgttatgaactctcatgtacaagtttttgtgtgaacatctgttcttggatatttaggagtagaattgccgtatgtttaactttttgaggaactgctttccaaagtggctgtgccatgttaccgtcctagcagcagtggatgagggttctaatttctccacatttttgccaacagttaattttttatttttatttatttatttttttatttttttgagacagagtctggctctgtcacccaggctggtgtgcagtagcgcaatctcagcctcactgcaacctccacctcccgggttcaagccatccttccacctcagcctccccagtagctgggactacaagtgctcgccaccatgcctggctgattttttgtatttttggtagagacgatttgccgtgtttctacctggtctcatgcgttcgagaccagcctaggcaacatggcaaaaccctgtctctagcaaaagtattaaaaaatcagccagacgtggtggtgcatgcctgtggtcccagctacccagcaggctgaagcaggaacgccactgcactccagccttggtgacagatcgggaccccgtcttaaaaaaaaaaagaaaagacagatagatgactgtggttctaaggtttatgtattccaactattttgtgaatggttgtggagtttaaatgtaatgattgagtaatagtatcataaatactgttccttagcagagtggaaagtgtaaagaatagagcagaagatttacggaggaggacactcataagcttgtgaaagtgaagttgtagtaagaatagagaacaatatataaagggagcatcctctctgccaatgcagaaagaaagaccatatgaaaaataagaaattaagaattttaagcaaataatgtctgcaagaatacaattcttctgccctttgaaagagcaggctgcaaattgtttttgtcttaagaatgtgtcctcaaaacttggttgaccatcttgtttatagtgaagcaaaagagtacagtggtgtagctggctctgacgccagtgtcctatgttcatagcataggtcactggggtcagagccagctgtaccaccgtggccatattttggctctgcataactaacagcatttcaactcagtttcctcttacagttcagaattggaatcttttggactttagggcatcatacctaaatgtacgatctacttaatgtaagggataatgtacttgattgttgaagtaatatggtgctatttttttcttttattattatttttaattttttttaaacagatgggatctcactgtgttaccccaggctggtcttgaactcctggactcaagtgatcctcccttctcagcctcccaaactgctgggtttacaggcgtgaactaccatacccagccaatttttcattagtgtttctcttatgcactgaataggaaacttgtcctgttggatcaaaagaaaaaaaatcagatcttactgaagtctgaagagtggtgtaagagtaggtatatatgttagtgtaaggaagtgagtctttgataagaatatctctattagaaccgtgcttcttactggatacattttagtaattagcatttaaattaaaacctggggctgggcatggtggcttacacctgtaataccagcactctgggaggctgaggtgggtgcatcatctgaggtcaggagttccagacaagcctggccaacatgaggaaaccttgtctctattaaaaattcaaaaattagctgggcatggtggcacacgcctgtagtcccagctatatgggaggctcagacaggagaatcgcttatacccgggaggcagaggttgcagtgagccaaaatcgcgccattgcactccagcctgggtgcagagcaagactttgtctcaaaaaaaaaaaaaaccgtggtggtaatttagcctgcttgaactaaacccatttgtattgctcaaatttgccatctacagggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtaagaaccttggaactgtaaaacactattacatctcttcttcctttgtagcgtagagttgtaaaagtggatgtgtataatttagtaattatttggaccaaaagtcaatttatggcttaagatttatgcttttatggaatattagtcttgtccactgatgatagcaataaatcaagtcaaaaactttattgggaaatctctcctttgttagaatcagtattgagtaaagcaaaaaatcctagactgagtctttgaagatttaacttttattctcatctgtctcatccactaacaattattctaacaacacatttcttaaaacttagtttcttttatagaaacatggaaaattcaccttatgacacaactttagatcaaatgtttgtaaattatataatgctccttagataaaaggaataaagaatgtagattgccagactttacttacccatatttgaatttagcatggcttctgagttactgcgacatttctttggaaatataaaattaggttcattattcttttagctgcagtttgggtgtgagtcatttcaaagcatcaaacagtttaggtaaaatagagcagtgctttaagcacaaaagattttagaagtctgatttatttctatagtaattgctttatatttttacaatagaataatgttttctgttattttttatttatttatttttaagagactgggtctcactctgttgcccaggctggagtgcactggcctaacatacggagtacagtaactcgagtgcagccttgacctcctgggctcaagcaatcatcctgccgcaaccttccaagtagctgggactacaggcatatgcaatcatgcccagctaattaaaaaaaaaattttttttgtagagacagcatctcactatgttgccgaggctggtttcgaactcctggcctcaagcagtcctgccttggcctcccaaagtgttggctcattatatgtgtgagctacaaacttttttatatttaactccaaaataatgtatttggagagacatgaaaagattccctttggataaaactaggttcaggaattcctgatatttcttcttactcagcatttattgtgagccctatgttatctgttcattacattttatatatttacaggctaggacccacaaggcttagtcacctctgaggaatgctagcatattgttttttttatttttttattttttttgagacagagtctcgctttgtcacccaggctggagtgcattggccctatctctgctcactgcaacctccgcctcctgggttcaagcaattcttctgcctcagcctcccaagtagctgggactacaggcgtgcgccaccacgcccagctaatttttgtatttttagtagagaccgggtttcaccctgttggccaagctgatctcaaactcctgacctcaggtgatctgcccacctcggcctcccaaagtgccgggataacaggcgtgagccaccacgcccagcctacatattggttaaattcattgaaaataagattctttgcatgggtgaagcacctctttcttctgtatcttgctgtttaaatcattgattgtgtagttggtgtccttccactgacaggtgtatggactggagaaaccattcctgtgcggacttgctttggacctctaattggccagcagagtcactccatggaagtagcagaatggacagacaaggcagttaaccatatctggaaggtcagtcctgatgaaacttttctgtggcttttggctgtttttcttagtaagaggtagttaaaaagttatgataaagtcaaaatcagccagaactgatacagtgccattcactggtcagtcatttatttcacgtacatttttttaaatgttacattcatcattcttggtagccaaattataacatacagcaaaacaccagctactggaaatagaggacaaactgtttttgtctctgttttgtgagttaatccaattattttaaccatttaatgcatttgaattacttgtgactgctgaggccacagactttgtttgtatgataaaagtcttactttgtaattaaaacattcctcaaatgtttatcttaggaaataattctggaataagaagctaagattatttttctagttttcttttttttttttccttgagatggagtcttgctctgttgcccaggctggagtgtaatggtacaatcttagcttactgccacctctacctcctgggctcaggtgactctcccacctcagcctcccaagtagctgaatttacaggcacttgccatcatgcccagctaatttttgtatttttgtagagacggggtttccccatgttggccagactggtcttaaactcctgacctcaagtgatctgcccacctcagcctcccaaagtgccgggattacaggtgtgagccaccgcacctggcctatttttctagttttctaatgaggggttagaaatacaacattttcacatagatatctattgggaatgatgcttgcgaaattgaagtaaggagaaaatgggtcttgtgatctttggaaaggtaaggtaccactgtcattgggaactttaaatttggaatgctaggcccaagtgggaaaatcatgacaagggatgatcctctgcccttaatggacattcagtcattcagtgcctactgtgtgataggtgatgaagacaggtggacaggtagactggttttttgtcttttccaggcaaaggttgaataatcaaaaacaaagtcagtctcttcactgagcactaactgtaggtctctgatggtctttatgtattgctggaaatagggagaatgttgaaatgatagcatgttggagaagtaggaatatattttcccactaagaaagctgggacctactgcaaatgagtaaatgaggtgattgctggcctaagtgtaatgtagtgctttattgcatgtcagtgcatttgacatgtgtgcttgctttctgttggcagatataccacaatggtgtcctagaattctgcatcattacaactgatgaaaatgaatgtaattggatgatgtttgtgcgcaaagccaggtatgagtagtcttggatgagaaaaaatagttaccatttagatgtttttcaataggaagctttgcataaaagaagaaagagttaagaatccaaattacaccaacacctggacatacttaaagcccaaggcagccaggcatggtggctcacacctttaatcccagcacttggggtggctgaggtgggagaatcgcttgaggccaggagttcgagaccagcctgggaaacatagcaagaccctcatctctaaaaaaagtttttttcaaattagctgggtgttgtggtatatgcatgtagtcccagctcttgggaggctgaggtgggaggatcatttgagctgaagagttcaagctgtgatcatactatggtggtgctgttgcattccagtctgggtgacaaagtgagattctgtctcaaaaaaaaaaaaaaaaaaggcacttaccaaggaacaatatagttaccactgaatttgaaagtgggtgccttttctttatattggctgttagtccacccctgagttactggagttaattcttgtttagctagctagctctatgtctttgtcatactgttttttaaagacttcattttatttatcttgtttgcttccaataacagactgtagtgtttttgactacaaaaggtcatcagctaatatgttgaagtaagaattctgtttctctacaactgccttctcatagataggacgggaaattacaaaaacattccagaggaaatagtaaatagttctgcctaagctttcatataggattttgcaatgggggaatgttgtacttagtatgcatttcaaaattaatgtgcttgatctattaaatgtgataactcaggaaccgggaagagcagaatttggtggcttatcctcatgatggaaaaatctttttctgcacctcacaagatatccctcctgaaaatgaactgcttttttattatagccgagattatgctcaacagattggtaagttaatatgtgtttataatgaatctggcttagtaaaaataccaaagaccaggattaaagttttggtaatgatttacatgttagctgaagcaaatcatatacctttgtttgtataaatgcaaactattacttgtatttgaggtgttaaaatctgtgagattcttcacaagctgaatgttattgaccaagcaataattcatatgatacggtcttttatggtaggactttggtttggggcattgaagttccttaggctacttttcgagctagcaccattgagatataaattcatgaaggacagcgaagtccctcggtttgatttaacctgcatatgctttctctttgctgtgctgtttcatgatgacagctaatgtttaagagtttgggtatgctataaaacctaaatattttgcttacaaaagaggccttataatccagtatttaccaagtgctttctttgtgcctggtacactattttattttacttatgtatgtgtgtatttagagataaggtctcactctggcaggctggagtgtagtggtgcagtcatagccaactataaccttcaactcctgggctcaagcagtttcctgcctcagtctcctgattagctaggactatgggtgtacatcaccatgcccagccaatgatttttaagttttttttttttatggagatggggtcttgctgtgttgcccaggctgatcttaaactcctggcctcaaatgatcatgccactttgggctctcaaagcactaagattgcaggcctgagccactgtgcctggcccatagtacattattttagatgcccttagtacattattttagttttataggaagtgggcaaattggaaatatggagagaaaggagaactggaagcaatgattgttaatatcaagaacaagttttaagattcaagtattgggagataatgagtaatttttttttaaaaggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtaagttgtgttggcccatcagaatggaatttttgcaacaattagaaaatgcggtagtaaaggctttgtagagggattgtaggtggagttgagatttgatgtcagagaaagaaaccttcgtggtttaactgagattccttggaggctgtcacttccaattattaggatgttctgctttccaggtctccccaccatagttggaaggtgcctgggaaaatgcacttaataatcaggaagttgatcaatgtgtttggtcttaaatagaagcttctgagtctgagtctgagcctctcattagagctcaccccccagtcaccagccagagccagtttctctcctttaatattattgctcaataaatattgccacagtttattttttgagcttccattttctaaatcccatgcaaaccaacacctttcttttagtactttttaagaaaaaaaaaaatttttttttgagatagggcctcactctgttgcccaggctggagtacagtgacaccatcttggttcactactacttctgcctccaggactcaggtgatcctcccacctcagcctcctgagtagcatggactgcagacatgcgccaccacacctgactaatttttgtatttttaatatagatggggttttgccatgttgccaaggctggtcttgaactcctgggctcaaacagtctgcttacctcagcctcccaaaatgctaggattataggcctgagccaccatgcctggccactaactttttttaataaatactacaaaataactgatggctttagctttcttgttggggtcatcttttctccagatcttcaaaagtttcttccccatccttttgcaacagagaccttatggcccacaaagcctaaaattctatctatcctttaagagaaggtttgctgaccccttagaggaatcttatttttgcattcttggaaggattttgtttcatccctggttttgaggcaatattatatgttttaaaaagatagaaaactataaaatctatcttgtaaaagtatgtttctctatagacacgtcctagaattcatgagtttttttttttttctttatgtttgtgttagggcattaggattataagtcatttttttcaagttttatgtatcacctatacattttttaaaaatacatatttaggtcagaggtcctaaaggagatcaaattaatttactagctttagttgcagaatataaactcaggagctcttgagtggtctcacatagacaaccctagaaagtaaaatgctgcttaccagtcagctctgtttcattcctgcctctgctgcatgcacatatgtgtgcctgtgtgtcttggggatgccagcagttgttttcttcacggtgtaatactttgggctgattgcaggtcagaagaactacaggtgtaccttgtgtgacaagtctttcacccagaaggctcacctggagtcccacatggttatccacactggggagaagaatcttaagtgtgattactgtgacaagttgtttatgcggaggcaggacctcaagcagcacgtgctcatccacactcagtaagttaccctgcagccaagacgtcgttcctcaggtggtgagcctttgtgtggctgcagcccacctgctgattgaagggctggggagtcctggctcatctgtttcatgccttggtaccatggtagatgccttctgtgttccatgtagccaagccaaggttggaacactttttttggtgttatcctggaagatttcagttgttggctttctttttcttacttttcacatgtactcttttttcacatctacaaaaacctagagacaaaaaggactattgactgcaagtggttgcttatagttagacgatagtgtgcatgtgagagagtgatggagtgagaagagtaagagtcagcagccacactatggagaacctttggtcctattaagaaaattcaatttcagtccagaaataatggcgagacactgaaggatctgccagcccctgccattttggaactgttctgttggtgtgtgtgtgtgtgtgtgtgtgtgtgtgtgtgtgtttgtctgaattgcagttaaaaaaaaaaaattgttatcttaactgtttgtaagtgcccagttcaatagtgttagttatattcacgttgttgtgcaagcactataggattttaaggaaaggagtgtcatagtgacatacccattctgttaatacaaagattacttaggcagctgaacagaggatgattgagggtggggaagcctaaatattggaagaccaattaggtatttattgcatgaatccaagtgtaattaaatgtctagactgcattagtcacagtggtcatagaaagaagagatggattttgttgtccttagcttttaacaagtgtcagaagaggaagaaaatgttttcagcttatgttatggaaattctctttagaaatcttaccttcactgaaaacgttatattcttaatgtagaatttggataaacacttggctttgataccagttcttctgtctgcttccttatcacaatgcagcctgagatgctaaacagccaaggagcctggatctacattcctaactctcagaaggatattctaaaacaaagacttctttagttccattgctagcatgaaattttacaaaattagacagaaattatcaaatattacatcaaattgtgcaatattggagccaaaagagatccccggatcatctagtcttaacatcctgtctaggcagctcaggttgtgataataaaataccacagattttgtggctcaaacaacgggagagacacagtgagagaaggcagtcatgagcaagcctggaagagggcccccaccagaacccagccaggctggcaccctgatctctgactccagcctccaggactgtgagaaaatacgtttctgttgagagaatgaaagagaaagaatatgagagttccaatctcttctcataaggacactaatcctacatcatggaagccccatcctcatgacctcatctaaccctaattgccttccaaaggctccacctcacactgggtgttagggcctcaacatgtgaatttggggtgaggggggacaaatatttgtccagaagactgcccattataattgcctggaaaatgtgaaaaacaacaattggtgctaggaccccatccatgggaattctaatttaattggtcagagttagagctctggccttggtattttaaaaagctccccaagtgattctcgtggccagccagggttaaggactactgacttcatccacatgcaagattgatttccacaatgtctctggcaagtggatatattgtttcttaaagatcacacaattatagtttgaggaaaagttttgcttgaatcaagtcgatatcagcctctatcctttcattttacttttgcttaacaaatgtggatctggactccttttcagggtgagaagatatggtaagcctctttgccaaactttcatgggatagaaagaaggttttggactgtcaaaacttaaagctggtataagtcattcttataagaagcactgttccctcaaaatggttttgaatgaggctttaggcttcctatggagatcgttggtaaaattttcagatgcttgtatttttactttggggcatttcaaagtggatatagtagtattagcagtctttttatttatctacttaaaaaaaacagctacagccctaatgccaaatgcaagaggagttccccccctagtgtcccccgagagtggaagggtggtgacagaacctggctttgcccttcctgtaagaaagaggaagtgagcagaagaacagtgatgtttactccccaggtcatcttgtctcatggctttagataccgtcatatgatttatgtctccaccctcatacacctcaccatcactcagcggctctgatgctggatgttcgctaggcaacttaaatcttatgtgtccaaaactcaacccagtattaccccatgaatttgatttcctccagtgctgagcagctcattaaatggcaccaccattattcacctcaatggtcaagccaaacaccttgaagtaattctcaactcagtttttccttccttccttcattcaactaacaccttgtccagaccaccagcttttcttctatggatggcttcagtagcctcccagttgatctccctgccactacttgctgtttctcctcatctactccgcaacacagatgaacacacatacacacagttttctgtccgcagtgccagagcaatccatttcaaatataagtcagattgtgcctgtctccactcatacatctctggtggctttccatcgtatttgtgttaaaagctttttacagcagtcagaaggccctttatgatgtaatagtacttggctacctctcccttcaccttttcttacttttcatattctgctttggccactctgaccctccccttgctactccttgagcatactaagcacatccagtctcagggcctctgccttagaaacttctccctccagatgcctgcatgtcttcttccctccattcaggtttctgctcaaatgttatctcctcaggagggccttccttgactatcttatctaaaataggaccccttcacttttacctggcttcgtgtgttttcgtagtctttattgctatatgataccacgttacacatttgtttatgctataatctgtccacttagaatgtaagcttcatgaaagcagggacttagtttacccacatcctatagccctagcatctagaacagtgcctggcataattagacacagtaaatatgtgttgaataaacatctaaaaaccatcagagtagaagatgaaaagtcagacttttggtaggggttttgttgtggccttgggcaagttccttagtagtttttatgcacatgatgtttcccatctgcagaattaagaggttggattagattggtggttttaaaactgctccagggaattctaagggttcttcagtgccatctgttgctagaagaggatgagagaaatgctaaggaagccaggcttcagaacgcccgactgcaccctctcactccttccaggattttattaataacctgctttaactgtttcatattgggctttcataaagacatggggttcagctactcaaaaaaaaaaaaaaagctaaaaaattcctggtctgtgtgatctctaaggttcttttcagctctgaaatgtctaggccagggttactcaaaccttgacattattgacattttgaccgggttaattttttgttgtggggctgccctgtgcattgtagaatggttagcagcatccttggccttttcctactagatactaattataccacccctccccagtataacaatcagaaaggactccagacattgccaaatgtccccatagaggcagtcgcccctacttgagaaccactagtctaagaaaaggacagaaaaatggtaattccataaaagtggcatccagggaatacaaataacggtgtaatgagataccattatgtactggctaattggcagacattttcaaatttgagtcttccagttgagaatatgggacaaccagaaccgtcaatgatggatgtgtatattgaaacaactacattggaaaaccgtttgtcattatcttgtaaagttgaagatgtgcatatcctttgatttagctatatagttcttgggtatgtgccctagagaaacatgtattgcagagcaccatacaagtataaaaatgttcaaatgccaggtacagtggcatgcacctgtagtcccaggtacttgggaggctgaggcggacagatcacttgagcccaggagttcaaggctgtagtgcatgatgatcacacctgtgaatagccattgcactccagtctgggcaacatggtgggaccctgtctctaaaaaataataataaaaatttaaaaaaatttaaaaacgttctagcacttttgcttgtgataataaaaaactggaaaccaccaaaacattcattagctagagacaaatccagtaccatagataagttgtggtgtatttgtatatttgtaaatagtatacagcagtggaagggaacaaacaactgatacagcagcttgaatgaattttatgagcatcatactgagagaatgcagcaagacaaaagaaatacatatagaatttacatagaatttgagaatttacatagtattctaaaacaggaaaaatgagcctacactgttttaaactatacatgttttatgagtcttctgtatatcacctatgcaaaagcctgattcagaaggatagagctgctctgacaaaggcctgcggctatgaagaataagtgttgcctcagttgttatttgtaaccccaaatcaaatgttttttcttgtgttcctcttagagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattttggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccgtgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacaggattcctctggtagtctcatttcatggaggaaggagatgagtgagtcttctagggaaagtcaagtacaatttgaatctttctgaggttagaagaagagagcatttctagagtattttagcttttgagatcatattcttattgtttctgctgttagtacttaagacaaactgcttcctgtgcttccaaccctcttctgccctgttcctgcctaaggtatgcctttactctgttacctccttggagaaatgtggcaggtctgcagtggagggttgggggatgtgttgcggatggttagggttggctgctgacactgggtcgtgacgcctccctcagggcagctctggttcctagggcagcttcaaactcagcattttgccaaaggcatccagctggctggttcccccatacccaggaaaccactggtactgggactctaagctccctttcttcctttatctcagtagcacacactgggttcacttccttcattcccaagactgaaatgatgcccaagatagttacgcctagtgtcagaggaacacaaacagcagaggaagcttggaaacctttttagtgaagttgtagctgttagtgcttagtatttacaactgtctctccatttttttacctcttaattttaaattctaagtcattttcacaagatgaataaataagtaagtgccctttgacatgaatgttttcagccttttctgcccattttgggtggccttgctgctgttgagtaaatggtcacggtgagaggcaggatgtgtatgtaggctctggagccctgcagaatgttctctagtgtgggctttgctgtgtgatgaaggtttgtaaccttggccaagttatgtaagctctctatgcctcttcccttaactgtaaatggagagtattaagagcgccgcttcattatactgtttagatgttaagttcatacgtgtcagtggctcccacagtgctcaacataaacagtagctgatattctttagtttcccattagtctacatttttcattttaacataggtttctacactaaaaaaaattgacatatagaatatccaagaagctctagattttagtaatataaataaaactggaataatttgagttttcaaggccaaagcctataaactagttcagagtattcttgcagctcactgtatgcttggcatttccttctcaaaaaggtcagtggctcataatcctggcatttttgttgtgctgagattctcagagggcaaagaggtaacaggaagtagagtcttcgtcagccttttcacgcttgacctgtgtccccgctttctagtaaacactcctttacctgtgtctcaagaagcataaacatgccagaggctgtcagcacctcatcaagtatgtaaacttgatgatctgatcaccaaacttggaggcacacactaaggaatgacatatctccatatacacaagtgattatggtctgttacaggtgaacacaccgccccctgccaacaccaccagattcatatggtgaagtcctaacctccagtaatctcaaaatgtgattgtagttggagatacggtttttaaagaaggaattaagttaaaatgaagtccttaagttaggacctaacccaatatgactggtgttcttagaaaaagaaaatttggacaaagccttatacagagggaagatgatgtgaaaacagggagaagacatttccaagcccaaggaaagaggcctggaacaggtccttccctcacagccctctgaacagtcctgccattgctttgatctcagacttccagcctccagaactgggaaacaatacatttctgtttagtcttcccggtccatggcaatttgttgtggcagccctggcaaactaaacagtctaaccagatatacgttcttgataatgattgcttaaaggggagcagcttccagtatagtgacttcagtttaaccccagctttacagattagcatgagcaatataaaggcaggcaccatttct

SEQ ID NO: 12708 - DNA, 76281 bp, Human
  misc_feature (1)...(76281): n = A,T,C or G
cagtaaaagtaatctgccatattttatgcttgaattactaataatttcacttatatgcatattgtaatcactctgtgttacatacatttctccatttagtttttaagatttttttaagaaggaacctaaaataaagagcaaagatcaagcttctttaatatgtccaatttcagatatgaagtaggcatcctatattatgttttatcaggaataatacaatttaactaaaagatattgttaataacagatactcagactctaaagtaatttacatagcttttgaacgtatgttttcaaagaacttagtagcatcccatactgtgttatgtttataggtttagacctctccccctctattgagctcttaacacttttaaaatggaaaacaaatagtaaagcagttgctaaaaatggcagttggagtagcttaagagtttgaattgtttgtttaaggactgaaaccaaatataaaaacttttaaggggattttttttcatcattcaacaaggaactgaaaattacaaggcttatttgcaatcttaattatttactcaatctgtttcctcccacgtctctaaatgggaacgcataactttaattttaaaggacatattcccatagggaaatatagatatcactgtaaaacttacgactttgaattaagtaaaaagattgtggccatcactggcttttgagctgcagaagcagaagacatgtacctgcccttcgggggtattagggacccgactaaacacacttattcttctctctgattgctggaccattccccaactatttggagctccacaaagtatcaggacttcatcaagagctcagtgaagggtgagatctcaaagataaatatagaggactcattccaaatatagaaccagttaagtttgcatgctcccttctgttgaagaaatatcaaggggtttcctgtcttggcactacttagcagcagctgcggctatgtatccacttgacatctggtgaaattgtagtttttgatggaggaacatttaaagttgacaactgtcattgaaacaactggtatatagttttcaaagacaagctagaaaccagtaatagactaagtacttcaattttgttaaaagaaactgggtaaagggttcaagttatataagatagggaagtctggttttccaggtaaaggttctctctctttttctgttggagatgtcattcatcaacataacgaagcctaaatttaaaagactaagacaaaatatttacaaatcacataaaagtgaggaaacagcaaaattagtagtcattaggagaaagccagggaagacaggacattcatcacatcctttcctcatctgctttcctcactgagtctctgagtgctcattaaatgctttcaatacagtgtaattaagtgtgtgaacatggttgtcatgctcctccaggaatcttgaaaccaggaatgccaggtatataacagcgggttacaaaagaaaacacggattcctaaatcagtgttttactgtcagtgcagtgttaaatgtcaatgcaacacttaagttgcattgacattcatgtgttgatcggattgtacaatgtgacgtgtgagatttctcgggaccgtcgaagctcagacaactccagggctgcaatttactcgtctggctgccctcgaaccaggctcccttggcgcgtggggctctcccggcgcttggtcccgacccgcgccgcagtcaggataccacggcaatctggggtcgctttgtaaggagctccgacctccgggcagtgcagggatactcgacggcgcgcgatgtcccggcggctccgcgagcctggcgcgctgagagccccagcagtccgagtcctcgagctcgggcgtcttcgcgccgccgccccgctcagtgcgcccaggcaccgcggccgtgacgtcacgcccgggactggccgttgcagcaagacggccgcgttccggttccggtaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaaggtagggccgaggcgggcaggtgccctaactagctggcgccgaggagacccgggtgcggtgggctccaccgactctctctcccgcagtgttcgagcaataccagaaggccaggacccagttcgtgcagatggtggcggagctggcgactagaccccaaaacatcgagacgctgcagaacgcgggtgagcccggagcccgaacccccgtcgccccccgcgcactgagtccccgacgcctccgccccgctgccctgcccgtggagctcttggggagccgcagtgtggggaccggagttcgcaaaagcatccattcttttcagcgggtctttgggggtcaggccgagagggtgaagcttccagatggttgtgggaggtgcgcgttgtccctgtttccatcttcattgcacacaggcaagtgtcaggttgaaagtcgaggccctaggaattgcctggagtcattttacgtgaatgggactctaccctaatgagacccattttatccaagtgccattttgcatgccaccctgcctttgatcaccttcgacttcctcacagcaaagcaattccagtggtttagacgtgatttctcgtcttgctttagtgaaaggggaatgatatgcttgaatcttttccaagaaattccaagtaggtagagaccagactttgcgaaatccttatggcgcgttccttctactcctcagtccggactcttgcagatgtgagagggggagagagggggagagggagggagagagatcttcttatctcataacataaactgataagagaaaatggttcttcttcttcttcttcttcttcttcttcttcttcttcttcttcttcttcttcttcttcttcttctttcttcttcttcttcctcttcttcttcttcttttcttctttcttctttcttcttctttttttttggatgattctaccaccatctgaactgtaaggtagcattttatcactactgtgtcatgagaaatcttcagtttataggatgtgatctttaaaactaacacataatttaaacaattaacatgttgacagcaagaatacttaagtgtaatgattactctgggtttctttgaggggaattactactgcacctatgtgatacttcgttttgtcactaggatttttggcatttattccttgtgtgtttttattggggggcatgtatttacaataaagtatattttataatcttctaaacgcattttagtttgaaataattgtagattcacaactgtaagggataatacagagagatcccgtgtacccttttctcagtttccccaatggtaacatttttcaaaactgtagtgcaatatcacaaggaggacattgacattgataaaaattcgttgatcttatataggtttcctccttttaattgttcgtgtgtgtgtgtgttttgtcctatagaattttattccgtgcgtatccaccaccagcacagtcaagatacagaacactttcattgtcacaaggatcctctctcttgcccttttatagccacacacacctcctgctatccctaaccctggacaaccactaatctcttctccatttctaaaattttgtcatttcagaattgataatcctttgttctatagttgttttatatgggttgattttctgtattctgtgtgtgtgtatgcacccgtactcctccaagtacccagaacaatactgggcacacagtatttcatatacacagactaacacagactaaggtattagaacatgttacattttagaagtgtatttaaaagtaattttaaagtgtaaacttttaaagttttttctctcagtccctctcaatgacctttgtgaatggacatttactacttaacaaagatttagtttctggacaatatgaatatagccaaactaaaacttttaaaatgggaaaataattgatattattttcaaattttaatactgagatgttaaagtatacataacttttaagatacggagtatcatgttttagtgagtagtggcaggttagctcctcccataagagtgcaatgtagacttcacaatggaacttaatccaaattgactgtataagtggcttagatataagattctacacttatggtctggcttaggaaagatgaatacgaaaggaatataactttatgttttgaaattctctgcacttgactaatatctgggtagcatgctaaaatgtttcttttcctgagggacttatttttaacaaatttcatgttatcgagattcaattcaagcattcctttagcaattttaaatacagacataatgaatattcaatgtatttattcttttgattaaaaaagaacctgtaaactttgttatgaaaacttttctttctttctttgagacagagtcttgctctgttgccaggctagagtgcagtggcatgatctcggctcactacaacctccgcctcccaggttcaagcgattctcctgcctcagcctcctgagtagctgagactacaggtgtgcgccaccatgcccagctaatttttgtacttttagtagagacggggttccagcatgttggccaggatggtctcgatcacttgaccttgtgatccacccgccttggcctcccaaagcactgggattgcgcccggccagttttctttcttaatagtcagtttacttaaccattcaaatgatttgttcttttaaaaaattacaattttaaaaaagggctttagaatgagcctcagtatgtgtaaatcaattatacattatggtcaaactttttttcagtcaaatgccttcatttggtagcttcagataccaatgcatattactcctgactttgacatactgtctacatacctggaagattttgtttgttttctcatttttccctccaatatgctaagtaaatatatatcatggatccaagataatgtaaaaaatattttccatatgggtatcatgatcaaaccagtaattcccttgttaagaatttttgaatttattctatgtgaaaggaatattaaaggtgaaaattgtcaatggagtttttatttcattttaagtctccaatcttttttattgtgttttttatacactaataagagaatttgctttattaaatatgtccaaagtaattgccaaagcagacaaagtatgttgcaagatcttttcttcagagttatttggaaaagattaagtttgatttccttcttttttgttttcgagacagggtttcactctgtcgcccagactggagtgcagtggtgctatctcagctcaatgcaacctctgcctcccaggctcaagtgattctcctgcctcagcctcctgagtagctgggattataggtgcgtaccaccacacctggctaatttttgttttgttttgttttgtttttttaatagagaagggttttcaccatgtttagccaggctggtctcgaactcctgacctcaaaggatccacccgcctcagcctcccaaagtgctgggattaaaggcctgagccgccacgcctgggtagtaagtttgatttctaaacaaaattattactagaaagaacggtgtacaaagcatctataaccttgaggtgtttttttttttcctcactgaggttttattcctctaaattaaaagaactcatatgaacaattaaaaagtttaatgtctgttataaaatttctttatgtactctcaaattctatatgtttgaaccattacctcttgcagctatttaaaaacaaattttgatacttcccgtctgaataattagtaacacatgactgtaatagtagagataatacattgttacttctaccaattgtaaaatttcagcaattggaggtgttttgttagttataaaatataagaaacatgttttgtggcttactggaacaccaggccacttttagttctgtttaggaggtcttttgaaatacactaatagaagctccaagaaaatgacttttaaacttagctatataaaatacacttttcctgaaccagctatttatataagtggggtaaagtttaaaatattactcaaaattttacatattacaacctatagtagaacatagcaaatcagtagttatgcacattttcagaagagtaggaataaataagtttgcgtaacactttaaatgtgcacctgtatgaagctaattttcagattgaggcaacttaatgggttcagaattcaagaaaataagtcaaatatgctgttgacataaagtgattttagattacatgtatctggagcagggtaaaagctccagattaactatctagtacctcttaatatgctatgagaaggaaaagccctgagtaagcatttatcatgtatttaagacataccttgatatgtacatgtgctatgatcctcttacaaacctgctgtttcaaaggatattgaaactgaaaagaaaattaacaaagcaactacaaaaaatttaaccaatcatgctatttaaatttgactttttttttttttggtatagaaggagtcttagcagttgtgaatatgaacgataatgaactcaaaacactgacttcttcttaaaagatagggatagagaggtttgctacatatgcttaagtggaaaatatgccaaggagctatacacattctgtctttgtatatgcaccaaacaataagttctaaaaacaaaagcttagtcagaattttattctgtgttccaaaccactgttcctacatggacattgatctgttttgttagctgagcattggtacatagtagaaaataatagagtcagggttaggctctaattgtttccttagaaaaaaaatggacaattaaaaaaaactaagctgtagatgagcctataagaaggcttacaaatagcaaatttcataggttaaattttacagattaaagttttgatattttcaaaagtttttgaaaagttatttaggtatgccataatcctactttacattcgaatgaggtttcaggacctttgcacttctgcctgaaatctttccctatacttatttgactaactaatttctactcagtctttatggctctgttttggtgttgatgcctcaaggaaatcttgcctgagccctcacagtaaattaaatctcttggtttatggtacccttgctcccagtatttttgttttccccactaaacccactaactccattatgctatgcataaattccatgcatagcataatcaaaattattaaataggatgaaggaaggagtaactgaatgaggaagaaaagtttttggaagtagtaattgttttcacatccacagtttggataattgttctcttcacaaagtgagttaggccccaaactggaactagaactcatttttaatactgcctcattttgtgctctttctactttaacttgtacgtattagtaaactgttttatgtgattctaggaattcctaataaaccttggttttaactgttgaaacaagtcctgtctttaggtatttgagtaccaatggctgtccaataactggaaaatttggtggctttggaggtctctttgaggactatcgtggagtttgagtggaggccagatgcagagggctaactttaattgataaattcctccaggtttgagggagtgggagtagtatttagtgtttaagctggcctcagaactctagagggccttaaggcttccttgggcttctaattagaatcttaatcaaaccaggagctctttaaacgcacgcagaggaaagtttgtaatccactggaagttgggaaccgaggtagtcctgcagagactaccttggactgagaccctgtctgcatgaagtgcaggctagaggagaatttttcagagccctgggctgtcagctgcctgtgacttactgactgctctcctgggcttttgaaaacacccaggggtagaatacagtgaagtgggagtcacttggtgtttgttgattgattgatgtgagtatatacttaacatttcttgctttttaatcatgctttgtgtaaagtactttttgttcacgggggcagaactttgggatttctattgagtggttgtactagccttaggagaaattcagggctacatcttgataaaaaatttggccttgtcttgtagtgcgtggaatggcctgtgtgaatacaagtcaggcctccctaattttcaaagtgaaatcttgattttcccatatgatccatgctttctttcataaggatggctcaacttaaaatttattgtttatttagtttctgttaaaagtcttgctgtggctgggtgtggggtctcacgcttgtaatcccagcactttgggaggccgaggtgggtgaatcacgaggtcaggagattgagaccacggtgaaaccccgtctctactaaaaatacaaaaaattagccgggcgtggtggcgggtgcctgcagtcccagctactcggagaggctgaggcaggagaatggcgtgaatttcggaggcggagcttgcagtgacccgagatcgctccactgtgctccagcctgggcgacagagcgagactccgtctaaaaaaaaaaaagtcatgctgaaaacaagtgatatgtgtgtgtgcgtgtatgtgtgtgtgtgtgtgtctgaatgaaatgatctctattcacttttctaaatattctgtgttctatacctgcgtcaagttagaatcactattaaagtatattcataggctagattatattagtttcccatataaatgtctttgtagacttagtttaataatatatcaccctttttttaaaaaaaattgagggattacttaaaaaaaatagatgcttagattttccagtaactgctataaatctgtgaagacattttctgtcttgttaaattcttaatatgaagataaacttgcatattcaacaaatatttatttgtttatttatttgagacggagtttcactcttgttgcccaggctggtgtgcagtggtgagatctctgatcactgcaacctccaccacccaggttcaagtgattctcctgcctcagccttcctagtagctgggattactggcatgtgccaccacgcccagctaatttttgtatttttagtagagacgaggtttcaccaggctggtcttgaactcctgacctcaggtgatccacccgcctcggcctcccaaagtgctgggattacaggcatgagccaccgcacccagcaacaaaatatttattattacatggtataggtataatatataatatataggtgctagatatgaaatttcaggaaaaaaaagttcctgcttatttttatttcacaaagtgttctcctttttacttttgctgccaggaaactcagtgctctgttcagaactcagttgcagcagctatcttcaacctacatttctgataaaatatcagttctccttcccactacataggggaggtgggactgtacctttgtatacatatattaatattttggagtaaactatttcaaatattttacagtagtgaagtgtgaataaaataaaacattaattctatctaaagatagattttcaaactgattgctttccatacattttctcttcacatgttacctatgaaaactcttggagcagataatcctgttagtactgtcctgtttattctttgtgctgccccattcctgattgcagtcttctgcaaacagatggatgtaattaggtatttactgtaaaagagaaaacacattagttagagaaggcaggactaattcaacattggcagctctctaaaaagactttcaaattaaaatagagttttgtctatatggtgtggggtgattttaggtgaggaaacagtttgaatgacccacttgagttccttaaaactttatgaatttatgttaaagtgctacgcacgtacctgacttcttgtacctaaaaagaaaacaactgtgaacacaatattacccattttgcttttattttaactaaaatttacctgaaaagagagaaaattgcacattaatttccacagctggtttattcattattctattcacatttattgagtgtccaagtatcagatggatgtttagatgcggaccatgcaaaaatcggaggcatagtccctgtgcttaagtggcttatttgctaatggaaagacatataaataaattattgtttattcgaagggcaccttactcaagatttgggaatgagggatatcgttcaagggagacatctaggaggaggtatataatcacacagatactgtgctgaatttcctaggagttagccagataaaatggcattcaggtagagggaacgttatgtgtaaaggcacaaagacaagagaaaaggtggtactcatggaaaaggccaatgtttagttatgactggagctcagggtaatagggcaaggagaggagagtcagtcatggttggagaagaaacaagtctaattatgaagggcctcgtatgaagtttagatttctcctggaattgatggaaagccattgaagtgttttaattggaagagtcatgggatccactttgtgttttagaaaggcaattttagcagtcttttggagagtagataagaggggattaaatcaggatcaggagactgggtgctcatttttgctatagcagtcatgtttgataagaaatgttaaaggggtaacatctgcaggacttggtgacttaggagtaggggttggggcaggtaaggcgagagatgacttcaagatgcctcctggacttctggttgcttggacacattagcaccattcatctgtagagaaaggatgcaaagagcagagagaaattgtgattttactcttcagtggttgaagcgtgtctgagatatccatgcgtcagtgactgtggtgatgtagagtgctagggctcaggagacagatagctggaaagaaagatttggatatgtggaactaacatgttaatttgaaaactatattaaaagcccattttatatttcctcatgtaattgtaaatatgttaagttccaatcattttatctggagtataatgcaaatccaacttcgcatagctttcatgttctacattctcactcagttgagaatctcacagacagatggtggtggctgggacctaatcaagggacagctggctaggcacggtggctcacgcctgtaacccagcattttgggaggctgagttgggtggaacacctgaagttaggagttcgagaccagcctggccaacatggtaaaccccatctctactaaaaatacaaaaattagccaggtgtggtggcaggcgcctgtaatcccagctactcgggaggctgaggcatccgggaagcggaggttgctgtgagttgagatcacgccactgcactccagcctgggcaacagaacgagactccgtctcaaaaaaaaaaaaaaagagtcagacagttgcactagaaaaatgaattaaattttggtttcatacagtaacaatggaagacagttatgattaatgctaatggtagaaataatgtgaattcaacagactatataccctttggtatacattccaaacctggcacataggccagtttttcttggcaaatgggctgtaatagacagtagggaggagaaaccggagagcatagacgcgagccatgaagagcatctacctcattggattgtaatgagggttacatgggttactatttgtaaatttcttagagaggtacctggcacatgggaaatgctatataagtgtttgctaaataagtgaatgaatttatgatgtgctggtccccatcccaccttcctctcagcccttccactaaaaaatgatatatcagatatggtagtcctttactcacaaacaactgaatcaacactgaatcaccaaacaaaacttggaagatactatagctaatgagaataaatttcaaaggagaaaacagattattcttgctcataatagtttcttgaattatttactattacaattgaattctatgtaaaaaggccatactttttgtgattcaatctgacactttagataaattacaagactttttgtgtgttataagggataacaccctaaatcacaattgactttatgtctgaaaaagtatttcaagaaaacaaggcaaacagatatgtgataccaaaatttgtaatttcttaatcaaatgcaggaacaatggccagaggtatataatcaataaaggctgggagaaaccaaatcaaggcctgaaaattcttattctaaaaaaaggcaggggaggaacacaaataattttaaataaaaaatgaccagtgaaggaaatgagaacatgttatacaattcatcagtgttgtgaaacttggttcagtaaaaatcatcatataaatatcataatttgttacagaaatattaaaaaatctattagagtaaggatgataagtataattagacttacactgtaacaggagaatatgtaatggttgtagtattaaaatcaaagtggatggtagtttctaggtccattagcacaagtgttgggctagctgtatattgagaacaaattacaaattacctatgctaggtcacttgaagaatagaaaagaagtttaaaacaagctctggcctagagaggtttattattttactgaggatataagacatttattcacacaaactagagaaccatttaacatgctgtgtcaaggatggctgctgtgctgtgctttgcacaacttcaggggtgccatttatatcaatctatgtgaacggcattccttcgatttgtgcagtacgcatcctgcacagctatacatggtggacctggaattattcaaagttttcatttttattaatttccctgagagtaagtggggcaaacagtaaagctccccagtgactttcctttccccttaaaataaaatcagaaaatcttagtttggcctacagccaaatttgatctgaccccaagtaaacttcttagctttatctcttgctacctcactcctcccattttatgtttcaagccagtatgaatttattgaggcttcttcaacagtgggcaacaactatacatcctttgaccaaaccagaaacttggaaatatcactgattcctttccaataatcagtttgtcttctgaatatctccttagacctttcactttcacctttctttttgccattaccattctccaggctatcttcatatctggctcggtaactatgatagtttcctaagtggtcttccctgcctctcatcttgtcccttgtcatcctttttccctactgtaatcagagtgatccttctttacaaactgtgactttgatcctgtcactgcactgacatcaatgttcagataaagttcaaaatacttaaaatcgtttattggatacttcaggacttttgtctctatttatctcttagcctttttctccagcttcctgtctcccttcttgcactatagtcacactgcattctcagttttgtcaacatatgaaactctttttgctctttgtttataccattccttctgggtgcaatactattcaatcctttctctccatcccctccagtttttcagcaggcaggcaaagtctgcctgagagccttcagatctcaacttcagtgtcactttcccctgtgttgcctccccatgtccctccaagcctgggttagatgctctgttgtatgtttgcagagctctctctacttctcctatagtggcatacatcatagcatgttgggattatctgtcacaacccgtttagaagttccttgaggtcaaggacaattgtgtttttaatactgtgtatattcttgatagatatatcttgaatgaattactcattcaagagtaattcaaaaatgtatggcaaaaaaagcctctaactatgggaccattgaacctttaatagttcttaattacaatggatggtattaattaatgagtcattcactaataataaaattatgtggatgaaaatatagtaaatttagggaactgatttttttctctttttttaattattattatactttaagttttagggtacatgtgcacaatgtgcaggtttgtcacatatgtatacatgtgccgtgctggtgtgctgcacccattaactcatcatttagcattaggtatatctcctaaagctatccctcccccctccccccaccccacaacagtccccagagtgtgatgttccccttcctgtgtccatgtgttctcattgttcagttcccacctatgagtgagaatatgcagtgtttggttttttgttcttgcgatagtttactgagaatgatgatttccagcttcatccatgtccctacaaaggacctgagctcatcattttttatggctgcatactattccatggtgtatatgtgccacattttcttaatccagtctctcattgttggacatttgggttggttccaagtctttgctatggtgaatagtgtcgcaataaacatacgtgtgcatgtgtctttatagcagcatgatttatagtcctttgggtatatacccagtaatgggatggctgggtcaaatggtatttctagttctagatccctgaggaatcgccacactgacttcaacaatggttgaactagtttacagtcccaccaacagtgtaaaagtgttcctatttctccacatcctctccagcacctgttgtttcttgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatatccttcgcccactttttgatggggttgtttttttcttgtaaatttgtttgagttcattgtagattctggatattagccctttgtcagatgagtaggttgcgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggagtaaggaagggatccagtttcagctttctacatatggctagccagttttcgagaactgatttctttagcatttttatttatcaagcacttgatggtgtttattttgttctaatcttcctagaactttagaaattttatctaattctcacagtaactttgtgagtagtcctagaatttgagggaactgaggcacagagatgttaagtagtcttgccaaggtccctcagctaggaagtggcagagtccagatttgaacccaattagttttcctctagattcatgctttttaccaccttactctgttgcctctcaacatggacagtcatgtaaccttccttctatttgtaaagcatgaagtttctattatattatttcttattggaccccagaaagaatgcctgagtcagatggtaatattgacagtgaaaggtgaatcctttactgtgtaattggttaattttgtgcaaaaatcacttgttgtaaaacttgaatgaactatagtagtagtgtcatagtaagtggttacatagaatgtagctttagattaaaatgaagcatactgttggaatttgaatttttaaagctttgtaaaatttatggtaacaaatatctaacatattttataaatttatgatttttttttgagatggagtctcattcactctgtcacccaggctggagtgcagtggcaccatccttgcccactgcagcctccacctccccggatcaagtgattctcctgcctcagtctcccaaagtgctgggattaaaggtatgagtcacagcacccagctgggtatggagtttttgttagggataatgaaaaagttctggacatggatagtggtggtggttgcacaacactgtaaatgtactcaatgccacttaattgtacacttaaaatggtttaattgataaattttgttatgtatattttgccacaataaaaaaattttaaaagcaggttagaggtaaccaaggcaacaagataactttactatgacataagtggactgaaggcccagtttgcagaaactttttgttttatttttcatttaacttttattttgagttcaggggtacatgtgcaggtttgttacataggtaaacgttgttgggggggatacttgtttttaaaagaacaaagttgcaatgttaaatgtctttgtaagacagcagactgatgtaatatgtatataaattatatgctttaatgtaagaatgaatgaggtgttttttgtcattggaaaaacttgacattttcttcctgatgatttctatatgtcactggcatgcaaaataaaataatttggcctgcattgtgttataacaaattaaatgaaagagttgtgattgtcttgaggctattttataatctccttcactagactattagtttcttgacagtaggtgtcaagaaaacttaagtcatatatgtatccctattgcttgctatgtggttaaccctgatatcttttttgaatgaatgactgtggacaggatcagtgtggctatttttttttttaaatttttgagtgtcttcttgtttttgtttgtttttttttttcataactggattgcaatgtgggaattaaaagcagtgttttcaggccaggtacagtggctcacacctgtaatcccaatactttgggagtccaggagttcaagaccagcctgggcaacaaggcaaaaccatgtcacaaaaaaaaaaaaaaaaggtagtgttttcagtatagcactagaataagaaaaataggcaaggaactcaaagctataaattatgtgtatgggagcattgtatagatttatctttaagttaaatttcaaaaatattttcacacaatttaatcagtttttatagagcagacaattgttttatggataattgagtttaatatgtgaattgttatttttagtattggatataatattacatagtatatgttgggtccttcaagtgagccccagtgatgtcgtttgctccttactagaggccttgtttatcagatattgtggcaactattcagactgctttaatttgtgaactctaaatttccatgcattcactcaccatggatctctggatacctaatggacaggcaggtaagaaaaatttctttttatttccttccttccttccttccttccattgtcaccatttttatgcagtttccttgcatatttatctgtagttttaagagaaacttgtagttagaataacaaagtctccatgtttaatatgtgtaagaggtaaaaacatgtctctttagaggaagagaagcacatggggactgataattatgaagcactaagaggcaatttaaggactagaaatttggggtactatttttgactattttcttttccaataaggttattccaacagatatttcaaatggacactttagcttttattaatataaatttgtagatttgaaattttttcaaaattctctttgtgctactgtctaaactaaacaatataggaaaattataatagagcagaaacatcgcatataagcctaattttgacattggatatagaaatagaaggaagagaattgtgagtcattttattggccttatattaatattcagtgagccagatgcaatagaaacatggagaaaatatataaaaaagagaattccagccaggtgtggtggctcatgcctgtaatcccagcactttgggaggccaaggtgagtaaatcacttgagctcaggactttgagaccagcttggccaacatggggaaacctcatctctactaaaaatacaaaaattggctgggcatggtggtgcatgcctgtaatctcagctacttaaatggctgaggcagaagaatcactggaacctggaaggcagagattgcagtgagccaagatggtgccagcctgggtgacagagtaagtgagactccgtctcaaaagaaaaaaaagttcccttgggtatatggaatagttaatacctttttgagtgggcaaaatattttacttctaaattataaactaaaattttttaaaatcaggagatttgtgatagattaaatactataataaacacttaaaattaaatattagagtgccaggtaaattatttcattcttaaatccttaatatgtgttcaaagctctttagatttaattcaaaatataattcaatatgaaaaatttcaaaagatgataaaccactgcctttacataatatatcaagtgggcacataaataaatatatatatttatttcatatatttattttatataaatatatagatatattattttatatatttattctatataagtatatataaatatatatttattttatatattcgatgtaaatatatataaatatatgtattttatatatttattttatgtatatatatttattttatataaatatataaaaatatatttatatttatgtgtccacttgatatatatgtatatatgtatatatctatatatttcccccccaaaacaaaataaaaagcccagaataatcaggaaaaaataacatgaaacttaattgtgattctttaaagctattctaagcatacttgttttgcctcattaatgcatttattatgaaactttaaatatatgttaacaaatttagcttttcttttttagagcattgacttattttaattaaaatagtgcatatttattataaaaaatatgaagtaaggccaggcacagtggctcatgcctgtaattccagcactgtgggaggacaagatgggaggatctcttgagcccagaagtttgagaccaacctgggcaacatagtgagacccccatctctacaaaaaaatgaaaaaaattagtcaggtgcagtgaactcagttatttgtgaggctgagtgggaggattgcttgaacctgagaggttgaggctgcagtgagccatgattgcaccctgcactccagcctaggcaacagagcaaaattctgtttcaaaacaacccaaaaaaacaaaaaataagaacgtaatgctcgacgataatgacaatacaatgtcagcccaagccctgtgcccaattcaaaaatggtcacagggcttggcctgacatttcttcaaagaagatgtacaaatggccaatgagcacataagatgctcaacattattagtgctatggaaatgcaaatcaaaatcacaatgagacaccagctcatccatattcggatagctgttatttttttaaattggaaaattacaagtgctggttaggatgtggaaaaattggaatcctcgtaaaatgatgggaatgtaaaatggctcagctgctgtggaaaacagtttggcaattcttagtggtgatgttcacgcaacattttggatgtacttaactcaactgaactgtaaacttaaaaatggttaaaatggtaatttttattttatttgtattttactcactaagaaaccaacaacaatgaatcaactaataaagcaaattacaaagagatggacaatttttttaaatccacctttcctgaaataacctgtgttaacattgagtagtcatgctaataccttgttctgtgctttaaacttttgttgtggatatttcagaaattatctctatcaaacagtatagataataatatataagcaacacccatgaacactggatttgttgaacatgagctatgacccaagtgtgggcaggggctctgtgtgcctgcagcgcttaccagccttcgtgggattcacacctgcaacggtgatagaagatgatctaacctagccaacttaggcacgaaactaatgactaagtaaaaccagaaactaggaaaatccataggtcacatcattaaatgtgtctgtgataagcatcaccgctctctgcttaggttatttgctagtactcttttattttggtctaatcctaagtgttactataatggcttctcgacctttggctaagatcaagtgtttaggtgttattgtaaatgttttctttttgctctatttcaaatgtttctgcatataatactataaaagaatactggtaatatttgcttttgtgtataactaggatatatttttaaagaaaagatttaatgatatctaattgagtagactggtgtaaattaaagtgtagaaagtcaacgggtactttgttatattttgaattctgtcattacatttcttgtaatcttagactaaaacagcatcattaaaacagaaatagcagtcgactcttttgcagaatttacagtaaggcaaagttaatagaaagagctggaatatccagtaaaatgaccacaatgcaaatactattggtgtctctcttcccacctcctcagttttcaatatgtattttttaacaattatcaatgaaaaatgtataaattataaccttactttaccattcattagttgtgtgacaattaacctttctcagcctcaattttctcatctgtaaaatagacataatagtagggcctgcttcatagttttgttataaaagttaaatgagtttttatggaaaaaagtccttagaacagtgcttgcatataataagtccttgataaatatgagctacttttactattgttgctgttgtggtgatgatgatgatatacctactatgcattcaacccttggatgaatatgatgagcactagtagtacacttcctcatctccaagacatttatttggagataatacgcaggtgaggccttgaagcgagccttgaaatataagatttgcaaagtctggggggaagccctatcttttttgtgttaggcatcatagcatactctacaacctttctctgcatgcctcataattaaccctatcaggtaatatagacaggacttgctgaatcagggattcttacctaaatccaaagcctttcttatttccatgctctactgcatgtttaacaatgatcgcttgtattattctgtgtcttggccagttaggtacttctaaatttccattagtttatggtgaatagttttatttttactgattttttccctttaattttactgtctgcatatatactgaattgtatttttgctttttaatttaaattttcctgatttctgttctttcataatttaactcaggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatgtaagaattaaaaaaaactagttatatgtttttttgttttagatttttaaaaatgtgacagtttggatacagttgcaagcctgtaggcataaaattattagggggttaacacaatcttcaattatctgagctgcatgtaatcatattttcagggtattttgctttggtgctgataaccaccatttatctattattgataatataaggagaaaatagatttttttaggcagaattatacataaagcagtatttctatatatgagagttttaaacaaagctatcggatctgtcttagggaagtatgtagaccctaggcaaatagttgatctcagcagtccttatatgctggtgaaaccaagttaagggaaatagtgagagacagccttgaggcaaggggtagagaagcaaccaaaaagaggaagagaataagtatgtgtaatggaaggtttgataaatctttttttaccaagttataggcatgccaactctgttaagcactatctgaaattgccctgtttttttccccctcctatctggtaccactttctttttctatacaatgccagctatttggttttcacagtagttaaggaccacttgtaggtaggttttggactgttcattctattctgttagtttatcataacctagggatagagctttcttgacatatctttgggattaaattcctatttgtgtaacaaaaagacaagccaattgaaaaatcgacaaaggaattaaatagacatttctccaaagaatatataaaaatggccaagaagcatgtgaaaagatgctccacagcattagtcattaagaaatgcaaatcaaaaccacaatgaggtatcacttcataccttttagggtggccataataaaaaataaaaagaaaataacaagtgttggtgagggcatggagaaattggaactttcatacattgctggtaggaatgtaaaatgggggaaaccactgtgagaacactttggcaggtccgcagtcagtgaaacatttgttaccacgtgactcagcaattctattcctagctatatatccaaaagaattgaaaacagatgctccagcaaagcctgcacagaaatattcatagcagcagcatccacaatagccaaaaggtgaaagcaacctaatccaatcaacagatgaacgggtaaacaaaatgttgtgtatccatacaatggattattagtcataaaaggaataaagtactgataaatgctacaccatggatgacccataaaaacatatgctaagtgcaagaagccagacacaaaaggccacagattgtatggttccatttatatgaactatccagaatatgtaaatccatagagacagaagcagattagtggttgccaggggctggaaggagaagggaatgggaattgactgctttatttgtaagaagtttcttgttgggttgatgataatagtctagaactatatagtggtgatggttgtgcaacattgtgaatgcactaaatgccactaaattgtatactttaaaatggttaaaatggtaaatttcatgttatgtgtattttgccagaataaaaataaatcctaatggtgcagaaattttccttatatttatagatgagagagtcacttactaatgcttgttatagctctacaaggagtcacagaaattttatttttcttgtggatattccttctatcatcaaatactgttgggctttcttcctcttggactcttagctctttcttttgagagcagagtctgtattctggtatcccacgtagaagattttcagtagaagttttctaagttgaataaatgttaattagttgtagagagacaaaaaagcactacagcagaaaagtgaggaggcagtgaaaacacgaagcctttgcacaagcttctgtctccctcacctcccagcctttaagtcatttctcacaggagatttaatctcctctttatgaggtacaaagtcctgtggttttgctgggttttttttttttggcatttcttttaatgaggaatggaagagaagagtgttaggaatttgggggaagtgaaaattaggagaaagagggaatgagatcagaaagtgttagttataggcactggaattaatagtgactattgatacccataaatgttctgtaaatttgacaattctgcagtataaaaagtcaagttagctaaggtaatgaaaataaatgtatcaccattttttccccacatttgtaagaaaataatctatggaaacctacttcaaaactctattctaatatttagagtaaattagtagaaatttggttacttatataatttaagaaactaaagaaaatatgtcaaatcaaaaacatcagtactaatatagcatatttcttatattagcaacatatactgatttttaagatatactatgtttaagatgtacttgatgtgtttttttctcctgtaattttcattgtatcaatattatagtctaagtgaacagaatgctttcaaaacaggtgctgtagtcaactagtcacttttcattagtcactgtgaagaaatagaaacttagaatgtaaaataggggtttaattgggttttattaataacagaaagagttaggagaccatcactgtgtcattatgctaaccataaaaccatagtgagtgtcacagccacatatttcctatacatttaatttttttagcgatatgaagagaaacatgttagtcttgtgtttcagtttcatttactcattccttagtgagaaacaatgcatctataggaaatataaatatgaagcagtatttaaaatttacaaaatggtaagtaatttgcttttatcttaaaaaaaaagcatttctagagaaaataacttatatcccattgtttggctgatttatttgccaggaaaagttttaaaatgtgtcatgaatgttttgcctttatgtttatttgatgattgtaagcacattttagaacatggttgttacttcagaataatttaggacaccagaaagattagttgaggtcatgaaaggcctaccatgcttaaagactgagggcaagtaaaggaaatgaattagtcagttgacagtgagcttagttgcacatgctaacaatctaagagttcccaagggtcaaacaatacattttggtgtaatgcagatacataaaatctcgttattttatgaatttgtggaaagtatgtttataattttatacaatttccaaatgcaggcttcagggtaaaacatttgaaatacaatgtaaaacctaccttgttttcagttgagttactgaacagaagcaatgagggcacatcaaataatcaaaattattttgcaggatgtttttcatcttttatattcaaaagctgttgagctttatttatagtaatgttatttttatgtagttttggtctattttagattttggttttctaagtactcaattcattttgagttttgtctgtttgacccttgtagcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcaggtaatttaaaatatgcaggagcatattttaaaataggattattacaattcagatttattaggtaaatccagttttgcttagtaaaacataggtggggttttaatgatgtttctgtatgtgatgagaagtacgttttgaatgatggccaagttgtttggatcatatattcacaaaaaaaaaccctatatatttcagtctttatcttagcagaagggaaatttgaagaggtggagaaaaggagagaggggtggcagcgggtgggagagtaggcttgagtctcaaaggccttggtaaattggttcagttattaggttggtgcataagtggttttgccattaatggcaaaaaccccaattacttttgcattaacctaataaattattttagttagtcaccctcttggggtcatttggtcttcctgcccattcatgatagggagttccaaaccaaccaggagacatagcacgagtgagtgatgttgaggagatatggacataacttcctggaaaatattggtattcaactcatactgggcaggaagaagagaaggagcatgttctcctataaactgacagctcagtggggtcatcaagaggggacctgggcctcttgtgagaggattgtgttgactcacccaattggtaaaaagtacatgaggaacataattttccccgtcactttatagaagttgcttatgaacaaataacataagaagaaaatacagttttaaaataaacatatgtaaaaatgatcaactttgctagtaatcaacaaattctatacgaaaacatcaatgaagatctttttaacctgttatttgagtggggggtggtggcagaagagtaaagcagcaatatagccaggtgattaagagcactgtggcattagacagggtctgagtttagtttagatactaccatttagttgctgtgtgacctcggacatggcttataaaccttctgaaccttagcttcctcatctgtggaagaggatgactaatagtggttacatcagagatttgttgtgaggatgatgacacaatacatgtaaagcacttaggtcggtgctttgacatatggcaatactcagtaaatgtaacatattagtattaataatgaatgtcagagtggacgatatgacgtgtgcacattggtggaggaactacaaattgtataaactggtggagagcagtttgacaaaactattaaagtcattgccctaaaaaagcctgctttgagaattcatcctaaggaaagaattccacaggatggaaaagctatattcatgcaaatgttattatagcatgatttgtaaacccctcaaatatttgacagaaatttagtggataaattatggaacttaatgaaatctgaggcaacaaatttaaaaggtaattatgaacctacatggtaacatggaaaagtgattataatgttaaaaaagatataaaattgtatattacaattacaataatgtaaacataagtttttatgtggatataattacaaaaaaatcatgtttgtattcctaaggtggtaaaattaaggaattttttcttcatgttccagattttcagtgtgtgtctatgtctaaaatattagctgctgtgtagtgagtaattagtatatgcctggctctgtgctgtgtgcttcagacacattatctcattttgattgcagctacccttgggtgggcattactctccctgttaaatggagaaataaagtggactttagaaaggatatccaaaattatgttaatggtggaactggaatttgagtctaactgtctgactgtaaagcctttgttaactactataccatacagcttcactaaatacttcctgaaacagtattgaagaaaaacttcaaaacagaaacaggaagaggctttcctatggttatatttaatttggttcttaaaatggtgacattattacagacaaaatagaaataaaacagtataaaaggcaagttgaaaaagacaactcttgtcatgcttagaattattcagaattaaattacaaattattaaattattttcttaaatctagattttgattttccaaaaaggttcaccttaagactattgtttagtacatgttgattgacaaaactacagcagggttttcaatcaaaagctggttatcatgggaaactacatgagtatatttagtaagtttttttttaagtcagagggacacattacagattataacatgagtgttggaaaagagctttgagggacaactgtatagatactctctcaggcaggtgccccacagataacatttccatcccttcattttgttgagtctggggcaaaatgattatagttcataaacaggatctgtcttaggggttccattccaaattcttggtataatctggctcccacatggaatttccactgtaatttcaatatttcacagtagttaggggcctgggacccagaagctcccagaagagattattgcatagatttctcagaaggaaagggaattgttacctagtaaaccataaaagttatcactcacatccatatcaatgaaaatggaggatttacctccaaataacctgatttctttttttttgagatggagtcttgctctgtcgcccaggctggagtgcagtggtgcaatctcagctcgctgcaacctccacctcccgggttcaagtgattctcctgcttcagcttcctaaatagctgggattacaggcacaccccaccatgcccagctaatttttgtatttttagtagagacggggtttcaccatgttggtcaggctggtctcgaactcctcaccttgtaatccgcccgcctcggcctcccaaagtgctggattacaggcgtgagctactgcgtccggcttttgtttgtttgttttgtttgttttttgaaaataacctgatttcttaatgatttcctaaaagcaaaatatattgagattaatgaatattagtgaaaaactgtttggttagacagtttaagaaatataaatcttaaattgagatgcaaaagaaataatatatacttttaagggcaatagaaggaaaaagttctgtgtacaggaaacaaaattaaaataagcatagagagaagccgatgggcattacctgacttttccttgtttgaaaaatacaacttctaaaacttatttctatgtaaagattttaaagcattttacagacagccaaagggaacttggggctgacaaccagaaatggtggggttttttttttccaactgtgtacaaatcatatcattaagttttatgattgaatcaccagttattgaatacacatggtaatgtttacctctgactttgcagataaataagtgatttctttctagtttttcctgctccttagtgacagctgaggtagaattcttctcagataggctttcgtttttcttactttttgtaaccctttcccactctgcagaattcttcttttgtttcctcatttacacaacttttttttagtctgttgttataattgttctcttttattattagctattgttgttaatctcttaccatgcccgctttataaattaaactttaaaaagtttgtataaatttaaggggcacaagtgcagttttgtacatggatatatagttattctattaacatatttatttattcaaccaatatgaaatctgtcactgtttccaaggaatagtcttgcttttggaaagggtgcctggagagcctgtgccagctggaagcatgatgggcaaggtaggagggatggtgggattccccagccgccgggcttcctcagctgatggctcagccactgggaggtgggtgagggaggccgctgcaggaggctccaggccctcctcccctggtccccagcagcctccctcaggccttgtgactgaagtcctgtggctctgtggagggtgcttccaatgaatggccgtctgtggagacagtggccgcaatgagagcacttgggactgaggtgggagcagcagcctggctgcaagtgtgcggaagtgttttgtgtgaatagtcttccacatttgggctcaaaaatgagttttaagtgtttattttgggagctttagctaaaaaaaaaaaaaaaagtgtttctttgtggtaaactttggcttatctcaagcctggcaaagaggaatacatttgattagacattctacaacttttaaattattgatatagttgtcacatagatgagcagactgaagtagagaggttaaaggatttattctggttacacagcaatttacggtggaactgcttggcaactgctcaacacttccagagattcttgcattttacactgtgagggaggaatgtgtacaagatctcatcattcttttttagctccttgtaatatctgaaagtcttgccagatacctctgtttctaatctccgttggccgctttccacccggttgactcttctttctcttgtggacctgatttctgtccagctctgtggcagttgggagatgagcttgctgcgccagagatgagcagcgcttgcagggtctggctgatgtggacgtgacggaaacattgagtccattgtatcctctttactagatagataatgtaagcaaggtctcaagatgagctggcagcccgattgttttctatcttgtattgaatgatgaaatgataaaatgaaaagtttaaaattcagaattcttttgaatattcttcttatgccacccatgtacaaatatcaatagcttaaatagtgcagaacaggcttaggaagcagtaattaattaaaaaatctcacctacttatttatggtgagaacacaaaatatagtcttagcaattttcaaagtaattaactttttaaaaacccaaatattaatgacaaatatcagagataagagctaaggactttgaatggtttttcttagagggggaatggatggggagaagggactacaacctggtaattaaaaattattttaaaggccctgcagacagccgtctttactgacgcctatagatttcggttggttccagtaacatcttttgcttctttatctttcttttcatacctttttttctattgtagggggttgaggaacacaaacatagaggcaaatgaggtatgtgggataacatatattatatatttcatttattttgaccctagcacttattttcacaaatatctttgtattttttaggtgctagtgaaaaaaatataaagtgaaaataaatatccctctatgttttttgggcatagaggccaaatgtgctaaacaaaacaacattttaattaattataaccttgttttacttggtagttacctaattggttggttatttttagggttcactttgtgtgctggtaaaaaatgttgtgattcttttgtgtttttatttcttgtaacatttttagttgggaactcttggctaataaaatcttctaattttttttaacttagaatctagagcaacagaatgtaatatataagctcagattcctaagttactcatgcctctgactttttatatgaggctagcaattcatttatttaacaatgtcatcatcatggtaatcatcaaaatgtacttgaggcatttatgtctgtgttcccatatctttcccactatatgaagtacaataaattgactaagacctcgtgtgtgggactttataatctaaggcagaaaaattaatacagatgagcatgcaggtcatctagacagctaggcaaacactgacacaatgtacaatactgtattaaaagcatatataatgcattgagtgactatacattagagtaaatgaaagatgaattataactgggcagagtggcacgtgcctgtaatcctagtactttgggaggctgaggtgggaggatcacttgagcccaggaattcaagactagtctgtgaaacatagtgaaaccctgtatgtaaaaaaaaaaaaaaaaaaaaaaaattcaccagatgttgtggtgtgcacctgtggtctcaactatttgggaggctgaagtgggaggatcacttgagcccaggaggttgaggctgcagtgagctatgattgtgccactgaactccagcctgggcaacagagtgagaccctgtctcaaaaaaaaaaaagatgaattttgagttaccttttttgtacagtggcaaaaaagaggaatctttactttctcaagaactttgttacatccagataacaactgaacagtccttggcgtagaaataacaggaggaagtgatacatgcagtagtaagaggaaggaaagtgctttgtcccacaaaatacctgctctacttgataacgcctacaattcttttagtttaaatctttgtttttggctttatgcaaatacctgtgggagaaatgtgattaagtgtatgtgtgctaaatggataaagagaaggatattttgtgtactggtggtttggaaataaaccaagtttgaacaatgcaccatgacatgtttctctattgtttcttgaacttagtttgttttccagtcactggcgtataaatctgcctaatacctttttgatattggggggaggagcccacttttatttacatttgaatttctagaaatacatgaagcaaaatatacttgactgaaatttgaaagtgctccaattgagcatttcacaaacatctacaagagagtttgctattagaagctcaggagttggttagcataagaattgtaccttgagataagacatgttcatcatcttgttttcccatagatttttaaatccacagtctacaggaaaataggagctgtattctcatcatgttagctgactgattttgcacagttaatttttggagcttggtttgctcttatcagggttttagatgaatgaactagtttgctctaaaagtgtggaataagttaattgcctcaaaggattttctttttttttttttttttgagatggagttttgctctcgttgcccatgttggagtgcaatggtgtgatctcggcaacttccccctcccaggttcaagcgattctcctgcctcagactcccaagtagctgcgattacaggcgcctgccaccatgcctggctaatttttgtatttttagtagacatggggtttcaccgtgttgaccaggctcgtctcaaactcctgaccttgtcatcctcccgccttggcctcccaaagtgctgggactacaggtgtgagccattgtgcccggccacctcaaaggatttttgaagataggacctctagcgtttttggtgtcactgtgctataactagccacagaccatttctctgtatcccttttgatctcacactacagtgttcgcagtatggtagcctctattcacatgagacttttgcacacttgaactgaggctagtgcacattgaggagctacattttttattttattgccatttaattaatgtaaatttaaaaattgatactcaacttagttatttaaaaatttgtaggtataattggagcaacttgggtatgtgactctaccttttcaactgtaaactttttgaaatctaaatacttattgagcatttttgatgaaaatttagtggctgaattgagaaatgctgtaagtgcaaaatacacactagattccaaggcttagtgtgaaaaaatgtaaaatatctcactaaatgtttaaaatattgattgcatgttgaaattatatttgagatatattgtgttaaagcatattaaaattattttcacctatttctttttacttttaaagtgtggctaatttcgagttttaaattacattatgtagataatatttctattgggtagcacataaaattactgtgtctgtgctttgtagatatttgttaaaaggcaatgtgctagtaattctgtggtcttaaaaagacatgtgttatttttgtttatacatacgtgtatacaaacatacatgtataccagtatacatacatgcatgtgcgtatacttgtggacatgtgtgtgtgtgtgtgtgtatgacctgtagtagccagcctcccacatcgtgtgtcctggttttcagacccttgtttagtcttctcctgtcttataccagggctggtctgtgtggccagcagaagtcatggtatgtcacttcctgagaacaagttataaaagataagaggccaggcacagtgtcttatgcctatagtcccagcactttgggaggccaaggtgggaggattgcttaaggccgggagttcaagactagcctgggcaacatagcgagatctcatctcttaaaaaaaaaaattagctgagtatagtggtgtacagctacttgggaggatgaggagggtcacttgagcaggagtttccggctgcagtaagctatgatggcgccactgcactctggcctgggtgacagagtgagatcctgcctctggagaaaaaaaaaaaaatcagtgcttctgtcttgggcactctgtctttcttgggccacttgctctaggggaagctgttacgtggacacttaggtggcctatggaaaggttcacatggtgaagaactgaggtttccagcagccagcaaggaatggaggcttcccagcaatgacgagattgagctggaagcagatcctccccaaggtgggccttcaggcgactgccccagctgacaactggacagcaactttgtaattctgagccacaaccacctagctaagctgctcctgagttcttgacccgcagaaactctgaaataataagtgatgttgttttaagctgctcagtttgggattgtgtgttacatgacaatagataactaatatgtaatctgaatgcaaaagaggttcattatactgtataatagcaaacaaccaaaccaaaccaaaccaaaaattaattaaatgtcctcaagtgggaaactggttaagtaaatgatggcatatttgctcagtgggatattaggcaactgttaaaaatgttgggttagctgaatcctcaggaataaaagtagccagtggaaacccatgagggtgtgagaaccactcaggggagtcacagcaagcactgctgaccagggaccacgtttataaaaacatgacatctacatattaccctcccaatgttttatttttatttcctctttctgttttctctcctttacctgttctagagaatcccatcagggtacctgtggccttttgctgtctagccttctccatcagattgtgctccttgaagacagggacttcttacctagcactgggctggagcaaggagtgaatacctttgaagtttgaataataacatgcattttccatggtttttaaaactgtttctattatttattttaaaaattatttttgtatattaattaaaaaattgttatgtatttacggggtacaagtacagatctttttttcttttcttttcttttttttttttttttttttctttttgagacagagtctgactctgtcacccagactggagtgcagcggtgcaatctcagctctctgcaacctccgcctcctgggttcaaacgattcacccacctcagcctctcgagtagctgggattgcaggtgcatgccaccacgcctggctaatttttgtatttttagtagagacggggtttcactatgttggccaggttagtcttgaactcctgaccttaggtgatctgcccacttcggcctccctaagttctgggattacaggcgtgagccagtgcgtctggccatgagtacagatttcttacatgcatacattgcatagtggtgaagtctgggcaggttttttttttttttttttaagcaaaatgcaaagttataggtagagtgaaaccacaactatggttgcaaatgctatataaagcaggtggaaaacaaatgaaacaacttctagattcaaaaagcattactttgtaaagatgtaattccatttattttagctattttcttctttaccgggacactccagaccctctctgtagttttgcgttactcgattcagcttggtctcagctgttaaaggtctaatgctaaattagtggtggggatgggagctaaaatgacttcaaatttcctcagcctattgttgttcaaggctataaccaagtgtttttgttttgttttttttctcactttccttttgtctggtctccacttcttgactttttcttaccatgttttgaagctgctttttacttgagtcctgtgagagctgccttccctcccagctgattgtaatttcttactaaagccctgttaactccagatcaatggcttatttgactcacttgactttttaaaggagccagaattatttcgcctttaaagcaaatgtatgtatgtatgttaacccttaagctctcaaacactcaacccatgtgttagggttaaactaatggctctgacgattgggtggaggcaagaaagatagaaatgatgagagtaggaaaaatgacatttgtgtgtgtgtgagaaataaaaatcactcgagacttttacatagtaatatgcaaattccccctttatgcttttctcacttccacctgcaattggagatgtcaatctctcagctgagaatgatagctctagtgagtcactgttgcctatggagggatgttgtcttgcagatgtgttggtgtagaacaaagctttttgtggtagcagcctccatgatgcctgcctcctcttattcacatccttgtgtagtcccctcccccgttgcaccaatgcactatagcagaggcaatgctatgccacgtccaggcttagattataaaagactgaaatgtcttttataatcttgagtcttctcttttgaatcacttgggtcctctcttttgaatcactcactttggaggaagcctcatcatgagcagcctatgtagaggcccatagggcacagaactaaagattccctttaaccctcccacgagtgtgcctggacacatatcctcaattgactacagccccagttgacttcttgattgtagcctagtgataggtcttgagcctgaacctggcaggtaagccactcctagattcttgacctacagaaactatgagataataaatgtttgctgttttaagctgctaaatttggtgtgatgttacatagcagtagataactaaaccagttgtaaacagctgggttagaccaaaacctaaagagatttttctttgagacagggtgttgctctgttgcctaggctgagtacagtggcatgatcacacctcactgtagccttgacctcctgggctcaagcaatcctcccacttcagcctcccgagtagctgagactacaggcacgtgccaccatgtccagctaagttttgattttttttggagacagggtctctctctgtttcccatgctggtcttgaacccctggatgcaagcagtcctcccaccttggcctcccaaagtgctgggactaccggagtgaggcactgcgcctggccaacagatttcttttactttggaagtgctattaccaaaatcatgctggagttaccagtaagtaaccagctttggtaattgcagcaacatatttgttattataatttcacccaatcatgaaaaatttggttgaatgggatgaggaattattattaacataacattaatatcatataagtggcagccaattttaaatgtaggttttgtttgtttgtttgtttgtttgttttgagacagggtcttgctcttttgcccaggctgaagtgaagcaacgtgatcttggctcacagaaacttctgcctcctgggttcaaggggtcctcccacctcagcctcccgagtagctacaggtgcttgccaccatgcctggctaatttttgtgttttttttgttttttgtagagacggggttttgccctgttgtccaagctggttttgaactcctggcttcaagcaatctgcctgcctcaggctcccaaagtgctaggattacaggcatgagccactgtacccaggcaaaatgtagatttttttttttagacctgctttatttcaaaaagcttttgaagtgatacagctgtatatttttatggcaaaaaccagcccatcttcaaactgataaatagggccacctaactgcaaagaaatgattaatttataactttgttgtattttttaatgaaacaaaatataactttggtagggcttagagatagttaaaagcagtgtttgaaaaaaaattaaaaagcaataaagtttaaagagattaagttccagaggagttttttttaattagtgtgctggatacatatttttttcttttttctttttggagaacctcttcattttgaattctttttatgagtcctcatgatcacttgtttgctcaaattcttctgtctcacatctccactatgagctgaaagattattcgagtatcatatgtttagagtaatcctttcttaagagtcaatttttaggtttttattaatttcttagaattctctgaattttcttacgtaaccacaatagtggttcttcctctgtgaccccaaacatgacttcaaaaattaaaagtagaaagaacatcacctttccatacccagaaagccccccacaggctgttttagagggtgtaagatttaagcctatggttgtaaaatggggtggttcaggccgtagcaggcccacagaggggtgtgttttatttggccagcactatgttgtctcacacagtgttcttaaaaaaaaaaaattgccaacacttaaaaaccagataatttcacattaaaaaaaaaaagtcctgacaacagtaggcctatattcctacatagcaacactgggctgaaattaagaaactgctgccccttgtagatggtccctaggcttttgcacttcactactgctctcccactccccgaccttttttttttttttttaaatgtcctctggcttcatttattttagttactttcccgggccctgtgggcatttgcattgaccacttctgatctaaacagacaactagccgtgacataattgagagaggttgcagtcactggggcactattaaagcaagattacttttgtcttatttacctagtaacaaccatacttatactatgctaaggggcattcctgtctgctctcttcccttccagtcaacatagagttatttctaatgttccactcatgcagctttagatagtactaatcttatgaatgttgttgatcttaaaagtcctccttttaatttacgttctctttttgttttaaacttaaacctaaagtcatactgaggtttttgattattctaagttgaagattttgatccacttaaattgcaacacttctcatgcctgttactgacagatcactgcaagcttagcccttcgttaggaaaaaaccaaacaaaccaaaaacccagattccaagaacagcacagaatgaaattcttaagaaaatgcaactgtgtgagaagcaaagtcttgtcaccccaagtttttacggatcaaaaaattgtatgcacataccctcataaatgttgttggaaagaattatggaaaaactgagagaggcagagaagtgtgaaaagattacgcttccccctcgcttgtcacagtaccacagaggaggctgcctcagtttcttcactcaaaatgagctactcctaagccacataaaactagttattcctttactaaaaaacaactgatcatcagatttggcgactgtacatttttatctacatatatgcaataaacagctttaattattattcatgaataaggaaggtgctattggatagtttcctctgacagtttgcagtcaaaaaaaaggttaaagataaataacccctaatgtttaaaaaatgtaatattttaactttaataagggtctgaattaaggcagcagggtaagtgtgaaaaagtaaatgaatattatttctagtatatattattaattctttgaagaagaatgatacactcctttcatataatttattttaaaaatagtgatagaggcaggatgaagtagcctgttggatgtgtagtatgtatgatgtgcattatttaggtgtgccttattaaagaagacatatattccaccatcttttaaaataagaaactttctgctatattaaaaattaagctaaaaattttacatttgtttatttctttgtaacaataatgttagtacagttaggcccagcagtagctatatgtatgggcaagagacatgcttatatttacttttttaaaactcatattgaagaaaatttggcaaacagagaaaaaagataccacccatagtaccatcaacccagtataaatgctgttagcatgttgatataacatgtagccttttctctttgcatttttagacataggtataaccagtttttaatcttgtttgttatgtaacagtataggatatgtcacatattattgtgtaatggaagatatattataaaaattttttgaagatttacttaaaatttgaaatgaggcaatgatattttcagggactgaagataaatttcttggctcactgctttttttggtcaaccttttttgagcatctaagttggtacatatcaatctttgatttcataatgtgataattggacatctaaaaactcatttccatgtttgagtttaaaatgaacttcatgagatttctcctatgggaagtgatctttaggtgtgcagagttttgtatgtgttttggttgctgctggtttttttcgagtagaaaatacagaaaaacctgggcgcagtggctcacacctgtaatcccagcactttaggaggctgaggtgggtggatcatgaggtcaggagttcaagaccagcctggccaagatggtgaaaccctgtctccactaaaaatacaaaaaattagctgggcgtggtggcagttgcctgtaatcccagctactcgagaggctgaggcagagaattgcttgaacccaggaggcagaggttgcagtgagccaagatcacaccactgcactccagcctgggcaacagagcaagactccatctcaaaaaaaaagaaagaaagaaaatacagaaagaaagaagaaaagaggagaaggaaggaaggttggaagcacttcctgaaatgatacttctgtatacattttccctgaacactccacagacctgattcctggctctgctctgtacttgtagtggcctgttcatgtattcactctgagcagggttttctagaacagaacaatgtttttattccctttccccaagatctagccaagtgtgcagcacatagtaagcacttaatgaacattcagtgagtgaaagaggagagaaaaccatgtacagacaccaagcataagagaggaaggaattatatcaggatgtttttagctgtaagttgtagcatgtaaactacaagtggctcaagcaatagggacattttttaaattcacatgacacaaagttcagagtaagggcagttccaaagctggttttgcagctgaacaatgtcatggagtacccagatgtttttcatttttgtactcagccatcctcagcatattggtgatttcttccattatagttgcaagatggatgtaggagttccagatgctatttgcagacatgaccatgtccaacaaagaagaggtggtattttctgctgtgtatctcagtttattacagagctttcacagttgcttccagctgacttctgcttaggtctaggattggctcacaagcctatgccctagctgacgatggctatcgggtagacaccaacagtggctggcatagaaacaatagaggaaacaataatgggaaaaagagtagtgataggtcagaatgaaatagcctgttggatgtgtaatatgtagagtctacattatttaggcctattgtattcttatctgtatatacattcactatctgatatttaatattaacatatgtttgaagctaggagaacaatacttctaagtaaaaagtgtgctactcaagagcagtagaaccatatacatttggggatgtaaactatatgaaattgcaagtacaaaattgctaggcccactttaggtccttggaaacttctttagcttcatggcaaatctttttccactgccatccccggccttccccacatttaacattgctactctggagagaatagaaaacttgggcaacaagttagaagaacagaatttgctttctttttaacattatgttattctaaggaagaaggacattgcactcaagaattactcaaggaacaggtcaaatgaatgggaattataaagatagataatagatgtttttttaaaaagcatcttgagtttttgttaatagtacttttaaaccgttgtagtttgctacatattctttactcgtagaaactggatataaaagtgaaaatacatcaaaacaaaatattcagcccactagatatatatattccaggtgtgcttaaatagggacatatgaattattactatatgacacttgtataatttggatagagtcgaattcttaagcagaatgttaattatcagaaaatgagtattttatttagaaattatatgtaatataacattttatatttttttcccatttcctttggatgggtgtgggggtgtggtgggggaagagaaacagtgaccacctgtgtcacctgctgtcttcatggtcttcagtctattgcagtagcatcccagaggctgtttctgaggaacctgttgtattgctagattgatactgcagtctgttggctattgtcttctattttaaaaacagagcaaaacaaaatatattcctgtcatctgcctctcgttcttgagattacataagaacttcccatagtatactagcttttacaccaaattttaaaaattgaaacatacctttgccaacgaatgtagtggtaatttgcagaagtgtgtcattggcgccgagctgaatgagcctgtcacttaatagccttccattaatacttgtttaatggaagaatgaatgaactgtttatacaatattgggacttctaagataattatgataatttaaggaaagcaaatattggacactaacctgtatttgctaacattttcttttagaggttgtgatattaccaatactttgaaaaatcaaacactgtattatcttcaaattaaagactttaagtgatatgctaaatagagctcttagcttgacagttaagacatttatatataactaaggcactacacatctgggaaaataagaacatattttgaaaggaagagattccagaaatgggtgtctgtgattcagtaagaggggccgtgaatacaatgtgagtagaatctgtaactgtgtgtggtgctttatgcttctcaaaaggcagttttttcatgatattatatgggtctgcttgcctgtctcccattatctgtaatttaaagtgtgctatttttgtagctgttattcttggacatacaagtaaatcaacatgtatgttcaaaagatatgtacttgatttctgacaagagtaagataaatttattcttgtatctaaacattagcatttatatacaaaagtttattgattagtagtaggtctcatttttgaaagtatttttatatgtacaatgaaaaggcagctttctattttgtatgaaatttttaaaaaatcttttaaaagtactacaagataaaaggaatttaaaaattgacattattggcacaagattgatgttaatgtttactcacgtaaatagcacaaaatactgcctaattagtgtggttggtaaatttttggtacttaaattttctctgttattgtaaaccatgcataaaatgcttgtctattgagaagtgcagaattgtcagagcttaaacagctgacatctgcttactctcttaaaaaaaaaaaaaagaataacaagccatttcagcctaatctacctcaaatgtgttcatgtaaatggaggtccatctattgacctgtattcttttcagctcaggattggtccacatggtttatgaaaccaggaagcctgatttgaaatgcagatgttgagagagtgaagtacaccctccccttttttctttgctgtatctgtcagggtgaaaaatggcttgcacaagggtcagtcacccatactcacttaattacttttcttggacccacagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaaggtatttcaaaataaggttgaaaaatacatcagccttcttataatgtaagaaaatggaaatgtgtacacgtgaatattttgcatctaaaaataattagcaaattatcattgaaaacagatatgaatatattatgtatttggtctcttaatatgtgaaaataatactgtaaggattagataaagatgtgattggggaaactatgtacaagatcagaagtaacaacagtgttaacattaataattaaaatacagaatcacataataattaaatcctggtttggaaaagacctaaagatttttgaacccaccactataatattgtttcttatggaaattgcaatatttatcttagccttttttatagctttctaaaatctgatttttagttaatagtcaccaattatacttttatattctaatagttatatcctataatgttttaaaattgttaacattaactaagcaatggaacattctttgaaatggtatcagcatcatgtcaaagatattgttctgcttgatgatttttgtactaaatgatcacctgtctcataaattagcaatttcagtgttgcataattaagaagtggtattcatccagaggtcatgttatttaatcatctgtaatagatagagtttcaaaatattgagaactaatttggaaattaggaatttttagaacttgggtataagacttgaatgtgaatgtctcaagactcagaaatcttaggctgtttaggcatgtacatttttttccttttataaaggaatttgaatatatataaaactgtttacattacatctgaactctgtagtggatgctatatagtgttttgttgttgttgttttttttttgcttcacagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgaggtgaaaagaaacttcaaggcacaataatatgtagtagttagttttagtttttaaataaaacatcaatttgtttatagggcctaggggttgtggcacatgatctagttgagtcaggatttctcgtcttctactgatgttttggactgggtagttctttgttgtggggagctggtcctgcacattgtaggacggatgtttagcaggatccctaacctctgcccactagatgccaaaagcacccttctcccgcaagtggtgacaatcaaaaatgtctccatactttgccatgtgttcctcagggagcaaaactgcctccagttgagaacactgggttatattagcagagtttgagcttgaaatctgtttctagtcatttccaactttccatttgtagattgtgaggacaatggaactttgccatccttacaattttatgtcagctgggagtagtgagaacactattatagctccaggttgggagaaatcacaaaggtcccctggcctactgtgaccactccagtagctgctcttacatggtgatttcccgccctgagttcctagatgggaaagaaatagagagaaagcaagcctgtgttgattctgaagtatcttttttctgtgtatattttgactaatcaatttttatttcattaaactttaagtcctcattgtttatttcatctaacatctttatttgcttgagatttttcaaaattaaagtgcactcagctagtaatcattactagcaaagggggaataattaggttagaatatttcaagtccgacattgtctttcaccattcagtgattaatctgcttcatactcacccattgtgatgggggggtttcagtagttagttatgaaccagccctaggcttagagtctacatgaggaattttgacatccattataatagggataaaagttgtgccatcgatgcatgaaaaattgaaccacagagtaaagctcctcacagtttgtgcatttgaactagcaggtttattgtacttgtatatttctttaataaatataataatttcactaaatgataattcaatttcaccagttgtttttaggttctaaatagagtgtggcaatattaaactgtatttaaagaccatcatagggtcctggtgatctaactcttgttcccatcgcttagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaaggtttgttcttgcttcgttttcttccagttgcagtaagaaattctaagacagaaccacagattaatgttctccaacagaatacaaaatataactgactggagcaaaaaaattacctgaaaaaaattttgattgtttcaatgcttattagcaagttttattagcaaggtaatgggaagtttaaagttttactcagcgtttctcatcaacaggatatcaactattttgagcattagtattatctgtatttaaatattaagtttatttgtatcttgaaggattaattgtacatatctacaaacatgtaaagcttaccttggttagaaacacctatttgtaaatgacatgcccagtagtcattttcagtattctgggaggtctatatacccctccatttcctgccacttcagtgggagatgacaatggctaggacatccctttttatccactttctcttcttcagcttttattaactatttctcttcttagatttaggcaattcagagcacatgtcagtgtttttgtttccttgctctagggcttttgctttatctcagttcacaattttgtaagaacccctcatctagtgcagccctggcacatagtaggtgcttacgaaatgtgtgctaatgaataaatattgatctctggacgaatgcttcaaagcctgtgtgcttacagtgtgtgcggtgaccctctggggtgtgggtttcttatcagcatagaaaacctgctgctgtatgttaaacagaaatgtggattttttttatcccttactaatcctcagaataaaaaggagcctcagatctttattttctacctatttcttgataattctttgctttactcccttttatcctgctcttttccttttgttcttctactaccacagactgtgatagtgactagagcaatagtggtgctttctgaagggtcacggtaaggatgttactaggtttttgatccttggttcttttgtggatagtcatgaagcttatgcatgggaagaatgatgaaagaagaagcaattgccgttgcttcccatatgccttcctgaaattaaccagggagctctccccttctttggtctaaggttgctgctggcctttcccacttggtttgtttttcagatagagatcaaggtgttgcttgctgaaactccagcagtttcgggcaagccacatagtatggtagcactctctgcttttcctgtgtggtactataaagactaacaataatactttacatttaaatagtaattttaaagcaaatttgcattccttatcttatttgttattcattataattgaggccaacaagtcagagcttcagggatggagtagaggcactgtctccttttcctcctgtttcttcagtcttgttacatcctggacatgtgggctttctggaaagttgcttcattctgaagacaggtctgacctttaatattggcagacatacatttttagttgtaggaaagaagccaatgaagaaatatagctgacctcttcaggaaattggtcttaataaccaaattaaaaagcaaagaataaaagtatatatgatgattctggcctttgctgtggtagcataaccatgtgatctttttttgtggtaccaaatttaaggtgattaccataatctcaaattagtcagaaaattacacctgtacagaatttggaattagaatttgattttttaaaattgttccttgggtatacaaaatgtaatgtatttgaggctctttagtttattctgtttttattgtttagataaaattgaagcataagatgcaaaatgtaagcatgtgctgtgtaacaaaagtagtcgttgttttgacattcagtcatgttaaagtggaaagaactataatttaaaagttgaccataattgatggaaagttatttatgtactgtttcaggaaaggtgttagtgaatatattccgctgacaaggtacttaggattcttactgatttattttattctcaggcttattatatcaggtttattatatttggtgaaaagacaatttctttaaagattctaaactttttaacaaaggaaaataaatgattttaaaattctaaacatttttatttagtcacagtaaaatctggctttgcctatttcctagtctgtgacatctgttgtctggttaaatacctctctatttggggggtaaaagctagtagagaaattcttggtttagttgaatcgttaccgataattaaggtaatttagttctagtcatgttattgacttaagaaatgacagcccctgtgatgtgctcatttattgaaccatttaagaaaaaaaggatcaaggccgaagtgatttcttctcatgtttgagagacatggaagactctttaatcctgctctagattcataacacttgctcttttgatccacgctgcagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaagtaagtgcttaattctgttttatgaagattttggctcatttaaaaaatatgtcatttcaaatctctttgttttcatcatggacaatattgttttatgagtcaagaaatacaaatttatcagaactgacttcactcttctttgaaaatgagttaccctgtctctaaaaatcagtgatatattttagagaaaattctctatgggtgcaaagttgtttgtaaaatgaatggttaatgcagtctacattcctgttgactcttcttatgtagtgggaattgaagaataatagaattttttagtttgaatttgctggagagacctctagttcattttacatttaaaagtgaaatccaaaagaatttaaggtacctttcaaatgtatcatataactagtcagagggcatttttgaacccataatttacctctttaattccaaggtcacctgaccttttaattatatgtcttatatttgtttctttaaaaaattgtctataagactcactaaattaaatatttttaaatcatgcatttttaaaaggcagattttctgaaatattactagctactaaaatgcttcacaaaacatgaatatgaagaaggatggattatttaatgattttataatttaaaaaaaaagaaataaaatgttttccagcatagttcctattaggaaaacttgtaagtttttgaaagcagcttgtaaaattgacttggtttgagggaagttcacagaacagacaataatttaacagtaaattaaattacatttaaattttaattaaaacagtaaacaaataggaaaacaatttggtgaaacttaactttagatggcataatgagatgggaagttttcttgaagtatacacttaagggactctgaaagttatgtatagtgaattatctatttgacttgtaaattttataaaagtaaatttatgtatatttggtcatgtttgcatattatttctctactaatgcattgagagaaattggtttctaagatttaactttttttttcagtttttataaggctttctagaccaacaattatttaatagatttagaacttccctcatatgtctctcacatgtgcattctttggcaatgcttggtaaagagagaaagattaacaatgtaaggtcttttctagtttagcaggtctctttaactttctggtgagaaaccaaaactctattcctagctttaagttgtccaagcacagctgatatacatgtatacgtgtatataattgtaacctatatctgtagtcctcttttggcttcgtatttctttaacccattatcattgttgtttttctcctcctcctttccttctcctcttccaccctctcctgccaccctcctgagtttcctcttaagttttggaaataaagtaaagggatgtatgagctagagcataaatcattaatagtggactcaatagtaatttcagcttgagaagcccttgcaaatagtcccttaggtaagagtatgtactttttatatactactaccttatatatcttgccttttaataaattattatgatattatgttgtatacatatcactggagaaaaataaatttgaaaacttcactttttgaagtaagataaatttcattgtgtttaacaagtggtgtttttaggttaactaatagaaattaacttccttctgcctatatttagtacagtgttactttcaggaaatacactgagtagtaagtgaaaaagtgggatctttaccaatcattattccatcaacaatcttttaaaggcttcgagcccatccaaatattttattattgtagggatttgatcattcttttttctttccccacggtctcgtgaattctctcagttgttattttaaagggtgtagaataaaagtccattcaagcctgttcgatttgacaccatctcagtagggaaaagtgtatccaagagtgtcaagaactgtctaatggtatttctcatttgttactctatggcaggtttcaaattataagcccatgttgaagttcattttgtcccaaaggcatgtcagcttctgtaagcattctctaattggtttccatgcaggagaacgaatgagcaatcttttggaatttctctcatgttttctttggagaaatatctattgagaccctttgctcattttaaattgggttacttatctttttattattgaattgtaagagttctttgtatattctgggtacaagttcttatgaaatgtatgatttgtaaatactttctcacattctatagattttcttactatttgctcccatgttattccaaatctcttaataaaaatggaaaagaagtttttttctaataagcttatctacatgttttgaaaatattcaggcagttatacctttatttgtttggatttagaggcatcatattgaaatgtttcatcttactttggcatttgaatcagctcattctagttataaaactatgtttaagataattatttaattattgtgttcttacggtaatagttgttcccccttcattttttagcagctttattgagctatagttcacatgccatacctttatccatttaaagtgtaccattgaatggttttgggtatgtttacagaattatgaaaccatcaccactatctaattttagaatatttttattccccataaaagaaatgctacccattagctgtgattctgtatcccctctgcctagccccaggcaaccattaatttactttctgtctctatggatttgtctcttttggacatttcatttaaatggagtcatacaacatatataacctttttagagatagggtttctttctgttgcagactggagtgcagtggcataatcaactcattgaagccttgaactcctgggcccaagtgatcctcctgccttagcctcccaagtagctaagactacaagtgtgtactgccacatctggctaattaattttttctttttttggagagacagggtctcactgtgttgcccaggctggtcttgaactcctggcctcaagcagtcccccaccttgacctcccaaagcactgggataagaggtgtgagccaccacacctagccatgtgcctgccttctttactacttacttgaagtttcacagttcgtccatgttgtggcatatatcagtattttgttcctttctattgccaaataatattctattgtattaatatgtcacattttgtttatccatttaccagctgatggacgttggattatttctactcttgactattatgaataatgctgttataaacattattgtaacaagttttcgtgtggatgtatgttttcatttctcttgggtatttacccagggatgaaactgctgggtcaatagataactctgtttaacatctcgagaaactgcccaactgttttccattgtactaccagcaaggtatgatggttccactttttccacatctttgtcaactcttgttattatctttatttttgattgtagtcatcctagtgggtttgaattggtatctcattgtggttttggtttgcatttgtcaaatggctaatgatgttgaaaatcttttcatatgtttattggctgttcatacgtcttctttagagagatgtctattcagaccctttgctcattttaaactgggttatttatctttttattattgagttgtaagagttctttgtatattctggatgcaagatcttatcagatgtatgatttacaagtattttctcacattctgtgggttatcttattttcttgatgatattgtctgcagcacaaaagttttaaattttaatgaaattcaattgcatatgctttttgtgttgtatctaagaaggctttgtctaaccaaaggtcataaagatttactcctatgttcctcttcattttaatagctattactctttggaccacaatgctttcagaacaaaaataactttctgaaaagaatttttaaaaatttttcagcagttttcattcaagataattgtatttgtttgttctcacactgctgtaaataactacctgagactgggtaattgatgaagaagtttaattgactcacagttctgcatgctgtacaggaagcatggctgggaagcctcatgaaacttacaatcatggcagaaggcaaaggggcaataagaatgtcttcacatggcagagcaggagagagggagcgaagggggaggtgctacatgctttgaaacaagcagatctcatgagaactctgatatagtttggctctgtgtccccagccaaatctcatcttgaattgtactcccataattcccacgtgttgtgggagggacctggtgggagataatttgaatcatgggtgtggtttcccccatactgttcttgtggtagggattaagtctcatgatagtggatggttttatcaggggtttccacttttgcatctttctcattttctcttgctgctgccatgtaagagtgccttttgcctcctgctgtgattctgaggcctccccagccatgtggaactgtaactccaattaaacctctttttcttccccatgtcgggtatgtctttatcagctgcatgaaaacagaccaatacaaactctactatgtttactctccaacactgagagcaagccatatcaataatccactaaggaaagcaacaattagtaatttttggtattcttccaatttttagtgaaaaacaattgaaattgtattggtttcccatagtattgtcaattttattttgttaattgctatttttatgtgtagtgttaagaggtaaaaaaaatagtgttgttacttactgtggtttttccaatagccctaatcagggaggatacagtcagtttttagaaatgacggaaaaatgaatgaagttagaactgtagatgctatgctagttaataggtaaaccaggcccaaaccctcagaatgccctcaatagatagcccaggattccttctctgacatcgtcatatattgtatctaaggataaacattaactactaaatgcaatgacaattaggaaaatttataatctgttattcattagctcaaggtaagatattacttgatttactgaactaggtaaataggagagtttttttgaccccataaaatttctgtacaattcatggtatggagttgtaagggctattttattttgctcacagccataaacaaccaatcataatgcatatcttctagaaggtaatgaatcttaaaaccaacgtgtgacatgatcttgtatgtaaaaaaatcctaaggaattcacacacacagacacacacacacacgcacacacacaaatcatagaactaataagagttcaacaaagtcatgggatacaagatcaatatacagaaatcatttgtattttcttttttgagacagggtctcactctgttgcccaggctgggctgctgcccaggctggattgcagtggtgcaatctcagcttactgcaacctccacctcccaggttcaagtgattcttgtgcctcagcctcctgagtagttgggattacaggcatgtaccaccatgcctggctaatttttttggtatttttagtagagacagggttttgccatgttggccaggcttgtcttgaactcctgagctcaaatgatccacctgcctcggcctcccaaagtggctgggattagaggtgtgagccactgctgctggtctctcaattgtattttcatgtacaggtaataaacaattcaaatatgaagttaagaaaataatgttattcataataacatcaagcattaaatacatataaattaacaaaagtttaagactagtacactgaaaactataaaacattacttaaaaaataaattatgagacattccatgttcatggactggaagactcaatattgataaactggcaatactccaaattgatctatatatttaacataatctctatcaaaatcctagctggcttttttttcccccagaaattgagaagcttatctgaaaattcatgtggaaatgaaaagaacccagactagcaaaacaatcttgaaaaagaagaacttaacactccccaatttcaaaatgtaccacaaagctatagtaatcaagataatgtggtacttgcttacagaaagacatatgtatgtatcaatggaattgaattgagaatctgaaataaaccctttttatcatcaattgatttttcacaaagatgccaaggcaatttaatgtggaaagaatagtcttttcaacaaaggtgatgggacaattgtatcctcaagtaaaaatatcaatttggacccttatctcataccatataccagagttatctcaaaatggatcttagatctaaatataagtgttaagattataaactcttagaagaaacctgggaataaatatgtgttacctcaggttaggcaattattttttagatattttacctaaacacaagtgattttaaaaattgataaattatatttcatcaagataaaaaaaaatcctcttatgcttcaaaagacaccattaagcctgggcacatggcttatgcctataatcccaacactttggaggacaaggcaagaggatcacttgaggttaggcgttttgagaccaacatgggcaacatagtgagaccctatctctacaaaaaacaaaacaaaactagcagagtgtggtagtacatccctgtagtcctagctatttgggaggctaaggcaggagtattgcttgagcccaagaatttgaggctgcagtgagctatgatcctgacactacactgtagcctgggtaacaaagtgagatcctgtctttaaaaaagaaaaggttaacattaagaaaatgaaaagacaagccacacaaacttggagaaaatatttgcaattcaagaaaggagtttaagtattattatttttttttttgagacagagtctcactctgttgcccaggctggagtgcaatggcacaatctcagcttaccgcaacctccgcctcctgggttcaagcgattctcctgcctcagcctcctgagtagctgggactacaggcacccaccaccatacctggctaatttttgtattttcaatagacacagggtttcaccgtgttgtctaggctggtctcgaactcctgacctcaggtgatccatctcccttggcctcccaaagtgctgggattacaggcctgagccaccgcgcctggctgagtttaagtctttttaacaactttattgagatataatttacataccataaattcactcattttaggtatacaatttaatgatttttagtaaatttacagaattgtgcaaccatcttcacaatcaaatttcagaatattttcatcatcccagaaggaagcctcatgcccatttgtagtcactccctcttcctcctctcaattatacccaccagctccagacaactattaatctactttctgtgtttctgaatttgacttttctggacaatccatataaatgaaattatacaatatatgaacttttgtgcctggcctctttcactaagggtaacatttgtgaggttcattcatgttgttgcatgtgtcagtacttcattccttttcattgtcaaatagacatgcaaagaaagtcttaagtaactaggatttctatcatgctggataatatagctgattattaattatgatatacatttctatctagaagaatataatcataagctgattatatttcttccacatgaaagatagtaaagctcagtgaatttctagtgtcattagactcttttctacagttcttgattaataacttgacaatacatcaacttagaactactagaataaggctgtctttattgtacagtgtatgtgatttctactacactgttcaagaaccttttcactgataacagtgaagttaaatttgttagcttgctaagattatcacgatttaagatagttcccaagtatgttgggaattgagagtttaattccaacttacattatactacttgtgggaaaaagctgggctgcatattttacattccttgttttatttaatctaatttataaaacagtgtttgaggataaatgtgtcaagcaataagaggctatgcaagactgcttagcctgggtctccaggaaaccttaaattcaagagattctttactaacaacacacctgtggtaaagttttgctgaatagatttaccaattataaagttcatgatgtgaaaatcacaatgctccttgacatttcaagagcactgcaaaacactcaatagcaaaacagtgtggtgatcccagaagaccaggttgggtaaggcctcagagagagaataagtgaagagaaaagccataagggagcactgaagcacaaaacctcagacaagcagatgtggaattctagtggaaaatagctggagacaaacccaattgttgtgaagctttccaaactgaaggggacagcctttaagaaaaagaaaatgaatcacaaccagccatggcctgagggctggctgctgtgatgtgctgcagccccatcagggtccttctccacttgtagcaagggtcagcaccacctgatgtcaccttgaaatacggagtgcaggagggggtagaaatggtacatatggtacgtattcttctgcttgtgggtgatacactccctgtgttgagaagatctgtagttgagtagatcctatctgttttgcttctgtgaatggggaaatgtctacctacgagctatagcagcacctctgcaaatgctcattgaataatgcacactgtagccacttctgactgcatatgtataagccatgaagtcatggagaatatagaatgcctgataatgacattcttcaaaaaaccaaattattttctcgtatttgttgataagtagaaatgggatatattagttatctcagtttcctgtatacaaatttttactctaatatagtacatattaatttatagtctgtaactttgtgctttataattttaattttcttctaggtattttaagagctcagtaatacactttacattttaaggcttaacacaaagacaacttgtaggatattctatgataaaatcaatccaagcaggagttttttttggacaacaattttaaaaaatgaaacaactgcagcttagaccaggaaattgattttattttgaaattccaggaatgtcagatttgaattcttgtcaaggtttcattgattacttacttatgtatacattctgctttgtatttctagagtaaaaaagccataaagaatatcctgcaaaaatgtacctacttaccagcccttgaaccatttctatatgatgctcctcccaatattctgaaacatgtggttggacagttcagtaaggtaagaaatgccagcctctaaggggaggaagaaaattaaaatgatttgttgttattttttttttctgttgggtcagtagctttttctgtaacacggggtcatggttttactgcttaactctcaccaatctgtatggacagagaagttaccttaataaaattcacatgtaaataaaacactttcttcatcctcacattttccttagagtctctactgtctttttaagtgttcccagaaaagaaagctctcataatatagataatttatattgataagtgacttttagtaatctttctagtgtctttcatttcactcacctgggaatatggcaaagatcataaagagaaaaggaaaaaggtttctgagccaccgaaatatctttcatgaagtccatgtactttactggagatgttctcagacagtcatttggagcatatcgacttattttgtgaacaattttaacaaatatagctgtcatatttcttagattgttgcagattaaatgatagtaaatggtagtaaggtagaaaggtcaagctgctataagtgggcacagccagcagagctgattaccaatagcaaaggataaaagagaatgactctgttaccacagacactgatagtcaggatggtgaccctaagctatcaagagctggctaaattatgctcagtgaatttgacttaggaaaatggggtctgtacaagtagtagcccatggtggttatgagctcggttctgaattggagtacctggagttcccacttaccagctctgtaattctttaacaaaatgttgacctctctaaaccttagtttggttacccataaaatgtaaataattagagtacttatttcatagggtcattgtaaagagtaaatgagatattgtatgctaagcatttagctcaatcccaggcacatattaagcacgcaaaagaacaaaaacaaccaaagagttgtatttaagaaataaaacatgcaagcgggtcaggctaatttaaaagatttaaaaaaaaatgaatggggtgtggcaaattcatttgaatagtcagttataatgctatataaatgagatattactcttcatacactatgtttctacaaataatgaacaaaaactatgtattgttataacttttaaagtagtccctacagataagtttgcctagttttaggtcttcatctgaaagatagagtctgctaacagccttcagttctctcaactctgttcatgacctccaacagtatgactggccgtcaagtgccagagccacaggaaagtagaagtttcacattgctgaagccactcacccaggcaggatacagttctgtgtatcaaacacctatgtcctttcttcctccttccaataaaataaactgcccctcttagttatatgggatgtgaggaatataatggcatgccctcttgaaaaaccaactaaataaccaaataatgcagagaaaagactaaattactgcaagggaaattgatccatttctttattttttgtatacttttgggtgctaagaaggtgaccagctaatttggtcctctaagagtgataaggggtaaggggctgagtagatcatctacagacagagttatctgttcttgaactgggtaattgacattatttctgaaagtttcattttgtagtttaatcttttaggctagtgagtgagatattctgattttattgaagtagctatgaaagtaaacactaacctacattaagagttcaaaatacataaaaccagtgggatgtgtggaagttagacagccccaagataaaataaatacagtactgtatcatatacacttataaatgtgccttcaggaatattttcttttttttttaaatttattattattatactttaagttttagggtacatgtgcacaatgtgcaggttagctacatatgtatacatgtgccgtgctggtgcgttgcacccactaactcgtcatctagcatgaggtatatctcccaatgctatccctccccccaacccccatcccacaacagtccccagagtgtgatgttctccttcctgtgtccatgtgttctcattgttcaattcccacctatgagtgagaatatgcggtgtttggttttttgttcttgcgaatagtttactgagaatgatgatttccagtttcatccatgtctctacaaaggatgtgaactcatcattttttatggcttcatactattccatggtgtatatgtgccacattttcttaatccagtgtatcactgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttgtttggctgcataaatgtcttcttttgagaagtgtctcttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatgatgttgatgatgatgatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctgcacccagttggagcttcccagctgctttgtttacctaagcaagcctgggcaatggcgggcgcccctcccccagcctcgctgccgcctttcagtttgatctcagactgctgtgctagcaatcagcgagactctgtgggggtaggaccctccgagccatgtgtgggatataatctcctggtgctccgttttttaagccgattggaaaagcacagtatttgggtgggagtgacccgattttccaggtgccgtctgtcacccctttctttgactaggaaagggaactccctgaccccttgcgcttcccgagtgaggcaatgcctcgccctgcttcggctcgcgcacccactgacctgcgcccactgtctggcactccctagtgagatgaacctggtacctcagatggaaatgcagaaatcacccgtcctcttcatggctcacgctgggagctgtagaccggagctgttcctattcggccatcttggctcctacctcccatgaatattttcttaatctaaagataccaaagcactaaaaagagatgataaagcaaggtagaaggtgaaaagatactgaagtggctggggacagagataggaagtaatgaaaattctccaggccaaatgaaatatgtaaaaccaatatatttatagaatattacattttttacaaatatatactagtgcaatcttctgttgtccagctgatttatattattgctctattagcaagatccttttgtggttttaattatttgttaaatgcctacatgtacccagctctctgttgagcattggggaacagacaaaaaagattaagttgttcttcagggaactttataatctagctgaggagagcagacaaaacaattagaaaacatttcaatgtactagacttggagataaactttttttaaaagaaggaatgagtgaatatagtctgaagtcttcagatagggcttcaatggaggaaggacaagtgaaaagagctggtccttgcagaaggaacaagatcagaaaaaaagagcgtttcggtcagagggatagtagcagtgactaaggaagagagcaggacttcccacattgtgaccccaccccttccccaggaccttcctagtctggtcagtctttttttttgtctctcataataaatttcttcatttccactggctttttcctgtcaacctgcaaacgtgctcaagtctccctgatcctaagatcaaaacctgcaacatctttagcctttagttctatcctaccgtggtctactgataccctgttttctctttctgaaactttaaagtttgccttgacttccttacttgggacactttcctcagctgctgatagcctgccttcctcaacctcccctccacacacagctgcctttagtcaagtcttcagcaccttctcttcactgtcagatccagtgacttgttttttagttttcattggttgctttaagaaaccttctcttggatttattgattccttacgtttctgatcttctgtctctctaacatttcagtcccctttctatgcctactctttagtatattcattcatttgttaaacatttgttgaacctctgttaggtaccaggcacgagggaaatgaatgaatgaactcaagtatagtttctgccttcagtgacattgtgacagacatataatggataattaaaaattaaaattaaaatattatgtggtatttaggtattatgtggtaagcacgtggatggtggtttgacagaatgctgacagaagaaaaggactcaactcatcctgggataaggggataggggcttccagagaaggattcttaaaggaggtgacacttgagctaagtcttaaaagatgactaagagttaaccaagcataaggggagaggtttgtggagtgtggaaagccattttaggaagaggtagcagcgtgggcaaaggcaagagatgacacagcatgcatgctgtgatgttactgaaacaatatttaggatggagattagtggtggctggagaggtatttaggagctgggtcccagaggaccctttgtgccttgttaaggagcttgcctttaaattcttagggagcaaagagaccttgaatggtgtaagctttatattttacatctgtgagtggatctccattgcctttgcccatgttcattgcctttatttcatttcttcaacctaaaaattaacacattctaaaaagcacatttcacttcaaattagcagcagatttggctcattatgttataggtatattgggtataaattctcttttacattttctcacatacagtattgcttttcaatagtaataatctaacttggaaaagaaaagctgacattttatgtgcttcactttgcaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtggggaaaatggactttgaaacgttcaatattagaatgtagtttttctgttttcacatctaggttttatatccactgtgtcaaaatgtggactttgaaatacgatgtgaggccaatatgtacctttatttctctcttgatctcttccccctgccaaattaattaatgatctgactgacacgcacatttccaattcaaactggaatgtcatttaagacatttttgtactaatttaacatgtgctttactaaagagtacccaaatatagagttcaaagtaaccagtttttaaattgtgaatacctgattataaaaggcctatagattctgagtttcatagttccctgcatattactattctaccttaagctcacatttacattaatgagactatcacaggtagaaaagagatgttgagtaacaacaaaaaagttattatctaaatgcaaaaaaaccccaaaatgatgtttattatttacaggtacttcagagtaatatagcaagatgctattttcaggattaataaaaaagattcatttttaaatgaagttgatttgcagagcattcaacctaagcctcggtccttgtaagcctaatggagaactattccactaaactctaaataaataaaagcaaaaaaagagaatgatttaaacaactgaatcttttttttttttttttttttttttgagacagagtcttgctctgtcgtccaggctggagtgcagtggcgcgatttcggctcactgcaagctccacctcccaggttcacgccgttctcctgcgtcggcctcccgagtagctggtactacagacgcccgccatcacgcccagctaatttttttgtatttttagtagagacggggtttcaccgtgttagccaggttggtctcgatatcctgacgtcgtgatccgcccgcctaggcctcccagagtgctgggattacaggcgtgagccaccgcgaccgcccggccaaacaactgaatctttaaaaatgcccccaaggcatgcaggataaaggcatatttatctgtattttctaatcctacatttatttcttattttctttgattaatattggaaaatataaattctaatttttaaaacttacatgctgtaacatatacttacgcaagttgcaacatgtctgttaattcttcctgtttaatatcaatggtgtttaatacgtatggtaacattaattttaaaagcacaaaagcaattttaagattaaaatttgttttctatccacatatttttacccagtaaattctttccagagttgcaagtttgtgcactttttaggaagtttatgagaactccttgaccaaaagagttccaataggtaagctttgaaatattaatatatatgatacatcaaagcagtgatatatcataacatgtataattagtctacatataacactctgtctccaggctggagtgcagtagcgcgatcttggctcaactgccatctccgcctcccgggttcaagctattctcctgcctcagcctcccaagtagctgggactacaggcacacgctaccactcccagctaatgttttgtagttttagtagagacagggtttcaccatgttggccaggatggtctagatctcttgaccttgtgatccgcccaccttggcctcccaaagtgctgggattacaggtgtgagccaccatacccggccacaaatttatattttaaaagtttgtataacataaaatgtgtaaaaccgttaaataaaggaaatattaaaatcttttttgaagaaaacaaaattaatttttatacgtggaatatgtgtcccttcacgaagaatggtattttatataagtttaaggtaactttcaatgcaattttgttacaaagttacagaaagatgcaaaaaaaaaaaaaaaaaaaaaagaactaaagtgtccccagaatgaatgacctattagaatcaaccaatggtaaggtactttattgaannnnnnnnnnnnnnnnnnnnaaggtggtttcacaaaaagtgagaaaccggattataaaggagatatatacttcttttgtaaaagagaccaaaataaatctttataatagggagaaagagacccattccccaagaaaggttatcttataaatagtataaaggacaccttcaaaggcagtttggttccaaaagtcccaaaaaaacgcaaaataaaaaaaaaaaaaaaaaagacctaaaggtgtccccaagtatgaatgccctattaaaaatcacccaaatgttaaggtacttatttaaagaaaaattttttttttttcccacttttttgaaggcatattttaattgagcaccaggaaaaactacaaactgcatcacattagaaattaatctagtgctggccaggctcagtggctcatgcctgtaatctcagcactttgggaggccaaggcgtggggatcacgaggtcaggagatcgagaccgtcctggctaacacggtgaaaccccgtctctactaaaaatacaaaaaattagcctggcatggtggcgggcgcctgtagtcccagctactcagaaggctgaggcaggagaatggcgtgaacctgggaggcggagcttgcagtgagccgagattgtgccactgcactccggcctgggtgacagagggagactccgtctcacaaaaaaaaaaaattaatctagtgctttgtcaaaataccattgtaaatttttaacttctccacttccccaattctgtgggctgggatttcatttttaaaattggctaattattataaagaattttggttacctgactaatgttttcaaatttctgatatatatatatatatatatttcacccacacagggcaagtaggaaaacctcagttatgttttaaagcattaggttctataaaatcgtattttatagaaatcttggaaatgttgtctttctataaaaatagacaaatataatctcaaaatagtttcatttttacaattacataattctcaagaatcacttggtgataactattttagaattaattatcctttgtaagacagtttatcaactgatacattcatctgttactaacctaaatatttatttcatactgccttccgatttagtaatctttaaatttttttaatgaagaaaggtaggtaaatgagaggaaaggggtctggactagacattagaagacctaagttctgggcctggcttactccacagccataaggtgtttttgaattcctttttcttcaaaatctctgcctcagctggggtggggaagcagctttggggcaacatctaatttggggagggagacatggacacagtctgccattcagcataattctggtatcataacaatataataataaccccaattctctgtgggtctaggataaggttaattcgcttacattcttaaaggacatttagaggtaagttgggatagctgtggttgctggccagagggaaggaatttcctggtcttatctggaggctcatattggttctttccgaaggagtacgctaagagctcaggcttaggtgtcaaacagaccttaattcctctctcagttataactacttactataactaactattaccttgaaggtaatagttaacccctttagccacagtttctgcatctgtacaaggtggttaaagataattacctatttcatagttagaattaaatgagaaaatgcttagccaaagggctacatgtggctactgaggactagaaaaatggctagtatgtctgttaaactgaatttttaatattgaatttaaaatttataaactgacacttgattcagttattggaaaacttttagatatgtttggaaccacttgcaaattttatgtaatctaaatacagacatactagccattttcttaaattaattaatttttttgagacggagtttcactcttgttgcccagactggagttcaatggcgtgatctcggctcactgcaactgccacctctggggttcaagcaattctcctgcctcagcctcctgagtagctgggattacaggcatgcgccaccatgcccagctaattttgtatttttagcacggacgaggtttcgccatgttggtcaggctggtcttgaactcctgacctcaggtgttccaccctcctcagcctcccaaagtgctgggattacaggtgtgggccactgcacccggcccataccagccatttttctagtcctcagtagctggtggctcccattcagtctacatatagctggtggctcccatatttaacatggtaataacaattattattaatctaatatcaatgataacatcattatatcaatactaagaatactatattattaaataagtaaaatattaatatgttaatatggtaaattaaatatttattacattaaaatataaaatttattaatatttaaattaaaaggttaaaattttaaagatatttaaaaatctacctcttgaattcatattatctggtgtccgatacatttgaaggcctaggaaggtaaagcctgctttaaaatttttgactaactcagagaagaagcagttgtgaatttctcagtgtaagaatacttcgaagaaacccactgttgaaagacaattttttcaagagtaagaggctgttaggggagaaacattctttaaggtagctttttgggtgtgtacataagtagctgtttaactatggatgcctgtaagcacactactcactactaagaaaatatggctgtattttttggtccaccttagcttgataaattgtggaaggaattttagtgtaatataaattatgagtttttaggtcaagcatctgggcatagataaagataactaacaaaaggcaaagcaagtctctaatattaggttttatctggagaaaatgccttcagaagcttaattattttgagtgttttgagaatttttgaattatacttccatagatttaaaaaattattctagaatgcctgctaaattttatttgacattcatttatctgcatgtaagttatttccatgacgtattaagcatctcacaatgcactgatcaacatatttaatacttttatactaaatcttgtataaaatgttcaatttatgaatgtaaatgtatagtactatagatgcccaagaactattaatagtaaaaatgattaatttcctaggtttctatgatacaagtatttgtaaatagtttttcaatactaaattatattttattaaatagtttttcaatatgaattatacttccagaaatttttgttttcctaggtgaccagatctgattaaaacccatgctgagaatgatctctaaggcagttagaatgcagaagttgattagtaacaatagactgtgtagtctaacttatgaaaaaaaaaatctattagctaggatccttaaagcaacattagccacttgatgtgattaaaatgaagtctctgtaataaaatattgtcagtggattgaagattcttgtttggaaaatgtcccctttgccattacatttatatcccttaaatgttttgctacttctgtagcacagttttatgaattcgtattttcctcctggatagcctctaactttatgcacaaagcattactggagcataattattcagagtgtatttgagatttcactcacaggattatttcagataaatcccctatattgaatcttatgtgcctgctgtgttgatcgtttcaccagcatttaatagtgtattttctttttcaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcattagaattgtccttttcatttttcctatccagtgtgttgctgaccttggggaatatgtgattggatttatgggtcttggttagttgctgtgtatgtgtcttttgctttaaagggatgttacttctgctgctctctcctggaggaggtgaatgataacccacacagcccctaggccacagtgtttccagtctgactctgttttcaggtttccttctttgactctctctctctttttttatttttttcatgcaaaaggagctacccgtttgttttttgtattttctggattcatctctgtcatcattatttcctaacagtgcataactttgttgtgtcttttaaaacttcataatacccgagattacctcattttgttttgccttatatccggctaagattgttggttatttcatttttttttaatacttccttgggcctgttttgtttccttgcagcaatttctttgacctgttgaataggaaaatgtaatttgtattcccagttttgtagctttcctttctttctttcatgcctacacagcttgtcttatgaatcttttaattggagaaaataaaagtagtttttatctttcttcattagggctgtttttcttagatgtgttggtaatgacagaaattagtttatctgggttaaaaccacctcagatattgttggaatgtcaaatttcctagttgaaaattttcacttcatagataatttcatacttatcaaacagcactaaacaaagtaataaaatacttaatagtgttcagatgggtgttataatttgatcatatgcattgtggaaaatttatgctatgaaatgtttcttgacataaaactctttaaacaaaatgaagctttactttttgaaaagtatgttgtgagatttaaaaaatatatataaaaacaaaatctttttcatttgtcatagggcaaaaataatgtctgttattaatgataattcactgatatttttcacccctcatttgaattttgtcaattctaattccctgtgcaaacccctgtcccactgctccctacccacccccagccccaggagtttatttaaaattcccctgttcttaggaattctcaacttacatgaacaactatttttaggacttcagttcaggaatagaattacttggaccttattattatagattcagtcctttcacctgttgtggaaataggtgaaatcagtggtacctgaaaagagatgttggaaacataggttctagtctctctctgttaagtattatagtaagggtgataatagttgctcagcttactcataagaagcttatgaaaataacctgcaatggtgaaaataacaatgttataaacaaatccattttatacaaactcgacatgtgattaatggaaaacctaatagtcaatgacagattacatattttagccagcaattgtgcaatattccccaggccccacactcttagataagtgtagttcaaaccagatgatttatgattaaaaaaacccctacatttcctgccctcatggagttttctaatataaacacatttgccgagacagaggcagtggaatacgcacaagacactaaacacaaagcaggcatatttaatgtagtatggaaaaacaaatgacaaccccatatttacaggatattgacctgtttttctaaccccttcctctcaaagaaaacccttttccttaaagaaaggatgaaaggtttgcttgtttctaaacttgatttgaggtcctgcttaacataaaccctgaccttaaattcctgggtgaggcccatctcccatcccagatgtcaagtttagaaaccaaccttgaaagaatgaagaatttttctgttgtgttttcaaatagccaattctttgattaagataggtgctaccaaatgttgaggtttatgtacactgtggcttattctgccacagaattcactgtttagaaaatgttgatttgtagctcttctgcttctttcaggtgattaaaagga

SEQ ID NO: 12709 - DNA, 18228 bp, Human
agctactcaggaggctgaggcaggagaattacttgaacccaggaggcggagattgcagtgagccgagattgtgccactgcactccagcctgggaaacaagagcgaaactccatctcaaaaaaaaaaaaaaagttcacctgattgcctttagttctcccctccttttaggctccgagctccctaagaggaaggggtttacctgccttgttcacagctgtgtcctcggtaataaaccttgcccggtgcaaggtaggcagtgaggaagtatttgtgataacagcaatgtaaagccatcaacacagtgcttggtacatgcagaacagccatcaacacaggcaaccatccctgtgaacagagggagtgcattatttatgatgggaaactagttttagttggaaaattatcaaattaccaggaacggaaagaacaaaacagttctcccaagtagctcttctggggccaagccccagcaccccacccatgcaggaccaggcccccaaaggccttggaaccaccttgttccagggtctcgctccactgtcctctcctccttcccaaagtcaggactcctttccttgggcttcagaattcctatcttctgctctagaaggcttggagcaagtgggggaaaggcaccactcaccaagtctgtcaggggatgacatggtatagagggagaggagctacataaaatacaagatgccagttaagtttgaatttcacataaacaatgaaataacattcctttctctgccatcgtggtgtgtgcttgactccacttctcgccatgtctttcccacaagacttttgggattaagcaattcctggccaagaaacaaaagcaaaatcgtccccagtggattcggatgaaaactgataataaaatcaggtacaactccaaaaggagacattgaagaagaaccgagctgggcctataaggaattgcacatgagagggcacacatatttatgctgtctgaaggtcacagtcatgttaccacatcaagctgaaaatgtcaccgctctctggagagttgtacatgttttattgagaatatattttttctctctgaatctgtgatgaatgcgttggttggctgggttcagtaataaatatgtgagacctttcacttaaaaaaaaaaagaactatttttttttttttgagaagggatcgccctgtgttgcccagcctggagtacagtggctattcacaggcacaatcctagcgcacagcagccttcaactcctggagcctctaaatccatcctcctgcctcagcctccctagtagctgggactacgggtgagtaccactgtgcaaggctacaaaataactttttagtaaaagtatatcccaaactttatacgagacgtagttactctaaaaaaaaaaaaggatttgctgtttatctgaaattctaatttaactggttgtcctggattttctttgccaaattggtctgccctacggagtgcgagggctgggattttaacccaggcctgcctgctctgagctgacctttcctggcacctgcaaaattaggatgacacgttaggaacttcctggggttcttaagggaattagaagagggacctgagtgcaaagggctttggaggcattcaactgctatgaaacgttagtaaggacagggattgcgttcacctcaatcacagctgaacccattgccgagaactgttatcccacacagctggatcttcatcattatgtgttttaatgaaaaatcgctgatattgctgtccctaaatagccaacccccaaaataattaaatcacctcaagggactctaggtccaatatccgcagcacgccacacaaacatctctcagctcagccacgcagggccgatgcctgcgcgacccacactcagggaggcgcccgcctcagggcctcacaggtgggaccgcgcctgagagccctgcgcttgcgcactccacgccgtgctctacgcatacgcctgtccagccccgcctctgggtgtgtggcgtgggcacgccggccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccaggtacaggagctggtgccgaggcgcgacgcagccactctgtagaaaagtcgggcgctcttcctggccccgggctgcctcctagtgttgaggctgaggaggcaccccttggcgggccagccaggaacccccaaaaagatccttcctgagtacccgtgacctgctttgaacccttattttgaactcaaaaaagaaagccaggtggcagccccccttctgtggcttctaggatgttccccttctagaacgttccagaggctccctgcagctgggttggaaggtttcctaagatccttataggttggggagtttggggtacagttagctttgtattttttaaacgttttttgggataaaatttttggttaaactttaagggttttttttggtttttattttttggtttttttttagaaagaaaatgagtgttgtatgtcttctctcagtaagcgaatggttttctcagaattaacaaggacatcaacacattttaagtggtttataataagacaacatgtttaattgttttgcaagtggagagaatgtacatattttaaatgatttatttaaaatcaattacaggaaccctccagctatccatgttagaattaaccacagaaaacatgactacgttattgaccattttcacttaaaaatactttattttgtttcctcgacttgctttcttggttgagcaaagtttttcagccttttatttttaagcccaaaccaaccaccaaaaaatctgaaaaacctacaaacaaaccaatttttacaaaagaatttattttgagggagaacttgggagagtgagggaaaaggagagtggcaagtcccttgttaatatcgcagatgtagacgaatctgattgtatcttaaagttggttacagtattatcctgcaacactttttttctccaaactaggaaaaatgagtatttgggtcagtttttacctcccaatattagaatagattaaatgttttaaaattcattttctgaaacacaagttttcagtaaaaattctgaagttcctgtggaaattaaaactctcaacattttgcccgttttctagagtgcatttgatttctcttcctagacaataagctcatggtgtttataacagaacaacattttttgcagctgatggcttgtgaaattaacagtcagctgacagaaaactgggcttagtcttcgcattttgctgtagagtggcgtaatagctgccaagtcaaccgtttgttgcagaactcacaatttattctttccagggtagtgattaaacgttttcctttttgtatcgctaaatttcaaaagagccgattttaaggcatgagatcaactagggtaatgtgcgaccacaaaaggtgtttcttttgaaatttttgcattgcatttttgggaaagaaattcaaagccaatattgtatcactttttaattaaaacatatatcagtagtatgtcaagtctagtttgtattcaagttcagctagattacagtaggttaatatgataaaattacagttgtaaatttagtcattaatgtaaaagggagaccttccattggtaattgcttgagaagtaaaattacaagcaaatgaaatttatttgtaaatacagttgttttaatgcagtagtaaaggtttaatgggagagataattattgacatggattacctagtctttttttttgtctttttttaaaaccccaccccaattacctagtcttaaaaaagaataaaataaaaagttactttagtattgatctgggaaaatcttacatattaaaaagtcaaaatttatgattaagatggaatcatgctctgtttattgtttcagttctgaggttcttgcatctatagaaaatattatccaagacataatcacaagcttggcaagaaatgaagcacctgcattcacgatagacaacagatcaagctgggaaaacataaagtgggcattttgcatttttattttttaaatgcaatatctatgtcattattaaaattatttgaattagagttctggtcatatttttttcattttattgcctttaccttgccaaaaaaaaggatttaggaagtttacgaaatacataccatacagagaggttatgtaaactagaagtaggtgtgaaagatgaggcaaaggaaaacaatgctagcaccaacagaatggagcaccagaagaggttagaattccaaatgcatgtgataaagtctcataattttgctaagaataggcaccatacttggagctaagctttctagcagtcagagggggagatgtcatgggtgcaattctcacatatgccacaaaagcaaaccacttgctcaggggaaatataaccaatcctgataccagaccaaaataaaagtatcctgaacatagagcacatttaaggctttctcctgacagatcttctgcccctgctaaatcatgtgtccaaaaagggtaaaatcagcaaacagctttatcagaattcttgaacctagttataccggttttttccagcctctcatattttttaagagatacagaaacaaaatgaaaggaattttgagtctccttcatcactgttgttttatgatctatataagtaatataagctgtatacttttcagtcatgttttgaaagatggattttatctagctttgaagcagcttacacctgacatatccacctggtgccttctgccacctttaggggaagcttggcagttcaacttaacctaataaaattgttattttatgtaatgtaattttgcaggtaaatcagaaatgaaacatttcaaagcttattaaattgagtaaaattattaaatgagtaggttattaaaatgagtaaagtactaattgtgaaatatttgaaaacattttacatacactaaaaatgtcttcccagtaaaaaagtatgcacacacacaaacacactcccacaccccctaatcaaaggtgttagctcatttatgttaaatggtttatcttagtgcctctgtatgtcacaaacctaatttcctagttatcacctggaatgatctatgctctcaaaccagttgatcctaaagcttcagtgcttaaattgagaagaaatgtgggttttaaatgatgtgcagaagaccataagtatatattgtttggtgtttagaagttgtctttttcacttttttcctttgctttaaacaaaatgacaggtttgaagattctgtgggtcttcagatggtatcccattgcaccaccagaaagatcaaaagtgattcaccaaaatcagctcaaaaattttgtaagttaattgttcttagcttttggtaataaaggataaataaattttgttatcttctcaattttatttgttgctagttaaataattttacctgtttttaatagatcactttcatacataaaataaatttctataatttttcattgtcaataactatggaagtaggttatcaacataaacatttttcaaggtatatggttcagtgcataattatcctctcagttttgctatccatagagcaattaattttaactgattctgcaggtaattgttctgtacttaaccctcccattttggaaagataattttttaaatgttaactaaaattaagttaaaatccttgatagcagtatcttttgaatcagtaagagaaatgatgagtaacttgtttgttgaattttattttccagctctaatccttaaaatattgtccatgatttataaattagtacagagcaacacttatgcaaccaaaaggtaaatatattgttctagtaaattactcttcaaaatgtaatgtgagaaatagttggattaacttttattatatgctttgaaaagttacataagactaaactatagctcataatttactttctttatatgttgtgttttcatccagttaaagctttcttcaattaacactgtaatacttgtcatattcaaaaagaatatagttaattaaaaatatgtattttaaattttcatagggacatatattacactgacagtcaactctttggtaaccagactgtcgtcgacaatattatcaatgacatttcttgcatgttaaaagtgtcaaggaggagtctacatatagtaagtagtacctaatacaaaacattttattttaaaacaaaatgtttgtataaaacataatttttttttttttttttgagacggagtcttgctctgtcgcctaggctggagtgcagtggcgcgatctcaactcactgcaagctctgcctcctgggttcatgccattctcctgcctcagcctcccgagtagctgggactacaggcgcctgccaccacgcccggctaattttttgtattgttagtagggactaggtttcactgtgttagccaggatggtctcgatctcctgacctcgtgatccacctgcctcggcctcccaaagttctaggattacaggcgtaagccaccgcgcccagacaaaacataattttaaaacataatatagtcttcttttgctattatttgatgcttgcatttttctcactataaatttaagtaatagattctcaatatattcctttgggtgaatggaccaaactgatgaattaccaaatatttttaattcctaaatcccttacatattttctctttcatctctgaaatttcaatccaagtgaaaatgccagtaattcagcagatgaacacaaggagtgacttaatagcataaaacatattcgtgaagcaggtttcaaatatgtctattattttttgcagttatctacatcaaaaggtttaattgctggcaacttaagatacatcgaggaagatggcaccaaagtgaattgtacctgtggtgcaacggtaagaagcatcattgaagttttcacagctttaactcttctagctccttcagttttgaagcataattttatttcttgctttattatgtaacctagagcttaagatttcaaaataaaactgaaagatggataggaatatgctttacagaactgtacattacatagtttcaaattatgctaattgtcaaatgtcagattgaaataaacatacaaatataactcttaaaaatgcactattattttcagataaagtgtggcttggtcattttagcatgttatttagtaatgttcataaaattttctggttctgaaagtaatatttttaatactaaactatttgctgggctttgatacaaagagagcccacagtactaaacttagtacccctgttgggagaattgctgtgagtcatgtgccggttttcttactgaggggtaaagctgttttctactattttttaacagaggaagaagtctctgatgactggtatggtcaaagaaaaataaaaacagagggctttgtgataaactaaaaatgtggttattttgctttttatgtaagataaaaactttttttttaaaaggctgttgctgtgccatcgaatattcaaggaattcggagtatcctttaagtgggaaaactatttaaacttttggaatgttcattcattcattaattcctttggtaagccaagccttcataatgtgtaaggaacaagttaggccctgtagcagtcaagatgaacacaccatggtcccttctttagtactcttttaggagctcaccatctagtggaagagacagatatctgaatatatgaatagatgtgtttatatgtttgaaggtacaaactaaaatgttgtatctatagctgcttttgaattatctatatggcaccttaatttagttggtgattaaattgaaatactcttgctttcaatttatcagccttaacttcacagatttagttacagatgcaaagtttgtattaattgtagaaaaagatgcaacatttcagcggctcctagatgacaacttttgcaacaaattgtctccttgcatcatgattacggtatattatctaactttactacaattccaagactaatgtatactgttatggtgattggtaagaggatttacaatattatctacacaatgtcctgttttcaatataatgcatcctttgggatcatagaacgggaatttccaatgtgtttatttaaacatcctcaaagctggctatcacctcaagttcttttttttttaatagagacagggtctcgctctgttgcccaggccgaagtaccatggcatgatcatagagcactgtaaccttgataagttcatgtttctaaaaccacactcaaaagctttcttccttgaaaagctgagtgttcctgccacttgtcctgtggctatcagtgcagacactgcaatgaggtccacacgtcagagtcagtttgacttactcctcacatcccatggtcaccaagtccttttgaattggccttgggaatctctttcatttcagccctttctccttaatccttcccctttcattcttacacaagacaaccacctggtagcctccagacaggcccctgacttcaattatctctcatccctgccacaccagacttgtcatttccctccttgccagttcaaaaacttttggttttgtctgatacttctactccaaatctggatgcctctgtggaactggtcagcccttctaagactccattccgcctcctctccagggcagcgctcctcactgcctccataaacatctctcgcaaatgcctctcaagaagaggctgggactcgagggccatattaggaagagccatttttcaccaggtcctttaaccctgtttgactcctctactgtgttcatgtgctattatttttcccaaagaacattatgaaaatacactaaatactcacgatgagctaggacccctgctaagcacttgacatagtaagagttcacatttactggtgtttatcacatgtcaacttgtataggctctcaatggccttaggaggtaggtactaacatcatcgtcactttaataatggggtactggaatgcaggaaggtattttaccacgtctctatggctattcaaaaccaggactggatttgaatagttgaaatccatgttgctataatgccatcacttggtgtgataggcatatttatgctgattttatagataaagccatggcctaaagagactaagaaacttgcccaacatcacaccactgatgatgggcagagagggaattcaaactcggagctgtgacccgaagcccattctgaatctctagggctactctgcgctcttcctctgctctctgtttcatttggttttctgcttttctctaacattgttgtaacactcttcaatttacttttctacataattattattttaatgacttcataatattatcccaccatttaagttttattaaaccctaaatttaagccaggtactcttctaagtgctttatgattattaaataatttaattcctataataatctcatatgttgttacagagcatcaaaccacagagtggttttgttactcattcaagttcatgctgctaagaagtagcagagctgagatgcgagctcaggctgcctagccccgcaactgctgcagatcaccgctgtactatgctgcctctccacatccctgttgttagatattttggctatttatattagtttgcgccattttaaataacacttcagtgagcatctttaaatatgtaggatgtttattatttctgtttttgctgaaatatttccttaggaccatttcctaggactggcataattcccagtccttcagtctgtttgtatataatgtacatttttttttcacagtcaacaccagtctttcagcacctgaaatccaaggtaggaagatgtaacccttttttttggtgctgtgactcagatatgaaccagggttgctgtggccacatgcagagtactaaccgttgtatgagcataacctataatttattattactattattattatgattttgaggtggagtttcactctttttgcccaggctggagtgcaatggcgtgatttcggctcattgcaacttctgcctcctaggttcaagtgattctcctgcctcagcctcccgagtacctgggattacaggcgtgtaccaccacacctggctaattttgtatttttagtagagacggggtttcaccacgttggccagactggtctcaaattcctgacctcaggtgatcgatccccctaccttggcctcccaacgtgctgggattacaggcgtgaaccactgcgtccagcctaacttttaaattattaataagagtataattgtaaccattttattctactgaagttaaaattcttaattttcatcttccttttagggaaagggagttcctgatctaaacacaagacttttagtcaagaaactgtgggatacatttcatgttcctgttttcactcttgtagatgctgatccacatggtaatttatcactggactatttacaacaatagtcataactaaatcatatttgttgttgtgttttcttcctctttttttttttttctttttgagattgagtcctgctctgtcacccaggagtgcaatggcgcgatcttggctcactgcaacctccacctcctgggttcaagtgattctcctgcctcagcctcctgagtagctggaactataggcacatgccaccatgcctggctaattttttatatttttagtagagacggggttttaccatgttggccaggctggtctcgaactcctgacctcaggtaatctgcccacctcggcatcccaaagtgctgggattacaggcaggaaccaccgtgcccagcctgtagttgtgttttctactctcgggacacttatgaaacattttaaaagaaaatgattacattaaaatttggtctataattatttgacacaatttatcgttactttgtcatattaaactgagaatgataaatttttcactggtgatgtccacaaaattaaaattatagatagataaaatttgagagtgcaaattaacctgtaatatgtaaggagactaattttatagttaactttcttttaacaggcatagaaataatgtgcatctataagtatggatctatggtaagtatagaaaagcagttttccttttttattatttagacattttatattcattgaggtgatttctgcatttattaatcacccccaagcaggctgagagtgcccaaagtgtacctgagggcctagtatcctattctaggagcaatctgtgtgtcggtggctgtgactccagctcccagtatgaccagtgcaaacacagatgacagagtgggattagctgtgggcaagcagcattattatcctgcactctcttggcatactgaaggaactgtggggctctggggtgacaacaacgctgtctgatcaccaaatatactcgaaatattatatagagccttgaattctgacttttctaatcccttttctcccaccataaggagaaatggaaacaataaatgtcaccaccagtgtctacaattaccatataccagtggtctcacagtgtggtcctaagccaggagcatcagcatcatctggaagattcttagaaatgcaaatctcagtccccatccagaactactgagccaaaatctctaggggtgggatcctccaagcattctgatgcatggtgaaatttatagcagatgaaaaggatggtggagcagggtgtaagatggggaatcatgaacaataagaaatgtaggtcagagggcttcatttatagtttgctttagaaaattaatacagaaacactatatagaagttgtggttgttgttttgttgctgttttgagacagggtctcactctgtcatccaggctggagtgcggtggtgcagtgacagctcactgcaaccttggacttttgagctcaagccatcctcccgccttggtctcccaaagtactgggattacaagcatgagccaccgcacttaacccagagaagttttaacaccttcactaaaagcccagcttagcatagcccctgatggttttcttacttctgtgggctctgggcatgtgaagccagctttagtacttgtccttcttaataagtgaaaaatttgactgaaaaacaagaatgctagttttctacaatttagcctcacctaatatacttttgttctttattttagtctatgtcttttgaagctcatcatctcacagttccagctattagatggcttggtcttctcccttctgatcttaaaaggttagatagtatagcagaactaggatatttaaaatgacagttcattatcatatgtaacaataagcctaaaaagtcactacaagggaaagctcttaatgttttttatttatattgtccacgatgacttatgattatgtaattatgaattaaattcattaatgtttctgtttcaactactaaaatatttaacacatgaatttggttaatgtgttacactttcagctagctaaaactttctgttttacttttatggttaagacattttatacactttttatacttaaaagtacaatacattgtaggccgggcacatggtggctgacgcctgtaatcccagcactttgggaggccaaggtgggcggatcacttgaggccaggagtttgagaccagccagggcaacgtgacaaaaccctgtctctactaaaaatgcaaacattagctgggtgtggtggtggtgtatgcctgtaatcccagctaccgggaaggctgaggcccaagaattgcttgaacctgggagacggcagttgcagtgagccacgatcgcaccactgcactccagcctgggtgacagagcttgactctgtctccaaaaaaaaaaaagtacaatatagtaaatccaattaaattgtaaccattgacaacatcatttgccatatgaatcaatttttgtcatagatttaaatttttaacttcaaaagaaaaatatcattttaagagtattaaaatttgggaacttcaagtttggcaagtttattatatatgttcattatagaaaaaaatattaagcaacaagttaaatatcacctacagatcagcagccttacctttgtagattttttttctgtgcatagccataactttttcacaaaactgagatcatactctgttattttataatctgctttttttaaaacacaacaaaataatgtgatcacttttccatgtcaataaagtacatttcttattttagcatcttttgttgctgagttttaactctagatgtgctagtgtttattcagccattccctcatagccatttaagtggtttccaaatctctattctgataggtcgtgctttgatgcagtctcttgtaactaaatctctatgcacatccttagttagtcccttaggctgaattcccagaagaactggtgggtcaaagaggatccccataatcagggtttgactgttgtctggatagattaagtttcttgctttctctgaagagtaagagtccacctgtccctcagcttatggcattaacattttttttcacctctgctaatgtgatattttaaaatgttttattgttgtaattggtcagtaagaatgaatttaaacatgtttattggatttctttaagtggtgagcaatccttgataacagttgcttgtttcctaaatatggaatgtgaacaggttttgggtgatcagccacttcctataaaatgagggtccaagaggaaacatttcattctttatttttgaatattcacactccactggattaacgtgttcaatttagtgtatgtgtgtcatggtcagaatcccttgggggtgatctgtttgtataaaaacaattttaacacaaattcaagacatatgatctgataattagtaaggtgaatagcttcaagaaactctagctgcatctcataaattctatcagtgcactaaaaagccactccaaatgaatatacgatcaaaggaaaaacactatggtagctacagaagccaggctgcaagggaaatcctccaggcctccctttcaatcaaattgtcacccctatccaagaactgcccctggcaaatggtcataattatggacacattgaaaaagactctcctgggaaatctaggatttgtgacttcaaaaggtagtccacaccataaatccaggacctctcatgttctatttttaaaacacataccatgataaagttatattccacgtttttcaaatttaaaactagataggtaagaatgtgtttgtgtgtgtgtaaagtgataaaagtgtgtgtgtgtgtgtgtaaaatgataaaagtgagacactaacttccatggcccagaatcttcaaatgaattatgaagaattaaatactcaatggaacctaaagtccctcagtgaatctcagccgttggccatgcatattggagctcactgccagaagagtgtgaagctctgagaggcttaatgtacattattaagctgccctggtatctgtatacctgatggtagtgctattggcatttgtttaataaccaatatcagtcttcctgtcatcctgtcatcatcccacgagtgtgacatgaaggaaaacaaaaactttagaatcttactgtggaaacacaaacttccactatgaacttgaaaacttgctggtctaagacatgacagatcccttcaatcctggatgtaagaggtagatctgtactaattttcttatttctgagtttcttgaagtagtaccataaatacaggcaaaatacaggacattcaagttacagaaacacttttttactgatttttttcacctacttttttccagattaaatgtacctaaagatagtttgattccactgacaaaaagggaccaaatgaaacttgacagtatcctgaggagaccttatgttacctgccaaccattttggagaaaagaagtatgtttccttttacaactcaagtgttgcatgtttaattgtcttttactttagtagtggctattcacatcgtattttgaaaatatccctcttgaaattttatatgacacgactaacataagtgttgtttggcagtaaatagttgttgaaattgagtcatatgaatgctaatagatgagatcagtgaatggagctggcctgtttgtatccttatcatggttatatacacattcttgatggctgtatcatagtttgtgggattaaaaaaaggaagaagaaatcataaagatttcagactatccctaattattgaagacagcatacagagtactctcactccagatatttttagctgtagcagctctggaatattctggctgacccttaagactattgtccctggttttggagaataaagcaattctagattactagtttgttgaattgacagaaatgcaactaagaactctggtatgagtacattttacttttattgacagatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgtagtcttcagtgttttgctttattttgtattgagcctattttttattgataatattatttatttgaaaagtttctcgaaggtcttgaatgcttctctagtctgtctatagaacaaaaaacttcttcagttttaagatctacagaagcctcagattttaataaggtacttctccaacagtaaatatgtgaccttttccctccataaacctatcttaattttgccagaggtcagttttatgattttattctgtactttcagtaaacctttaactgcactgaaagtttcttgtgcttgcaagcaagaataagaatttatagaagcacggtaatattaggttagctattttataaagagaaatggtaacaataataataatatataccatttctgagaacttacatgtgccaatcactgctgattcagtatctcatttaattcccccaaggaccttgtaattactgggtaactacaccatagttttcaggtgagaacactgaggatgctatttgtccaaagccacaataataccaggggacaataatactacctacctcaagaaaatgtgggtctcaatgcaaaatgtaaatgtgggatccctttttattaagaatttcaagatgatagcagcagagaattaaaccaagcacaggcccttcttagcctggggtcctgggtgactgcacgggtggtacacctgtgaggctgggcctgcccaagaggttgtatgtagtaaggattgaagaaggtaatataataataaaggaaaatacatacatagcacttactatgtgctaggtatttttgtaggtgctttgtaaacaataactcattgcatcttcacagaaaccttatgagctaggtacttttaaaaaatcacccccattttacaggtgagaaaacaaaggtacagaaaggttaaataattttcccaaggtcacataactaataagcagtggagctgggacttcaaaccagaaagtgtgggtaccatggcgctagtacaggtaaagtacttcacgtgtggtctgtgtcctcactgcatggaaaggtctgcaagtcttattgttggctagtgtcaaatcaagatcccccgataccatacctacaattaacaaatatgttatattccctggtcacataggaaccacacatttcattttgggaacattctggtatgctgttaattttacttactcgtgagactatcaaaaattctaaaaacatttttataaataagaaaaaatttcctctgaatttataccatacttactcctttaacatgtaacagtgtcacttaactttggtatgctttgtaaaggaagaaattactaacttaaaaatatgtttaacccacgacacatctggcttaggatatactatcaaaatgggaaggagtgacaaatctacgatagtcattcaaatttaaaaataaatttgaaaaagacagatacctccagtttggataattaagtcatctcaagtttattattgcaaatttacttaaaataattttcaattatttgggaaatgaaaatggaaagagagcaaaatacactatagtttgacgttactacctatctttattagatgaaaatgaaaaattaatgctagtagctatttgggaaccatctagaattctaattctaaagatttctttctaaaaaggattaccataatacttagcatttaaaatggtaactgataacaataatctcatctaccatcatctaactgtatctaatttggatatttccataattttaatcaagaaaacattagattggaatctttaaaattaaaatgtataaaaactaatacaacaaggctgggcacggtggctcacacctgtaatcccagagctttgggagactgaggaggaggattgcttgaacccaggagttcaagaccagcctgagcaaaataatgggactcccatctcaatttttaaaaattagttggttatggtggcacatgtccataggctcatctactag

SEQ ID NO: 12710 - DNA, 78720 bp, Human
  misc_feature (1)...(78720): n = A,T,C or G
tccatttgcattcctagagcatagcatttgttccaaaaatatttattgagtgtctgttctgggcttgaacacgagtaggaggatttaaaagtgaatagcatattgcgtctgcccttggggacagagacagaaacatgaaaacatgaaattgtccttcaacacaagaagtgctgtaatagaggcatgaataacgcggtgggaaacaaggagggaggtcatgctgcctgaagcaaatgtcaccgaagggcagacatcaagaaggcaggacattccaggcagagggaatagcatgtgtgcagggatgaaagctcacaagaaagagaaacatgagtcaggtgcggtggctgatgcctgtaatcccagcactttgggaggctgaggcgggcagattacgaggtcaggagttcgagaccagcctggccaacatggtgaaaccccgtctctactacaaaaatacaaaaattagccggatgtggtggtgtgcgcctgtaatcccagctactcaggaggctgaggaaggagaatcacttgaacccaggaggtggaggttgccgtgagctgagaccgcaccatttcactccagcctgggcaacagagagagactccgtctcaaaaaaaaaaaaaaagaaaagaaaaagaaaagataaaagagaaatatggagaacatggagcacctgagtgtcaaaacatcatgggcagtaactgtcagggagattgccagagagctcggggttggttggcgcatccatcctgcttcctgcttccttctctggcctccaagctccctgaacctactctgtgcaaagcactgtgccaggtgttggcccagagtatgggactgcagcagtggcctgggtagcggagaagggttttttgaccagctggagacctttgtggctggtgtcattctggaggtgaagagaaggccgctggaaagagctgcccagggaggactatgggagaacttgcagctctgggccatctctggacatgaacgttttgcatacacacaggggagctctgtgtgtctgagtgggggcgggaggggtccttctctctcttttggcccctgcagcttggcttctggagctttcctatgtcttgctttagtgctagcccttggagggttgccagggaaaccgctggccagctccgggagatagacgtagcagaggaaaggagagtgggtgactcagcctggcttcccacaaccgcaaccccctcctcagcacgtggaaaggatctgggggacccccttcccctggatcctacagatgaccctgtttattctttcttctctagagagagcagtccctcccgcagctctgactggtgggagccagccagattttcccaggaagggaaccggccccaggcgccccgtcccccgtaggttcaccctggaactcggacaggtgaattcggcctgggcgaatgtgaattcctgccgtgcccatgcaggcggcaggagccctggctgagacgccctcccgggggcaaacccaggataattattgatcggggcccctgtggacttctgacctcggcctcggcgggagaggacccggaacgcgggcctgggctcccagggagagaggtgggcgggccgcggagggggccaaccaaaacgaccacgacagtgcgccctagccctgctagtggtggtcgacccaacccaaacaaagcagcatgtgcttgcggtgcggcgtcggctagggagccgagccgggaagacaccccaccgccgcagaaagggggtgcgcgcggcgccggcaccggcaccgccgagcgcgccgccacctcgggtgtgccgagggggtccgggtccttcaagggcggtcgcggagggggcgcgagggacagcgggctagcgagcgcgcgccgggcggaaccaggaagcggggcgcgctccgggttgccagcggcgcgcgtccctgggcctccgcgcgtgagcggcgcgcgcgcccccgcgggccccggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgaggtaggagctgcggggcgagccctgggcccggggccgggggagccaggccggggagccagcccgggcggggcccgcgctccagccgctcagccgcccgtcagggccgcgccgccgccatcactcccgggccgcggtggttgcgcgctgggcgaggggcgcgcgcggggagagggggtccgggttggctgccggggaggctgagggcaatgcggggtgcgcgagggggacttgcgaacgccgcggcgccgcggggggcgtgcgctttaaaggctgcgtgcgcgtgtgctgagtgggtgtgtggggaccccgcgccgaccccataggagctcagggggctgctgtcagccgcctcacaccttcacgttgcaattccgaatatccccagccgtcttccttgctttaacttctttctttcaaaagaggttcccgggactccggggatgggatgagcctgcgggggtgcctggtgcggtggggggtattagcaaagcttcaagaaacagggccttataaggaatcaagacaacaaatacgaacgtttcgataagactctggggggcgggatcccacatcaggacccgccaggcctgggctcgtgcgtgtggccgtgggatgcagtgtgctttttctttctagtcagggataaagggttaaaagtgctcctggtgtcggggggtagatatggagagtcggaaggggagttgtatcacaaaagctggtctgaggctaaaggaatctggcaagatggtcggggtgaacaaagaggaaagaactcacacggagcaagaggcggttgcaaacacttgtagccagcagtgatggaaaagccaaagaagaaaaccaagtgtcagcttttagaaagacgggattaatgaaaagcacaagaattttaaagactaaaagagataccgattctctctttgccaaagagccagagtcagttcttttcttcttggtccctgtgatcccgccatacctcgtatcaaataaatagtgccaaaagtgggtcaaagaatgttagagctggaaaggaacccagcgatgatgccattcttttattgtacaaatgaggaaactgaggcccagataggtggagtaagtggcctgctcaggtgacacggctgtttgttgagtatccagggattgaaacttcaaggactctgagattcgtgctcttcccaaagcatcgtgcagtatacagatctttgcctagatacaattccatacattttctctgcagtgtcctcagggaatgccctttgaaagggccagcgtgacactgaatatcatacttgggcttatgtcatttttttcagtcttcaagtggtgtttatggtctgcttggatcttaggtttccaaagctgttggatagccgcctgggccataataagctttcagctgttgggtctacattatttcaaataattttgttatctttcaattaaggtaatagaactgtgcctctctccccaacattctattgttgtccatttgcttatgttatattgcgttatgttcattgcctgtgagttcctaggtgaggatgtattttattgagtgtgcctttcatgttttaaaatttcattttgtaacactgtaaatattggagtggttctgatcacttcaaatggggagaatcttattgattgattttattttaaggctttgggttgttttgtttattcatttgggtaccagtttccatctcatggaagatcacagttgttagaatggacatggctaaataagagaaggggctgctgattttaagaaaaacttcctatgtgacaatttgtggtatctgttacgtttaattcaaacaagtccacaccttgggtcaggtaagcgcgttatctaggagatgacttgtttgctactgtagcctctggaagatgaaatttcaagctccagattgagacacagggaaggaatggagaggttttttttttttttttttttttttttgtaaagcaaaccatcagaaaaaaaaagttgatttctatcaccagtagtttggttattgcataacttgaagctaaactctgcacaaaataatctttgctatatacccaactaggtaaactatcccaccttctcatcagttctcaccttttcggtgcttgtattttttgcccacgggatattaatatggattgtgttcagaaatttaaggtgtgtacttcatagtatgtatgattgtaggagaaaaatgtgctatcatcgtttggagtgttacaacataaatattttggtcaacacttcctatcctgctctgacttttcatctcatctccattttcttcctctcttgattgtttttatgtcatttacatatgtaaaagccacatcaagactaaagttgccatttattactttttgatacttaagtcgagttttttcaaatcatagtattgttagtattcaaattgtctgtaatttttgttaggcttatatattatgaatccatttgttgtggtttatttggcttgttgttatgtaggtaggtgacacaggtagtcttattgtaaaaggaagacgttatagataggtaaataacatgctcaagattagatgcaggttacaggtggaatcgaaggaagcctaactattttcgtgccctacaaaaatgtctgtatctcataaagttattcacagatttctggacattctatctgtgacacattttttccctttctgttaagagtgcagattactgcattattcctacaaaaggaagcaaaataaccctagtttgtatgatttttctgataatttgaaacttattcgtttaaaaagctatctggcaattccaggttactggactcttgagaagaatatccttttattttgatactataaaatatcaaagtatcaaaatactttaactgtgcaacttaataaaaataatgcttcaaagttagctctgcactatcgctgtcctcaaatgtgtggtatttaaaggaagaaaatgtttttaattctgagctttgtgaatagaactcttctaaaatcagaagtttttttttttctcctgcagtgttggaaacacaacagttttatgcttatttctgggaataagaaagtcaaacttaacaatctagtttccattgatcagacagtttttgtacttaaatttaagttctaagcatcagagtgataaatactttttaaaattgtattcactgttaattatagtggccttatttgaagtaaaatcttgacattgggtgttttattaatgatgatcctctgctactgaaaagcctatgtcagtttggagaagattttgcacatctaaatctatgctgtttttactaatcaaaagagaagagcaatttacaggtgttagatttttagttggttgaatgagaccctcacttttgatggtttcagagttgaagtgacgttttattacttttgttagtttgggtcacacccatcacttccttggaaggtatctttgaggtttggtttcctttttttttaaatggtaatattggggtgggggtgcttcctgtttgtattttcaaaattaggtccacatgttaaccttcttgtagtgtcacatttttattttaaacttatacagacaaacatcagatgccatgtggtttgtctctgaccctttgcgctacttcatgacagctttactgagtgaagcctgaatacccaatcgggaaggcaagatgttcttgtcttttcccaactctcttcaaagtttaacagccttggaaggagtcttagaacagcaacaaaagcacaatttacagaaaaatggaggtgctgctatctgtttcctcgcaggtacttggaaaatgtatagcactaagatagagttgaaacatgttatgtagagccttgaatgtcggtgcttcaaagaggagttgctctgggtttacatgatacagaaccccatggtttatattaagtagtaatgatagccgtttttctggactcgcttaaaagccatacacagtgtcatggaaaagagttaagaacaaggtgaaattcagggtatggtattagagctcaggaggaatcaccttcagccttaaaactcttcctttactctcctggatcacttaagtgataggtcacttttaatataaatgttgcaggatgagttaagtggagccttgagaaatatgtgtagattgtttcagtgattaaagcaagtgttcttttcctggcctttaactcgctttatgctaagaagtgtaataactaaatagactcctaattgaattgacattcagatgtgtttgcagtttagggggagtttacctcttctaaattttcatttggatcccattactaaaagcagtattgcattagcatggtgcacaattatgtacaattcaatttgcaaatgaagttaatacttggagtatcttgacttcctattcccctgctgccccaatattcaagaaaggagaagttataatttgtcacatacaagatggtttcttctttaggtttattcttaataactatgtccattttcacatggatgacaccactgagatgatgaatacctgtattgattgattgatgaagaacatttatctttttctacctacttttggaagctagcttgcaaaatctactgcaacattcactcttcatgtatccttctattacctttggtaccctgaataaccttttaaaaatttttgtacttttctaatatgaagagaagtagcttcatattctatgctagttttctgaggtgcttgtgctgactcattttttaaattatactaagatatagagcatggtttgagagcagtaatgagattctcagaaaatatgaaaactttcctttctgactagttagagaaaggttggggaagacaaggggaaatacatcaatgagccaatcaattattgttatttgttgggattaatttggtgactaatatttttaatgcccatcaggctactaaatgtgaatttggctttaccctgtaatgataacaggacaaacccaacgggtttctaacattgcttgttttcccctggtaggggatttctttgcatatgggaaatcaggccgaagttgccagtaacagccacatccatgatttgtattaaaaataactattcatcattctgggctagagctctgcttaccatggctcacctgggaagatattctgattatgtatctaatcattatgatgccacctttcgagaggtgagcagacaattaacaagtccttcaaattatgttcaaaacccagagtttgagaaaatgttccaacgccttcaagtgtgaagataataaaaacattacctaatgcttaccgttcactgacagtgtgctgggcagacattgttttcagctctggccttgtgttaactcgtgattctcagaggagtgggtattattcccagatggaagatgaagaaatggccacagagaagttaagtaatttgtccaaggtcacattactgttcttggcggggctgattccagagactgcatccctaactagtgtacagcaaaagcgagctggccactgccactttgttataagacattttgtttctttgaggcttgtatttctttgtgttcccaaatggagtctcgttggtttttgaatagaaaatatttttatatgtttaggatttttttaaatgttgatgaagatggtgataaatatttttccaattaaagtatatacttctggtggaaattatattaaagaagagaaagtcttaatttttattataagttgtctttcattcttcttcccctagcattaccgtgtacatcatagaagaagagctataagctgtctccttggcctctgtttacaaacaaagggatcatttgtgccaatgtagtgggtttgtgttgacatgcacgtctgtactgagaactcaacaatcccactcattttatttacaactttattttgcggggatttctgtcctattcttgttgcattaaagctttttagagcattagtcatgatttctgagacagatttaagaattttacttatttgggctaatttattattattatttcttgagacagagcctcgctctgtcacccaggctggaatgcagtggcgcgatcttggctcactgcaacctccgtctcctgggttcaagagattctcctgcccagcctccggagtagctaggactacaggcatgtgccaccatgcccagctaatttttgtatttttagtagagacggggttttgacatgttggccaggctggtctcgaactcctgacctcaggtgatcctcctgccttggccttccgaagtgctgggattacaggcataagccaccatgcccagcctatttgggcgaatttttaaggcaactgaactattgtatgtctagagctctgcaaaggccattagaaaatagtctcagatttttttttttttttcatttatgatgcttactttctctcagcacttttccttgggagtggattgtgaagttaagtcttggaaacagaattcacaaccctaaagcgtagtgctttaactttgggagatcaagtcacagacaagaagaacttcaattccctgtgcagagtataaacttgttcaaataaacagaggatgttagcttccaggattgtcaactgtcacctttgaccagggttgaattttctttgaatgttgacagaagttacaatgtcagtggaaaaagcttaatgtgaggtatctataactcagaatttccttatgtttgtgtcagtgagatcctacaattaaagctgcttctttttttctatgtctgatgagttttaaaagccttcactggggttttccagcctttaggtgagagtaagttaaaaagtttgtgagaaactattttttgttgtctaaaattcagagcctaggtcgggcccagtggctcacgcctgtaatcctaacaatttgggaggccgaggcaagcggatcacgtgaggtcaggagttggagaccagcctggccaacatggtgaaaccctgtctctactaaaaatacaaaaattagccaggtgtggtggtgcacgcctgtaatcccagctactcaggaggctgaggcagaagaatcacttgaacccaggaggcagaggttacagtgagccgagatcgcactactgtgctccagcctgggagacggagcgagactccatctcaaaaaaataaataaattaaataaattcagagcctatagctggtggcaagtcactgtttttgaaggagtgggattttaaaaaatctaacctgggctaaatgttaagttacattcatacatgtcattgtagcctatataaaaagaaacttgaacacttgatctcttaaagtactaaaaattggaattcatcagctttgtaatatagcattcattctacagtatatttaaataggtaaaatgttctgttagaaataatgctaattctgtttttttgtttaatgtttctaaaaatcttttggtcatcttttaggtttaggaaaagtagcaaattagagatctacagaaatctacagctctttaaaaatgaaacagttcaccctgtgaatttgtttgcaggattggtgatctgtttctgatgccaggaaggtgggactcctatctcatttctgatagaaagtgagggaaagctatgtatagtgagaactggatactagattcttattccgaaggcatggaaggtttaatatgtaaggatacaatgtaaatagtccctctttttgtatttttctttggttattgttacgtaactatagtcgtttgtcacttaatgatacatggtgacaaagttctaagaaatgcattaggcgattttgtcattgtggtaccatcatagagggtacttacacaaacgtagatggtgagccctactgcacacctaggctgtatgataaagcctattgctcctagactacaaacctgtggaacatgtatactgtattgagtactgtagacaattgtaacacaagggtaagtatttgtgtatctaaacatatctaaatatagaaaagttacagtaaaaacatggcataaaggataaaaaatggtacatctatatagggtacttaacaggaatggagcttgcaggactggaagttgctctgggcaactcagtgggtgaatggtgagtgaatgtgaaggcctaggacattactgtacattactgtagattttaaaaatactgtctggttaggctacattaaatgtattttgaaaattgtttctttcttcaataataaccttagcctactgtaatacttttactttgtaaactttttactttttttttttttttttgagatggagtcttgctcttgtggcccaggctggagtgcagtggcgtgatctcggatcactgcaacctctacctcccggttcaagcaattctccttcctcagcctcccgaatagctgggattacaggcgtgtgccaccacgcctggctaatttttgtatttttagtagagacggggtttcaccatgttggccaggctggtctcaaacttctgacctcaggtgatccacccactttgacctcccaaagtgctcggattataggtgtgagccgccgtgcccggccaactgtttacttttttacacttttaaactcttttgtagtaacacttagcttaacacataaacatgtacagctgtgcaacaatattttctttatgtttttattcttttactttttctctttttaaataatttttaatttttcaaaactttaaaaactttttaatttttcaaaactttaaaaactttttcttaaaagtgaaggcataaacacacacattagtctaggcctacacagggtcagggtcatcagtatcactgtcttgcacctccacatcttgttccactgaaaggtcttcaggggcagtaacacatatggagctgtcatctcttgtgataacaatgcctcctgaaggacctgcctgaggctgttttacagttaacttttttttttaagtagaaggagtacactctaaaataacgataaaaagtatggtaaatacataaaccagtaacataggcatttattatcattatcaagtatgtactgcacgcaattgtatgtgctagactttcacatgactggcagtgcagtgggtttgtttacaccagcattgccacaaacatgtgagtcatgcattgcattacaacattatgatggctacagcgtcactagaggataggaatttttcagctacgttttattatcttatgggaccacagtgatatatgtggtctgtcattgactgaaacgtcattatgtggtgcctgactacatatatggaaactctgagtgtagtcatgttttacaaatgagtttatcttgcagtgagtttaaatatcaagtaaaaatactaatttcattgtaatgtatgaagagattggcctttctcctcatgttgaaggtatcaaaacaaaatagaaaatatttggcttcctgagtggcatggctacaattcacatgctgagttggtgatgaggcaagatcccttgactttgcaataccagaaaaatgcacatagttaaaaaaaaatagagacaggggtcttgctatgtctccaggtgatccctcccacctccacctccacacctcccacctcaaccttccacagtattgggattacaggaatgagtcactgcaccgggccaaaaagcatataattttaagggaatgatttttttttttttttttttattttttgagacagtgtcttgctctgttgcccaggatgagtgaagtgtgccaggagtgggtccttaagtaagaaaacgtattactttagacacacatttaaaattttgtccaaaaatgtgatattctcaaaatttatggttttgaattttatttattattttaatttattattattattttttaaagagtggggtctcactatgttgcccgggctggtctcaaagtcctgagctcaagtgatcctcccacctcagcctccagagtagatgggactgcaggtgtgagcccctgagcctggctagttttgaatttttattacccaaatgtgaagaggtctagtttgcacagaacttaacattacattccagttttattggtaaatttgaacaggatataagtggctttaataactaataaaagaagatacatcttatagatacacatatgtctttttatatgtatacataaatatttaaaacttctttatgccaaaaaatgccagaaaccaaagctaagtgacaaaataagaaaaatatttctaatatatatgacaaagcattatgggtaaatattcgtaatatataagtaatctatataagtagtaagaaaaagatgattcccataatagaaaatgaacaaaagaagaactacaaatagccgataatcatatgaaacagtgttcacccatactggaaatcaagaaatgcaaataaaaatgacaagttttttcagttaacagatttatgaagactaaaaatattgaaaaataagagcagtgttgcttgggaatgtgggaaactggcactttcatactcattggttgaaatgtaaatgggtgctttttttggatggcagtttgatacatgtattgagagcttaaaagagtgcatactcaagctgggcatgggagctcaggcctgtaatcccagcactttgggaagctaaggcagtcggatcacgaggtcaggagttcaagaccatcccggccaacatggtgaaaccccgtctctactaaaaatacaaaaattagctgggcatggtggcacgtgcctgtaatcccagctactcgggaggctgaggcagggagtcagaggttgctgtgagccgagatcacactactgcactccagcctggtgacagagcgagacttcgtctcaaaaaaaaaaaagaagagtacataccctttgacttagcagtttcatttagatgaatttcattctaggacatctgaaatatgtttaaagatttgtacaaataggcatgggcaaggacttcatgtctaaaacaccaaaagcgatggcaacaaaagacaaaattgacaaatgggatctaattagactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcagtattcacaatagcaaagacttggaaccaacccagatgtccaacaacgatagactggattaagaaaatgtggcacatacacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaataatgggaacacatggacacaggaaggggaacatcacactctggggactgttgtggggtggggggaggggggagggatagcattgggagatatacctaatgccagatgacgagttagtgggtgcagcacaccagcatggcacatgtatacgtatgtaactaacctgcacaatgtgcacatgtaccctaaaacttaaagtataataataaataaattaaaaaaaaaagatttgtacaaaaggagtgttacttaaaatagcaataaattggaaaaatcttggtatttccattagaggtttaataaactaaatcatttattacacctgtgtatagctgtccaatagaatactgtccagctatttaaattatgttataaaacaatatttaatgacctacacaaaattcactatatattactaaatgaaaaatgaaattacaaacaatcatatacaattgtgccggaaaaaagaacaggcgctgaaaaaagatttcttctgggtcgtggagttccctgtgtgtgtgtgtgtgtgtgtgtgtgtgtgtgtgtgtgtgcgcgctttctagtatctttccatttttctataataaacagattatggctgggcacagtgactcatgcctatatttccagcactttgggaggctgaggtgggaggatcacttgagtccaggagttcaagatcagcctgggcaacatagcaagaccctatctctacaaaaaattaaaaaattagctgggcctggtggcacatgcctgtggtctcaactacttgggaagatgaagtaggaggatcacttgagcctgggagttcgaggctgcaatgagctgtgattgagccactgcattcgtcctgggtgacagagtgagaccttgtctcaaaaacaacaaataaaaacaaacaaaaaaacagatgataatacagggaatccttttgtaatcaggaaaaaaaagttatctttaaaatggctgtgtgtattgatatgtcttagaacgtagaatttgttttttgttatcagtgttttctttttagaagcagaaaaaagagtttgtgatgtttttgttaattttttggtatagtatcctgttttttgacatcttttgttgaactatgttaaaatcatcataatttcatttaacatttttagagtttaaataatttgaacttcaggactgtgttatttcctgtgcttcgtggtagcctgtatatttttacacagaagcttatggagaattatattgttatataatataataaattgttagggagacagaggtgaaaggattgcttgaacctgggaagtggaggctgcagtgagctataatggtgccattgcactccccaagcccgggcaatggacagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctctataaaaatacaaaaattagctagacgtggtggtgtgtgcctgtagtcccagctacttgggagcctgaggtgggaggatggcttgagcccaggaggcagaggttacagtgagctgagattgcaccactgcactccagcctgggtgacagagtgagaccctgtctcaaaaataaataaataaaaataaaaaataaaaaatctatcttaacttggattgtgcattgtaatttattatagtgaaattgctataacagaattttattttaagccagtttggggaataccaaaacatttttaaaaatcacgtagtactttttagtgcttttaaaacctaaatccataaagtagttaattaaaatgcatgaagtaaataagtgtttttctgtattaaagataaaactataaacatatattgttcaatatgcctacataaataaatcattctcttctttttggttattttttgcttatcacctcttacctcctctacttcctaaaaacatgataatctcgtttaattcaaaattatgttttctggccatacatggtggattatgcctgtaatcctaacactttgggaggctgaggtgggcggaccacttgagtcaggaggtcgagaccagcctggcccgcttggtgagaccctgtctctactaaaaatacaaaaattagccgggcgtggtggcacatgtctgtagtctcaggaggctgaggcaggagaatcatttgaacacaggtggcagatgttgcagtgagctgagattgcaccactgcacttcagcctcggcgacaaaatgagactctgtctcaagaaaaaaaaaaaaaaggtaagacatataaactaggaaactaagcaataattgtgtacagtatgtggaatatttatgttctagaccagcactgttcaatacaaatataatgtgagctccaattgtaattttcttagtctgtatcacaataaaaagtaaaaataaaattaattttaacaatatactttaatatataaaaattatcatttcaacatttgatcaatataaaaattattgattaatgaggtattttgggccagtttggggagccaaagcaggaggatcacttgagtccaggagttcgagaccagcctgggcaacatagtgagacccagtctctaacaacaacaacaacaaaattagctaggcatggtgatgtgcacctatagtcccagctacttgggaggccaaggtgggaggatcacttgagccgaggaggttaaggctgcagtgagtcgtgttcgtgctactgcattccagcctgggcaacagagtgagaccctgtctcaaaaaaaaacaaacgaacccaaaagcccacaaaaacactgagatattttacattcctttttttgtacgaatgcttcaaaatctggtgtgtatcttacagttataaaatctctcaatttagccaccaaattttcaccagaaatgcatgaactgtgttcagatttcataaaactttcagttgataaagtagattcacatactgaaggtgttccaaacgtactgaaaggttttccaagtattaaattgaacaccagtttccaggtttacatttaagttaattcaaatgagataaaatttgcaattcagttccccagtcgcactagctacatttcaagtgcttaggtagcacatgctgctagaggctaccataataaacagtgtggctataggccttctaacgaagggaaatgaaatatagggctgtctcctgctttataacatctggcttacaatcaacaaatacaaatagggtcgcttggtgcagcaaaccaccatggcacatgtttacctgtgtaacaaatctgcacatcctgcacatgtatcctggaacttaaaataaaacaaaacaaatagggtctcttgccctgtgggaactgaagccactgctctgtaggaaataaaagtgtctttcttttttgttttttttttgagacagaatctcgctattttgccgagtgaagtggcatgatcttggctcactgaagcctccccccgacaggttcaagcaattctcctgcctcagcctcccaagtagctgggattacaggcacctgccaccacgcccggctaatttttgtatttttagtagatacggggtttcgctgtgttggccaggctggtctcaaactcctgacctcaggtgatccacccaccttggccttccaaactgttaggattacaggcgtgagccaccgcgcccagcacaaaagtgtctcttacctaaagaaagtgatgcccttaaagcttcctaccattccctcacccccaagacacacccagacacccacagatgcaccctcttgtttgaaaactgctgcatccttgcatggctgaagcattacccatgtccttgaagctcctgctttcagaggacctctcatttcttgggagtagaaaagccctctctggccaggtgcagtggctcacgcctgtaatcccaacactttgggaggccaaggtgggaggatcgcttgagcccaagagtttcaagtcagcctgggcaacatagtgagatcccatctctgaaaacaaaattctgaataaaaataaacagcccaccctgtttcaggtatacctcaactgtcaaatcacttttaggcagggtgttttgttatttttgttttgtttcagagtgttgtttaactttatttttgaaactgaatttgtctagaaaagaatcatattcaccttttggtcttagctactcttcatttttataaaatacatcaagttgatgcttaaaattggggatctagttacagatgaaatttttcctttcaaaagagagttccccccagttttgctgtagtcttaggagatacttaagggaggggaatcatttttagttccccctaggtgaggtggtagcctccctaaactgccaagttcacaccatgactggtaacaccactgtgtgaggaatactgaacaaacggagcttcagaagggagacttgcagagattctggaatctaggtaatgccacttcctacttagtttatcttaatggttttgtttgtttgtttgttttgagacggagtctcgctctgtttcccaggctggagtgcaatggcgtgatctcagatcactgcaacctccgtctcccaggttcaagtgattctcgtgcctcagcctcccagatagctgggattacaggcaagttccaccatgcccagctaatttttgtatttttagtagagacagggtttcaccatgttcgtcaggctggtctcaaactcctgacctcaggtgatccttccgcttcagcctcccaaagtgctgggattacaggcataagctaccgtgcccagccttaatggtctttttaaaggatacctgatttcagaaggaacctttgaagaaatggctagaacttctgtgtttctttggatattgcctgacatctaagccaaattagttgaccttttaatgttaaataaaatattcaataacttttactaatgggtgggctttaggaacccctttattttactatgttgccaaaagtaggttcattataacattggaaacatcctgatgtaatttattgaatgtaaaattattcctcaatacatttgaggatgatttccataaagggaaacaaattcctttcttccaaatatactgtgacagcctattttgaaatatttaaaatatgtccctaaagatgaaaattaaagagcggacacaaagttgttatgctctaaggagtcattcttttgatttaaaattcattataattccctggttgtctagtggttaggattcagcactctcataaaattcattatattgattctataaaagtatattgtgttggattaagaaacacatggacatttttaagtgtttcaaaatatttttgttatacctaggttttcactgtggtggtatttgttgttttagtagaatttgacctatattttattctatgggaaaaagaagaaagtaaacattggctagctatctaccaccctgtactgctatttgtgtgtggtcccattgtgaatttttaactccatgctctatatttttagtgctttgtgaagattgaatctgcaaatcacctttgaaagacaaaggatttgatttgattgtggcaatcatgaaagttatcctgtaaataaaactgtatgtcctggaccaaagctggaataatgccacactgaaatgatcttaactgtggaatccttgattggacccgatttgttttgcacatacaatagctccataaagatgataggctttcagcagggatgaacagatgttctggttttatcagaaattgcttttgcatcaccaagacttcacaaaagccagtaatccccctgtttgatgttgtggaggtgcttttaaaacttcttcccagatactggtttgaacacacagactttgtcattgacctgtaagattcaattgtcaggtggtatctgttttctcccaacagaaataaagagaagaagaataaaaacaaaaactagaaagtgtagcaggggcacaattatttatttaaactttaaagtatttaatattacataccagaatctaagttacataaagcatgtctgttttgttcactgccacattcttagtacctagaacagagcccaacatgtaatagttactcaataagtatctgttaaataagtatagtagtcctgccttatcccaagggatgcctgaaacctcaggtaatactgaaccctacatatatatattgttttttcctatgcatatataattatgataaagttcaatttataaattaggcacagtaagagattaagaacaatgataataaaatagaacaagtatgtagtctttttttttttttttttttttttttttgagacagagtctcgctctgtcacccaggctggagtgcagtggcgcaatctccgttcactgcacgctctgcttcctgggttcatgccattctcctgcctcagcctccccagtagctgggactacaggcatctgccaccacacccggctaattttttgtattttgtttagtagagacggggtttcaccatgttagccaggatggtctcgatctcctaacctcgtgacctgctcgcctcagcctcccaaaatgctgggattacaggcgtgagccactgtgcctggccgaatgtagtctatcttaaaatactgtatcttactatgctgtactgtgggtaacagaaaccatagaaaacaaaatctcagataaggaaagactattgtattcccctttaatctcaatacagcaggtgtatccagagaacttcaaccctcagaaggactgaaagtgtgccttttactgtggaagaaagaaaagagagggggctgggtgcagtggctcatgcctataatcccagtactatgggaggctgagccaggagggtcacttgagcccatgagttagagaccagcctgggccacagagtgagacgctgtctcaaaaaaagttggggggatgggggagaagagagaggagacagcaaatatctctttgtttcctttggatttcagcattaaagatagaaaaaatgtgagtttattaggcaaaaactggttttttaaccccattttaaagattgtggagttacgtatatatatcataaaatttaccatttttaaccttttattttgagatggagtttctctgtgtcacccaggctggaggttagctcattgcaaccttcacctcctggattcaagcaattctcctgcctcagcctcctgagtagctgggattacaggtgcacgccaccatgcctggctaattttggtatttttagtagaggtggggtttcaccatgttaaccagggtggtctggaactcctgaccttaggtgaaccgccctcggcctcccaaagtgctgggattacaggcgcgagccgctgtgcccggccattttcactgttttaaagtacagttccgtggcattaagcacattcacattgttgtgtgaccgtcagcacctggtccatctccagaattttttcatcctaaactaaaatcctgtattcattaaacagtaatgagaataaaactctccatttgcccctccccgcaggctctgacaaccgccattcattctttctgtctctatgagtttgactactccaggcatcttatatcagtggaatcatacactatctgcccctttgtgtttattcctttttttgcaacataattcttttggttggagacttcacagtttttctttcctttgattgtttagtttttgctttgtacctagacctggccagtgatgcatgtgcaatgagtatgcaaagacaagttaattcagcagcttgttgcataccactagggagttattaaagctttcaaaatgtgattcctcatctgtatgcctgtggcttatctactccaagtcttgctgataaacctgcactgagagtaatagcaaagattagtctttctccatgtttcataaaacaaattgttctcattcttacagcctgattatgaactggaaaattacaggtacattgttgtaattgtttatacagacaatgagacatactctccacaggggacctcagctgcaggggaggttctgattgcgtgtcattaagaaacgacagttaagaaacttttttttttttagacggagtctcgctccattgccaggctggagtgcagtggcacgatctcggctccctgcaacctctgcctcctgggttcaagtggttctcctgcctcagcctcccaagtagctgggactacaggcgcatgccaccacacccagctaatttttgtattttttgtagagacagggtttcaccatgttggccaggatggtctcaatctcctgacctcgtgatccgcctgcctaggcctcccaaagtgttgggattacaggcatgagccaccgcaccgaccttctttttttttccatttttaaaaattttctattctcattacatcttcctttctccctacttttccttcccttcccttccagtttgtccttccctctctctctttcttccttttttctttctttttcattctcatttttctgagtagttgctgaagacacagcctgaccctaggggtccaaatatagatgaaacaatcatagctctctagcagttcacctggagggagagagaaaaagagagtaagagaaccaaaatgaaggggaaatattcttaatttttttttttttaaggacagaaactaacttgttgaggaaaaagagaaatatactgggagttctgactgataggaacaaagagaggacagcttcgaaggatgatttgaaaagtaatctatggaatttagctttaaagcaggatcttgggctgtagactactttattattattattttttaagagacagagtgcagtggtgcagtcatggctcactgtagcctcaaactcctgggctcaagccatcctcccacctcagccttctgagtagctaggattacaggtacataccagcacgcctggctaattttttaatttttattttgtagagatgaggtcttgctgtgttgcccaggctggtcttgaactcctggcctcaagtgatcctcctgcctcagcatcccaaagtgctgggatgttgtggactcctttagagcctcttgaaatagggctagtaaagtgattttctaccactgtatctgtgctcatttacattgggcagatcacttctgcttgacttcatagtttcaacctataacatgaggggtcaacaggtagattcggaaccatcagagtttaggccgaagcccatagaatatgaaagttatttttaaaatttatttttacaatgtctacaaatgcagttgttaaagtgccagagacagaagtattgacaatgagaaattatccaaaaccaggccaggcgcggtgactcacgcctgtaatcccagcactttgggaggcaaaggtggcaagatgacttgaggccaggagtcacaggctgcaatgagttgtgttcatgccactgctctccagtctgggccacagaacaagaccctgtctctaaaaataatcatcatcatccaaaaccaagactggctcctattggaaaggtggaaatggttgtgatggaattcagcaacaccaataccttggtatttctgactttcaggatgttaggagactctttcagtccttcctgtttaaatatgaatggatatgtattgccattattgccctgcccctacatctcccaaatttagattgctagtatttatgtaagtttactagtcacaaatagattcttgcatttcccatctcttgtcatagggccctctttgagttcaatatgcttttattggcacttactttggttttctttacagcagcagctgctaattagtgacagcttttgagcaagcagcttgtcatttttggcagagataggggacatccatagcaagtcaagactatattttcatttgctaaatttactttgctacatggaaatacatcttggataaaaaatagtctgtagtcaaaggtggctgtgtttactgaattatcttcctgagttggcattctgtcctgtagttgaagaactcacagagatgaaaaaaagaaagaaagaaagaaagaaagaaagaaaggttcaacgtctatcagactgatgccataagtcctgagtcatccttctaacattaatctacattctgggtatagaacctcatcatcttgttttggcacaatcataaatctttctggattgtagttagtggcatacatggtaactgaatgagtgaattgttgacaaatgtgcttttcgtttatactcagcttctttcttgagatataattaaaagaaaggttagtttgcttagagaagatcctttctttggaattttagctcatcttagcatcatcatatttcatgtaattcttctctttgaaattgctgcaataaagtgttagctctattttacaaacttgtcacgatgtttatgagggtggcacaacttgctattatgtttaccttgattagcaccaatgatgagtcaaaacctccgtcatggtttctataaagtgtgattcactcccattattcctgtaataaggattcagattaatgacctccacagtgttaaaaatatcctgaaggaaataactgacctaccatccatttcccccaatttaggtcctttttgtaacatggaggtctataaaaattgtattcaatacacaattactaaataccaaccatgtatatcaagtactatattggggaaatcaaaatgaatcagagagacatggtccttgctccaggatggcttacagtctattagttggccagcagataacttagttgccttggttcttatgtccagagtgtagggtaaattctaattctagaggaggaaaacatcccatcttttaaaaataagattatcaaaatgatcaaagacattggatacaaatattgtactgattctatttctacctaaaggtgttaaagattgtttgaggcacttttcctaggcttgtggaactgccaggcatccttgtcccaaatttccccttgatatatcgcacagcactgttaaattcagaagttgccttctgtatcagagtgtctatttcttgatggcatagcttggagaacccagatgatcttctagcattcaactcatacttaatgtacatcaacagtaacatagttatttgtatattttcttttctttttttctttttttttttttttgagacggagccttgctctgtcacccaggctggaatgcagtggcacgatctcggctcactgcaacctccacctcctgggttcgagccattctcctgcctcagcctccccagtagctgggattacaggcacgcatcaccacgcccagctaattttttgtatttttagtagagacggggtttcaccatgctggccagtctggtcttgagctcctgaccttgtgattcgcctaccttggcctcccaaagtgctgagattacaggtgtgagccaccgcacccaatctatttgtatattttcatttgaacatttattaattatagtaggaatttatcatgtataccttgtctccaacccaatgcacagtagcatcaggtaagttgctgtttagttataggtatcatgtgaacaggtatccagatggcagctaacttcagtatcctttgttatcctgtcttacacactggggtgttttacaagttgctttctcatttctattaatgacatttccccctgtatgtaaaatgttttctgccattagaaagcctaagtttcagatgttctgtgataaatattggtgatggataataatgtaactaatggaagccccttaaggaatttgcgaacaagtttaacaaagttaacaactcagcttcttataggaaatgttgcattgctaattctgaccacaagtggtcaggatctaggttttggccttatgggaaagttacccaagcccaggacagttctcgttattctcctcccactcacttttacaatctaaagcttttggctaatttctgattgatttaaaagaatgaaggtgaacccccaccccccaaatatggcatcctttggttgtgcttgaaggtttgtcttcttagtgctaaccctcagggaagggagtcttatttaaagcctttttttttggattgtcaaataatctttttgtattcatttgtgaattgcattttatgataattcattttgtggctcgtgttataaaggagttaaactgcaggtatcactgtcaggagaaactcatttgactagctgatgatttttttttttttttttttgagacagagtttccctctatcacccaggctggagtgcagtggcatgatctccactcactgcatcctccgcctcctaggttcaagtgattctcctgcctcagcctcccgagtagctgggactacaggtgcctgccaccacgcctggctaattttttgtatttttagtagagatggggtttcaccatgctagccaggatggtctcgatctcctgacctcatgatccgcccgccttggcctcctaaagtgctgggattacaggcatgagccaccgcgcccggcctcgtgatgattttcaataagtaaaccactgtggttcacagcctgagctccgaaggtggacaaaactccttgaatatttattactactactgttattataattctattactactgctgctagtactttatttttctcatttcccatgcttattcctttgctattatttaaggtttggtgatgaagtataggaagggcttggaaatgaagtcatttattttgtttccaacacaaaacagtttctagtgtgggtgtgtgggtggcttaatttaacataacaaactaatacgtttttccttgaactccatactatcttcatttcaaactaggtattctcagagtggggttaaaatactctccatcatcaaagcccagacattttagaacaagagcttgtctcacaaaaagcctggtgtctctgttgccaccacaacctgaaactaacgagttagaaaccacatagagccaacgacatggggtaggagctcgtaacattttctcgcaagttttgtgtagatagttaagccgggaaccgatctggttgagaaaaatgtttaaaatcatcattttcccttccttctccttcacttttatactcaaaagggtctaattttgctcctctgggaagattgaatgcgtaggctttcatgtagtttaacactctcttaatttaaagaagtctgggtttggtgcagtggctcacgcctgtcatcccagcactttggagggccgaggtgggtggagcgcttgagttcaagagttcgagaccagcctgggcaacataatgaagccccgtttctactaaaaatacaaaaaatgagccaggcatagtggcacacacctgtggtcccagctactcaggagactgagacaagaggattgctagagcctgggaggcagaggttgcagggagctgagatcacgccactgcactccagcatgggtgacagggtgagaccctgtctcaaaaaaaaaaattatattttctatcctcttcccctttttgttatgtgttttacagtcttttctccatgtctaatctaagaaacttatatattcattgtatatatatctactggttgtcagcattgaaccttgcctgtgccctagcatgttgcagaatgactgacttgactttattttgagaataagttcaaaatttattctttttttatcagttgactagggaccttatctgttgttgcatttattatctctaaaataccatcttctttttctttttattttttttgagatagagtctcactctgttgcccaggctggagtgcagtggtgcaatcttggctctctgctacctccacctcccaggttcaagcaattctcctgcctcagcctcccgagtagctgggattacagtcacgcgccaccacacccagctaattttgtatatttttggtagagacggggtttcaccatgctagccagactggtctcaaactcctgacctcaagtgatccactggccttggcctcccaaagtgctgggattacaggcctgagccacctcacccagcctaccatcttatttttagatggagacttctggacattggtataaaatctggatggttccagtcctgaccttttcttcatgtttaatctcaccttcctaacacttccaccacgttgaaaaagcgtagctccatatgatcttactgcccttcgttcagtcaagcgagacactgacattgtgtagattctgggtctcacatttgctttgtttttatctggagctttactggaaactaaatgctattgcgtactagctgcagaagcaggaggggaagttggcaagaattcgctgctttctgtttggtctgtctgaggcagctgaccttttggaaggaaatcgctgctcttcgcttcttccggtaacagtgccgcctgtgaaagaacacatacacagaagggctctgccgttatcctggctgatgccttgcagcataagctgttagttaagaggtgggagcctttcagtgcatctgttgtgtgctgtaggagcatgcactcaagttcctacaccatgctaagttgtgtgtagatctactattagaggtatagtgagagacggtctgttaccagaaaaagtaggttgctttagcaaaagtaattgcattttatttactcccactatgagtgctgtagtaaatgtggacaattattttgtgcacaattttagttcatcttaatgttaaatgtcctggtaattgctttttatacctggataaccgttgttgttttttttttttccccagcaggacaaacattttgatttgctaagacatgagctcttattaaatgtcatttcttctcagaattagaataagatttttttttttttttttttttttggacaagatcttacaatgtcacccaggctggagtgcagcgacacaatcacggctcacagcagcctcaaactcctgggcttaagcagttcttctgcctgtctcctgagtagctagaactacaggcatgcgccaccacactgggctaatttgtaaattttttgtagagatggagtctcactatgtcgcctaggcttgtttcaaactcctggcctaatcagtcttcccatctcggcctcccagagtgctgggtttacaggcatgagccactgtgcctggcccagaattatcttcttctttttctcatacattttttttttttttagagaatgagtctggctctgtcatccatctggcatgcagtggcgcaatcatagttcactgcagctactaactcctaggctcaagtgattctcccacctcatcctcccaagtaactaagactacaggtgtgcgccaccacacgctactactttttgttttgctttctttgtaaagacagagccttgatatgttgcccaagctggtcttgaactcctgagctcaggtgatcctcctgcctcagcctcccaaagtgctgagattacaggtgtgagccactacacctggccaagatttagcttcttaacaaacctgctactcgttggatccactttttctgcaggacttgttttacttaaacacaggtagtaggacaccccacaacttgggattatttttggaaagctgtagttgggtttcatatcacccagtaagcaaacaagggaactaaccagctgatgaagcgtttctctcttaaaagaggagatttcagttttgtattgttttaactaaaacatattcagttcagtttttattttgttatttgaaatgacatattcaagttatgtctaagtaaaaatgaaacattttaattcatggcaaattaagagaacacagctacctggaaaacggggcaaactgccatatccttctgtatttagttttggttcggtggataggtgtgcttttctaaggtattattggtctcttccctagatttgctgttgatggcagagatggttgggtgaaggtttgtgttgatgtacataaaagacatagagattagtacagagagaaacatctcagggcccccttagcaagattgccctgcagtgcttctgttcttggaaactggtctgatctgttccactttcctggggtaatgaagaatccagggggaatacaaaccctgcgttggttttaggtataggttcttggcacaaaataaattgatatcaacaaaacaggaagatttctccccggttctgttggcctttgagtaggagcgaagttaggaaccaacagctgaggtttcctgtgatctgctcttgtaatgatagctttctagacaccttgaattgttactcttgaactgtcaacggccttcacgtaagccagttgtgttcaggtatgtgattagaggtaagggatgtgtttgtttgtgtttagaaatggggtctcactttgtggctcaggcttgagcatagcggcgtgatcatagctcactgcagccttgacctcctgggagcgctcctgtctcagcctcctgagtagcttggactgcagaagtgagtcaccatgcccagctagaaagttttttattttaaagaaattctggtaccgttgtgagtgactttctgtgtatttcgttctatttacagttggtacaagtttgcttagtcacatcaaagatgaaagagggccactaatatatataaatatatgtcagaattacaaattaatctgctattaacagtcttaaatcactatttgaaaacacatttaaggcactatatatttgaaagtgaaagaattgcattttaaaaaaaatttttttataattctgaatttttactttataattctgaatgttctacttaaaattaaaatttttttataattctgaatttttactttataattctgaatgttctacttaaatcaaggctgcccaggtaagacagtgtcataacctggatattatcatgttaggaaatatttcttcctgtgttttatgtctctttaaacttggttcctgtgggatagtcagtagtaccaattccccattgattattaaatttatatcttaagttttacattttaaacacaatttaatcaaaaactttacaaaaattgtaccaaaaagccccttcacctaaatgtaacaactgtttacacttctctttgacctttctctatttgccctcttgcatacgtgttgcatacacttttcatttaacattcttttatttctactctaaaaaaatgtgtctacaggccaggtgtgatggctcacatctgtaatcccagcagtttgggaggccgaggtgggaggatcacaaggccaagagttggacaccaggctggccaacatggtgaaaccccatctctactaaaaatacaaaaattagggctgggcggggtggctcacgcctgtaattccagcactttgggaggccgaggtgggcagatcacccgaggtcaggagttcgaaaccagcctggccaacatggtgaaaacccgtctctattaaaaatacaaaaaattagccgggcatggtggtgggcacctgtaatcccagctactcgggaggctgaggcaggagaattgcttgaacctggggggcggaggttgcagtgagccaagatcgcgccattacactccagcctgggcaataagagcaaaactccgtctcaaaaaaataaaaataaaaaattagccaggcattggtggcagatgcctatggtcccagctgctcaggaggctgagacaagagaattgcatgaacgcgagaggtgggggttgcagtgagccaagatcatgccactgcactttaaccctgttgaaagagcaagactcagccaggcgcggtagctcacgcctgtaattccagcactttgggaggccaaggtgggcggatcacaaggtcatgaggtcgagaccatcttggccaacatggtgaaaccctgtctctactaaaactacaaaaattagctgggcatggtggcgcgtgcctgtagtcccagctattcgggaggctgaggcaggagaatcgcttgaacctgggaggcagaggttgcagtgagccgagatcgcgccactgcactccaacctgggtgacagagtgagactccatctcaaaaaaaaaaaaaaaaaaaaaattagccaggcattggtggcagatgcctatctatggtcccagctgctcaggaggctgagacaagagaattggttgaacacgagcggtgggggttgcagtgagccaagattgtgccactgcactttaacccggttgaaagagcaagactctgtctcaaaaaaataaataaataaaataaaaatttaaaaatgcgtctacatggtttttatatttcaacatagcttttatatttcatttaactggttgcaccatatcccattagattaatacattatagtctaatcatccccctattttggacattttggttatttctgtttgtcccgacggtatatatccctgggaattggcctgaatcaaggcacttgtcaaagaaaattttgctaggtagaaactaaacactgtaattctcaatggtaagagggaggccatgaactttaatagggaaaatattggtaacatgtgtggatttattaataaattgcctgttttgtttgtttttaactttcaaacaagaggaaagggattatatttcatttaagcagtatagaaacagggtattgtagtagctgaggagtttttttcctgaactaaaagatttgaattgtccaagagacagattctaagatgagttgatcttgaattacagtacaaatataaaccttcactagaaattctgaggctggctgggtgtggtggctcacacttgtcatcccagcactttgggaggccgaggtaagaggatcacttgagcccaggagttcatgaccagcctgggcaacatagcaagaccccatctctaaaaaaaaaaaaaaaaaaattagccgggcatggtggcacacacctgtggtcccagctactcagggggctaagggaggaggatcacctgaacccaggaggttgagactgcagtgagcagtgattacgccatagcacttcagcctgagtgacagagtgagaccctgtctcaaaaaaaaaaaaagaaaagaaaagaaagaaaaaaattctgaaggtaagataggactacatggcagcttcaaatcatttcttatttttccgtaatgcagatggtcattaattttgggctacagcaagtgcttttagtcatctggaaagtgatacagatgtagcttcttcccaaagggatcgcaaatccattatctccatggatttggacatggagataatgataacacatgtacactgtgggccaccatggcacaagagagcccaacttgcatgctggtggcctgcaagctgcagcacaacgcctaagaagtccagatttttattgaccaccagggacagtttcaaagtgagagtcaaacctctgctttcattgctttgtttttcttttttggaatgtttgcccttcattttgattttgaaaaaagtgtacatgacttaaaagtggaaagaatagaacaatgagtactcgcatatacttcacctaggttgagccagtgttcacagttgttagatttactttcccacactccccaccactgtcactcttccgtttctcctgccaaagtaagatgcagacgacatggccatttaccctcaaatacttgacagtgtatctactcccagcaagggcattcttctacgcaacctgaatgccattgtcactctcaagaaatttagcagtgataaagtaatatctaatatataatgatataatggcctttagagctgtgggtgtttttgtttgttttgagacagagtctcactcagttgcccagcctggagtgcaagtggcgcaatctcagctcaccacaacctctgcctcccgggttcaagagattcttgtgcctcagccttcagagtagctgcaactacaggcgtgtgccaccacgcccaactaatttttatattttttttttatttattttttttaagtataaacacatatattttttaaagtttatttttaacattttttttttttaattgatcattcttgggtgtttctcgcagagggggatttggcagggtcacaggacaatagtggagggaaggtcagcagataaacaagtgaacaaaggtctctggttttcctaggcagagggaccctgtggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtacaatttttgtatttttagtagagacagggtttcaccatgttggccaggctggtctcgaatgcttgaccttgagtgatcctctgggcttggcctcccaaagtgctgggattacaggcatgagccaccacacccagtcgtgtttttgtttttgaattacgctcttggttgtgtctcttcagtctcctttaacctagaacagttccacctgttttgggtggggggtgggatcattgattagagtctcacaatttggatttgtctgattgtttcttcatgatttagtttgtgtattcttttcagcaaatcatatctggaggcacataatgtcagtttatgccatgattggggatgtttgatcactcggttaaggcattgtccgccagatttatccacagaaatgcaccttttcccctttgaataataagtaatatgtgagtagtactttgagactaaatgctgttccccaacaactgtcacctaatggttttagtagctgtgatgatccttgtctgagtctactctctttatttttgagattgtgcatctttggccaagactttatatcctatatttagatgagagttttaaatatatagtaacctgctgattgaaacctgatttttatatttagtaagtagatcctttctctaccttctcctttattccctcccttacccttttcccctcctccattctctgttcttcctattgtaatatgcagtgatttggctgtgacataaagattaatggcggattgtcttcccagaatactatcatctctatgttgcctgggcacatttttccttgtttgcttctttgtgagccaaatgcttttattctttctgttctcttcccatctgtttaataatgtgattttttaaaaagagaattggcttcctgattgcatatagggtagtatttagaaaaaaaaaattaaagagcagatggctctggtattaacctgcttctagatgtgatagccttcttacttgatattagtccaattttaatatgaatgaagtcttaatcctttattgctgctattgaatatttttccgtccctcaaaatcgctatactaggctaggcatggtggctcaggcctgtaatcccaacactttgggaggccgaggtgggtggatcacttgaggtcaggagttcaagaccagcctggccaacatggtaaaaccctgcctctactaaaaatccaaaaattagccagacacagtggcacatgcctgtaattccagctactcaggaggctaaggcaggagaatctcttgaacccgggaggcagaggttgcagtgagccaagatcatgccactgcactccagcctgggtgacagagcaagactctgtctcaaaaaaaaaaaaaaattgctgtactaggtgaccaccaccatttaatatatttaataatgttggtatcaacagaaagcagtaaacataattagggaatttgctcttttttttttttttttgagatggagttacactcttgttgatccatcagcacaactggagtgcaatggtgcgatctcagctcaccgcaacttctacctcccaggttcaagcgattctcctgcctcagcatcccaagtagctgggattacaggcatgcaccaccacgcctggctaattttttgtatttttagtagagacagggtttctgcatgttggtcaggctggtcttgaactcccaacctcaggtgatctgcccgcctctgcctcacaaagtatgggattacaagcatgagccaccacgcctggctggaacttgctctttatattctgtacagaatccttagtcattcactggagctgataggtttaacagttttgaaccctggctccttgccttgtacttttcagatcagaagcaatgtttaaacgtcatctctttgatctgtcacccagccctagcctttgccaaaatcagagcccctcagtattaggtttcttactttaatttttcattctttgctctctttaaattatgaaatataacaaacaggcagaaaagtacatagaaaatggcaaaccaccttaagtcctcaacatgcatgcagcctggtgcagtggtgcaagtaagtgcaggttctcaggtaggtccagcccagatagtaccccttagtagtatggaccgaccctggagcaagtgtttcacctctttctctttttaaaaatagctttactgagatataatcacgcactataaaattcaccctttgaagtatattctcagagttatacaattatcaccactatctaattccggaacattttcatcatcccctcaaaaagcccttaccttttagcaatcattccccatttctccctcccctcagcccttggcaaccaacaatctattttccgtctctatggatttgcctattccggatatttcataaaaatggaatttacagtatgttcccttgcatgcctttcactttacataatgatttcaaggtcatccacactgtagcatgcgtcagtacttcattcctttttaacatctgcataatattccattttattcattgtatttatccattcctatccatatttatctgtttatcctttggtggacatttgagttgtttccactttggggcgattatgaggtgattatgaataatgcagctgtgaacatttgtgtacctgttttttgttttgctttgtttttgagacagagtcttgctgtgcttgccctgtcatccaggctggagtgcagtggcacagatctcggctcactgcaacctccacctcccagattcaagcaattcccctgcctcagtctcccaaatagctgggattacaggcacccgccaccgtgcccggctcatttttttcttttttaatttttagtagagatggggtttcgccatgttggccaggctggtctcgagctcctgacctcaggtgatccacccgcctcagcgtcccaaagtgctgggattacaggcgtgagccactgcacctggcctgtgtacccactttctggggacacatgttttcacttctcttaggcatatacccaggagtggaactactggataatgtagtaactctatgtttacccttttgtagaattgccagatagttttccaaaactgtttcaccatgttacaattctacttaatcttgatgaccctcaatttcctcatccataacggggataataatagtgcctacgtctgagggatttaggataaagagtagattcataaaagcacttgttataagtaatatactaagtgcttagctagctcttaaatctggatgggggataataataacactgataaatgttatttatttcttatcctatttctgaagtttatttttatttattagatgaattgaaatatttgttgctaataattcataaagcagtataataaatgaaaacttcaaatttcattagttgttttttgtactttaattattaaaagtcagatatgtccttggaaggaataggtaaaggcatggctccctgctggcttagtcctctctgttcaacaacatattagaaggaatggaataggtagttttcttctcctttttttttttttttttttttgagacagagtcttgctctgtcgccagcttggagtgcagtggcatgatcttggctcactgcaacctctgcctcctgggttcaagcgattcttctgcctcagcctcctgagtagctgggactacaggagcatggcaccacgcccagctaatttttgtatttttagtagagatgggttttcaccattttggccaggatggtcttgatctcttgacctcatgatccacccacctcggcctcccagagtgctgggattacaggcatgagccaccgcacccggcctcttcttttttcttttttttttaagagtttagtatgcatagggcaaaatcaaagccttgctgttactgtaccaccctcacccttcacaattctccattctttcattcaaagatgagagaacagacttcatggtgcctttccaccaccacctcccaagagttcctgtctgcagaagtccttgtgccagtgaaattgattaagaaataggaatgccatcttttaaaagggcccagcacagcctgtaatcccagcactttgggaggccgaggtgggtggatcacaaggtcagaagttcaagaccagcctggccaagatggtaaaactccatctctactaaaaatacaaaattagccaggcgtggtggcgggcagctgtaatcccagctgcttaggaggctgaggcagataattgcttaaacccgggaggcggaggttgcagtgagcccaggtcacgccactgcactccagcctgggtgacagaacgagactctgccttaaaaaaaaaaaaaaaaaaaaaggccaggcacaatggcttgtgcctctaatcccagcactctgggggaggctgacttgggaggatcacttgaggtgaggagtttgagaccagcctgggcaacatagtaagaccttgtctctacaaaaaaaaaaaaaaaagtttttttctttaattagccaggtgtgatggcatgtgcccacagtcctagctacttgggtggctgaggtaggagtatccctcaagcccaggagtttgaggctgcagtgaaccatgatcacaccactgcactccagcctgagtgatggagtaagaccctgtctcggatggatggatggatggatggatggatggatggatggatggatggatggatagaaaagtttatactggaggatattggttaaggagaaggatagcaagagctatttgtggaggattgatttttggaaagtttattaaattgagttaaaattagagatgggagaaagaagccggttttgtaagtttaaggtaacagtaagaacagtagtgagtacttacagagcacctgctcttagctagatactgttttaggtatgtacataaaactaattcattcttacagcagccccctaaggggcataagtattattattcccattgtacaaataagaaaactgaggcacagagaggcttaacaggctgtctttggcagaaccgtatttaggtgagttcagcatcatctctaaaagtttaaccccagtttagagactttggccctgggatggggggtaggatggagaatcggaattacaaaatgctttaaattatacatatgaatccagcagaccaaatctgctggattcatattattcatattatgcataatattattcatattaaccccctactcccaccccacactagaattcattcactgagttggcagatacacagtgggccttctaatgtcagacactactctccactgcagtttagctagggcaagaccttggtcacagtgttctacaagtcttcagagagagagtaatgtttttctttgttatagtttatattttacttttagaaaggaaaagcatctgagaaaagatatttatgactgagacaaaattattccaaatcccactcacttatatcatttatttatgtggtggacattcatttttatggttttcagtaagcctgtaacattatgagctattagactttgaaacttttattaacaagtgcctgagggcccgactgatttatttggctctccaagcccatgggtatatccagatatataaggttgaggtaggtgctttatgccttcagaaagtacagggttctgcatccagggctgtcttaggttgttctgaaatgtctgtgaacacagagtgcaactcagccgagctcaaatagttctcatctttggcctaaaaataagattgtgaatccatttcccagtctttagagaatcccctgtgatgatttaccaaagaacaaactacttcccttgtctgagcatcacgcactgaaattggagctgcccgtaaataagcagaagatggcgggtactggggacagaggtacagtctttgtagatgcagagtagcgttcgatggctagatgaatgccagttagaaggatgaatgccggttagatgaatgctactcatatcaggcatgtggacatagcctgataatggggtgaagagttgtgacatgtatgaagaaaaatactacttaactgccaggcacgctggctcacgcctgtaatcccagcactttgggaggccgaggcgggcaggtcacctgaggtcagtagttcaagaccaacctggccaacatggtgaaaccccatctctactaaaaaaaattagccaggcgtggtggtgagtgcctgtagtcccaggtactcaggaggctgaggcaggagaatcgcttgaactcgggaggcagaggctgcagtgagccgagatcatgccactgcactccagcctaggcgacagagtgagactccgtctcaaaaaacaaacaaacaaaaaaccactacatagcttctaggtgttattcacgtaactgggagaacagttggttttttcctaaactgggtgtttagaatttataatgataatctcagtaagtcatctcatatttcacatatagataattttcagtttaacagtaaaataaaaatgactctgtactagttagtgtacttttattttacacttttgaatagcagtgagcagaatctactctccagctctatcaaagcacttatgtgtagtgaaactatattgtatttatcaaaataaggtgattgccacttggtatttaccagctattatccttcaaatgggatgctattttagaaaataattattatggcatgttcataactagaatcataaaaatattctacaaattctaagagctcagcattctactctttgatgaaaactaagaaataatctaaaatttaaggcaaaatagagtgacattttttaatacccctacatgcatagtatatcaccacagtatttctttcctaaaacagtaataggctcctaaatatgcttgaccagcagggaatgttaaatatttgtttgtgtatttattcgctccgcaagtattttttgaccactttccataggcaagccaccgtactagacactggggacacagtcgtgaataagatgtgctcctggccgagcgtggtggctcacgcctgtaatcccagcactttgggaggccgaggagggcagatcacgaggtcaggagaccaagaccatcctggccaacatggtgaaaccccatctctactaaaaatacaaaacttagctgggcgtggcggtgtgtgcctgtagtcccagctactcgggaggctgaggcaggagaattgcttgaacccgggaggcaaagcctgcagcgagctgagatatctgcactccagtctgggcgacagagcaagactccgtctcaaaaaaaaaaaaaattgtaattgattatttaaatggaaatctgttccattttcatgccttggtgtttcatactgatatattgttcaattataactttgaaaagagccaatagaatcggtcaaattgtgtgtatacatttatttatgcaacaaaaaaattatgatgcttatgtgccaggtaccgttctagacccaggagaaagcacggtgaacaaaacaaagtcattgtgttcatggtgatttcaccctggtgggaagtcagtaagcaaatatatgatcaatatcaggaattgataaatgataagaaaaataaagcagattaagaggatagagagtgaccagaatgccgttttatttgagtgggctgggaaggagtctctggggagataaaagttttcatagctttccttcttttgtctctgaagtcaattcacctaatgaatgcagatgcaagagaatttttgtatctgttggtatcactcacatattcattgagagctatggtgagggcctacttcttactctttactacttaggaatactaacacctagattcttctcttcattcttttatcactcttccatatacttaagtgcctaagcaccttcattcatccatcccttatataattttttttcttgagacaaaatctggctctcttgccaggctggagtgcagtgatgtaatctcggctcactgccacctctgccacccagattcaagcgattctcctgcctcagcctcccaagtagctggaattatagacgcatggcaccacacctggctaattgttttgtaattttagtagagacggggtttcgccatgttggccaggcttgtcccgaactcctgacctcaggtgatccacccacctcagcctcctgaagtgctgggattacaagcgtgagccaccatgcctggccatccattccttatccttcatccaaaaatcatgatttggtatctgttctggttttccaaaatcttgcgatatgatttatttgattaaaaaatacattgtgcagttaagtgacttccagtgtttgattataaagtggaattgcttctggagagagctcttttatctaagtgttttggtgaactcacaaccactgaaatttgatgtcttgggtcaaattgggtctacagtgatcccagccttaatgcctaaaagccctaaataatacacttctcaagtgttctatagcattgcactagtctaaaatagataactggcactcccctacacctcattgttggctaactgacttgtcccataaatagcccagtgttacgtgatcagacaactacaactaacagaagagatttttatttcctgacacacttgtacagtctctggtagtaaacaaaatccaagtccaagtcaccggcccctaactgtaacctagttcttagaagaattgtgcaaatcagtagccaaatcatgtgggatggaattcaagataaccctgccttataccaaactctacattatggaaaatagtgttagagcaagattcattttcagtccttagagttacctgaagtcccttcccagtctacccaaatgtttctgccctaatctggttaaactcaaagagcatctgccagatgagttaaaaattgtcaggtgagtctgaggggggcatcatggtagttttataaagcctttctttaaaaaatcaagagcatgttaaaaaaagaaactaccggctgggtgcagtggctcacacctgtaattccagcactttgggaggctgaggtgggcggatcacaaggtcaggatatcgagaccatcctggctaacacggtgaaaccccatctctgctaaaagtacaaaaaattatccgggcgtggtggcgggcgcctgtagtcccagccactcgggaggctgaggcaggagaatggcgtgaacccgggaggcggggctagcagtgagctgagatcgcgtcacggcactccagcctgggcaacagagcaagactccgtctcaaattaaaaaaaaaaaaaaagaaactacctgctattggagtataatggttcatatttccaactcttaggtggaatgtattgtttttgtgtctgaaagatttgtaaatgctataatttaacaacattgcttcataaattccttagcagtaactcaggaggtgaaccttcgggcatttttccagataaatctgtgctctttgtgtgcaaagcattgctgcttaggtaactagtgataatgcatagggttcaatcaacacttcagatattttcacttttcttttactgggctttttcaaaatggcatatgtttattatatttctgaagtcaaaataccaaatctaaaacaagtgattttttaaaaaaaatctctcagctgggcgcagtggctcacacctataaccccagccctttgggagctgagatggatcacttgaggtcaggagtttgagaccatcctggccaacatggtgaaaccccatctctactgaaaatacaaaaattagctgggtgcggtggcgggcacctgtaatctcagctacttgggaggctgaggcagtagaattgcttgaacccgggaggcagaggttgcagtgagccgagatcttgccactgccctccagtctgggcaacagagcaagactctgtctcaaaaaaaaaaaaaaaaaaactctctgctaattatttattactgttgaaatgctgcttaccatggctgacaattttgaacaaaagtaaagaatatgtctacgatgtcaaagttagcaattctttccctaattctccttttgtacttttgcttataagaccttagtacatttcatagtcagagcttcatagacccagctgtgtatctttccatggccaggctgagtgtctacattttgaaaacattttaaagttaaaattcagttcaagaatattgtctttagtctaccaaaagggctaaaaacatttactttggccaaacgtggtggctcacgcctgtaatcccagcactttaggaggctgaggtgggaggatcacttaaggtcaggagttcgagaccagcctggccaacacggtgaaaccccatctctactaaaaatacaaaaattaaccaagcatggtagtgtgcccctgtaatcccagctactcaggaggctgagacaggagaatcatttgaaccggggaggcggaggttgtagtgagccaagattgtgccactgcactccagcttgggtggcagagcgagactgtctcaaaaaaataaaaataaaaataaataataaaataaaaacatttaccttggtaactaagtgaatatttactctggtggatgtaaggggaaaataaagaaaaaacgcccaaagcactgattgtttgttcaacagattgtaaaccatggctgtgtggatacaagctcagcagctccaaggagaagcccttcatcagatgcaagcgttatatggccagcattttcccattgaggtgcggcattatttatcccagtggattgaaagccaagcatggtaggtgaacaaggatgtttgcatcatattttgtgaaacacaagaatattggagtttgtttagaaagatgtcatgatggcaactttcaaagttgtatttttaaacatttttaaatgtgatccataaaaaggtatttaaaattttttttctttttataggtgaaaggtatttaagcccatcttagattgaggggatggaataactcttgggatttttaaaacaggatttgttcccctttaatagtaaatactgtctaaaagcattagaatattactgctaagaaagagcagccaacaaatatgtttcgagtgcccatgggatgcctagcagtgtcctaagtagtagaatttatatgaaaaaaattaaagcccaacattgtgttgtaatcccaacactttgggaggccaaggcaggtgtactgcttgagcccaggagttcaaggaaggcctgagcaacatagcaaaaccctgtctctgtacaaaatacaaaaattagccaggtgtggtggtgtgcacctgtagtaccagctacttgggaggctgaggtgggaggatcacttgagcctgggaggcaaaggttgctgtaacccatgatcacaccactacactccagcctaagcaacagagtgagaccctgtctcaaaacaaacaaacaaacaaaattaaagccctcatctccagataattcagtgtttcactggacatggtggtgcacacctataatcccagctacccaggatgctgaggtgggaggattgcttgaccccagcagtttgaggccagcctaggcaacatagcaagatcctatgtcaaaaaataataataataatttagtgtttaatggggcagataggtgtgaatatgcatataatttaattataatttatttcttatagtttattaaatataaattattttacatttcttaataagtttacatctaacaaaaaactaaaaattaataatttaacagtggagacattggtgtttttaatttatatgtattttatatatacacataaagactaaaagaaaattgagtgggtgttgtggctcatgcctgtaatcccagcactttgggaggccaaggcaggcagatcactggaggccaggagttctgagacaagcctggccaacatggcaaaatcccatctctactgaaaatacaaaaaattagttgggcgtggtgacgggcgcctgtaatcccagctactctggaggctaaagcatgagaatcgcttgaagtcgggaggcagaggttgcagtgagccgagatcgcactactgcactccagcctgggcaacagagtgagactgcctttaaaaaaaaaaaacaaaactaaacgaaaatatacccaaatgttaacactaattacattctggtggtagatttgataagcattttaatttttctttattttccagattactgattacatacttgggggaggggagagttgttttaaatttcttttagaattagtacagtgcagtcgactaacagcacaggtttttaattggtatcattattacacaccaggcagcaggatgtacactgctctgctcaaggtctgggaggttgctggttggttacagtctgtcagtcgatctgacatattcatttgatacttcaagcctcaccgtcttagccatgggtcctctttgacagtccctgagagaaccagctttgatgctgctatttgcaaagggccatatacctgtctgtaatgttgccttagaataatcgcaatgcgtgttagtagcaaatttctgttcagaaactaaagatcaccaaagaaaggcaattttctaggcaattaaaaaaaaactcaacttcatgtaattaagtgagggaaaaaaattagctaaatatgagaatgtcagctgtacctcgtttagtgctttccactcccttttcattttctctcctgttttctgatgtggaggatttagaaaaacatgagtaggaagttgctgttaatttcagatttcacttagcagagttctcatttggtgttctcactgaatgaattaaaagacttgtgttgatattaaggaaaacttgaaattttttagctttggttttcttcagaatataaagattttaatgaagaattttcaattcttttttttttttgagatggagtctcgctctgtcaccaggctgcagtggcgtgatctcggctcactgcaatctccgcctcccgggttcaagcaattctcgtgcctcagcttcccgagtagctgggactgcaggtgcccgccaccacaccgagctaatttttgtatttttaatagagaccggggttcatcatgttggccaggctggtctctaactcctgaccttgtgatctgcccatttcggcctcccaaagtgctgggattaaaagcttgagccaccgggcccagccaaatctttagttctttatgtttaagccatctaagcaagtcttttttttttttaacagagaattaaggtttcaagtaaagaaccaatacctgacttctgtgagttttgctcagagactggatccttttaagagtgggctcctggccgggcacggtggctcacgcctgtaatcccagcactttgggaggctgaggtgggtggatcacttgagatcaggagtttgagaccagcctggccaacatggtaaaaccccgtctctattaaaaatacaaaaattagccaggcgtggtggtgcacgcctgtaattccagctacttgggaggctgaggcaggagaatcacttgaacccgggaggcagaggttgcagtgagctaagatcgtgctactgcatcccagcctgggtgacagagtgagacttcgtctcaaagaaaaagagtgggtttccagaccaagggcattgttgccagttgaaacagaggtgcagggctgccctcattccttccagcctttcatttaatacgtattctatttaatacatagggcacacatatttagaatctgacttgccttaactgccttctcaaggcgcagattggggtgtactatttgatggactatggtatcactgctttttttgttttgttttgttatgttttcgtagagagaatcttgctttgtcacccaggctggagtgcagtggcgcaatcttggctcactgcaacctccacctcctgggttcaagcagttctcctgcctcagcctcccaagtagctgggactacaggcacatgccgccacgcccggataatttcttttgtgttttagtagagatggggtttcaccgtgttgcccaggctgatctccaactcctgagctcaggtaatccgcctgcctcggcctcccaaaatgctaggatcacaggcgtgagccaccacgcccggccggtctcactgttttgatacacttgttggtgcctcttttttgaaattagttgctatcttcagggatttagggatggcagagccttttagctaccactatcttgtttggctccagacccagtcagcagttattgaatgttatttcagtccgacagctgtttggtttcttcagtgagtaagtaatttggtacttcccagtgtcaattgttgcctaagtagtagaaaggaaggaaggaacggaaggaaagaaggaaagaaggaaagaaaggagggagggagaccatccaacccccgtcaccagttcagtagcttgaaatcaatgcaaagtctgtagcgtggttttccttgtttactggaaaagttggcattgccttcaggtcctgggtctgcaactagtgacatgaatgtctgactcgtataaattcttgtaggcaccctctgcctgaatgtctcatttccagggcttcttagaaatagcaataacttgtttcacctgtctctacctaagaaacccacagataccaaactccttgaggctggaaaggacatgtagaagagtcttggccttgtgcctcctttacacccatgaggggtaactataaataggaaattatccaagtccttatttccttcagagtacacagaaccctttccttttccttgcatttctcggagcaaatagcataagcaccaagcacatcattgagagaaaggaagaagggcagcacattgttaaaaatttttttttttaaaagaaggaaatctactgtataatccaactatttagtaaattacaaatagattaacataggcattgagtccatttctgttgggctgtttcttaaaatttgcagtgaggattaaaaacatcactttagttgaagaaaaagtaggatgtgttgaggctgtatttatacaggctcacgtgcatgtatgtatacagattatgtaatttttttcccctagggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccaggtgggtgtgggctctggggtcacacttaattaccttcccttgggggtcttcttcctgtagagactttctttctctccttcagtccagcattgttgagttacacgtgcataaggttcttgttgtgtggttttggtctttttttttttttttactttttatttgagaataatttcatacttccagaaagttacaagaatcatacaaagattccccacatatgcccatattcacctgttgttgacttttatgttgtcatatactcctcgctgtctctcgacacacacgtttttcagtcactggagagtaagttgcataccttgtgtccctgcaccagtaagtacctctgtgcattttctatttatttatttatttatttatttatttatttatttatttatttatttatttttgagacggagtcttgctctgtcgcccaggctggagtgcagtggagcaatctcagctcactgcaacctctgcctcccgggttcaagcgattcttctgcctcagcctctcaagtagctgggattacaggctcctgccaccatgcctggcagtttttttttttttttggtatttttagtggagacggggttttgccatgttggccacagtggtcttgaactcctgacctcaggtgatccgcccacctcagcctcccaaagtgttgaaattataggcatgagccactatgcccggtccctctgtgcattgtctttttttttttttttttttgagatggagtttcactcttgttgcccaggctggagtgcagtggcgcggtctcggctcaccgcaacctccacctcccgggttcaagtgattctcctgcctcagcctcccaagtagctgggactacaggtgcatgccaccacacccgcctaatttttgtatttttagtagagatggggtttctccatgttggtcaggctggtttcgaactcccgacctcaggtgattcaccctcctcggcctcccaaagtgctgggattacaggcatgagccaccgcacccagcccctctgtgcattttctaagaatgaaccttgtcttgcatggttataatacactgatcaacttcactaaatttagcattgatataatacttttaggtactcatctggatttccattttgtcaactaattcaaacatgtcctttagggtatttttccccgctgcagtccagaatccagcccaagatcacatattgcatctagtcatcatgtctctttaatctcctttaatctggaaccattttgcaaccttactttgtctttcattacattggcattttaaaataattaatgtaggctgggtgcagtggctcacaccagtaatcccagcactttgggaggctgaggcgggtgaatcatctgaggtcaggagttcgagaccagcctggccaacatggtgaaaccccatctctactaaaaatacagaaattaactgggtgtggcagtggacaactgtaatcccagctacttgggaggctgaggcaggagaatctcttaaacctgggaggcagaggttgcagtgagccgagaccgtgccattgcactccagcctgggtgacaagagtgaaattccatctcaaaaaataataataataattcatgtaccccctgctttttaaagataaaatgttcctcatttggggtttgtctgatgtttcctcatgattacgttaacattgcacatctccgagcagacttctaaatatagttggctgtccatgtccatgggttctgcatcctgattccaccaaccgcagctcagaaatattcaggaaaagaaaaaaagtaaaaacaaatagaaataaagatatgacagaacagctatttacatagcatttcttttgtattagatagtataagcaatctataggtggtttaaagtgtatgggaggattgtatgcattctatgcaaaacgatgccattttatataaggaacttgagcatctgcagattttggtatccaagtgggtcctggaaccagcccccacagatgccaagggacaattgtaggtgacttgtccttctcgggtatcacatccagaggggggcagtgtccctcgtcccctcattggtggtagtagttttgattgcccatttgagagtggcatccagtttctcctcttgcgaggcttttaaaacttatttattccgtttttaagaatgttccccggatactttaggcaaattaagatgcaaaaagtaaaacagcactttgggaggctaaggcaggtggatcacctgaggtcaggagttcgagaccagcctggccaacatggtggaaccccatctctactaaaaagacaaaaattagccaggcgtggtggcgggcccctgtaatcccagctactcggggggctaaggcaggagaattacttgaacccaggaggcagaggttgcagtggcccgaggttgtgccactgcactccagcctgggcaacagagtgagactcagtctcaaaaaaagaaaaaagaagtaaaacaatcttaccttttcactgcaattggatttccatgatgtgccttcttgttcctgttggtattggaggaacagtgcctcctgtgattcaggaggtccctcaggaggctccccatcctgaggcatggttagggcccatagtgtggagtggcacaaagtgatgtctgctgttggattctttcagaacacgtatgaccgctgccccatggagctggtccgctgcatccgccatatattgtacaatgaacagaggttggtccgagaagccaacaatgtgagtgtcccatagggatggggagggcagtcgggaagtcttttcttacccacctccctctggacccacctttgtcaaggtgactcagggtgcactattggtgtctctttaaagagagcttcatcctaaggggcacaaaagaaataggagacttgactgagtgcagcccagcactttgggaggctgaggcaggcagattgcctgagcccaggagttcgagagcaccctgggcaacatgatgaaaccccgtctctaccaaaaatacaaaaaaattagctgggcatggtggcatatgcctgtagtcctggctgttcgaaaacctgaagtgggaagatcccttgagcccaggaggtagaggctgcagtgagccatgatcgcacccctgcactcatgggtgatggagtgagaccctgtctcaaaaaaaaaaaaatgaaatagaagatgtggtctctgatcttaactgatttataaccttgatgagattgcaaccacaagacaatgtgaacaagtgcaaagtaattcaacctcagctgaataattttttagtaaaggcatgctcatattcaggtgagaatacttaggaaagacttttccctagcccctgaatcaggtgtggaaggagtggtctgatcaggtcacttacagggctgggtccacagagaccttgtttatgcctcccccatcacttcaccctggggtctccaggatgcctgcaagaggtttggcctcttccatggtggaagcaaatgattccatcacgagaatatcttgagtgaggacacagatgatgtgtgttcacatggccctgctccccatggcctccctaatgcttaatgccgtccttgcattgggtcagtgagtggaagaggaatcactccacctcctcattagtaggaaaacccaggtgacactggaccaggttacgttctagtttctccaaaggtaattcaatggacctcgtttggaatactctggtggaggtcagatctgaaatggaagcttctcccatgctttgtgatctgagccatgatctgtccgctcacctgtttctcacttttcccactccaccctgtgtctcatgatgacgtttgcttttcctcccgactcaaaatttaccttttggggtcttaccctggttgtaggagctggcttttcctggggattaaggcctcagtcttcctcccattcgcactgccttgcactgccccccatatgttcccagggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaaggtgaggcgcggtggaggcacattgtgcaacttgaggattgggcctggggactggaaagcagctctggtggggttgggagaaagcacactttccattcggaggcagcgacctttctctgagtagcagggacttatttgcattgaagacagtgctgagaggatgagatttaggaaggggagatgacaggaccccccgcttaagtgcatatctcactcaggtccccacatccagggagcttctgagctgccagggaagacatttcttcttttgagaaggagctcacagtctaaataaatactagcaaacaatacttttgtatatagtaggcatattataagtggagctttattgaaatgataaataggaaattatataattacatgtttaaaaatttttctggctgggcacggtggctcacacctgtaatcccagcactttgggaggctgaggcaggcggatcacctgaggtcaggagttcgagaccagcctggccaacatggtgaaaccccgtctctactaaaaatacaaaattagctgggcatcccagtggcgcatgcatgtaatcccagctacttgggaggctgaggcaagagaatctcttgaacccgggaggcggaggttgcagggagccgagatctcaccattgcactccagcctggacaaaaagagcaaaattctgtctcaaaaaaaaaaaaaaaaaattctaagctgggagtggttttgcacacctgtaatcctggtgctttgggaggccagggcaggaggatcacttgaggccagtagtttcagactagcttaggcaacatagtaagaccctatctctaagggggaaaagaaacctttctaagcaggtacgtgtaagtactaaggacctgtatatgatttctaatgttctatgcagttattcacagaggtcttcctgaaacagagtacacttaacgccccttaggtagcccttatggacagagcttccctagcctggtataaatcctgcttagtagttggggcacagagagcttcagtctgtggtgaggctgtggagccccaccagcgcccccttttgaccctgtagcagtttggcagtttgagctttaatagtttcctctctgcttccatgcccagctcagtctcagagaagccttggctcaaccacccagcccctccaaacacacacacacacagcacacacagacaacacagcacacacacacaccacacacatcacacacacagcacacacacacacagcacacacaccccccacagcacacagagacacacagtgcacacacacagcacacacacaccacacacagcacacacacagacacacagcacacacacaccacaccacacacaccacaccacacacagcacacacacaccacaccacacacagcacacacacaccacacatagcacacacacacaccacacatacacaccacacacacatagacacacagcacacacacacacacacagcacatgctcctctaattccatgtatgtaggttccattttatgtctatagtgatactacttatttactctttatcttctccactggaatataaatctttgagaagggactatatcttttatctctgtaccctgaggccagcacaatgcctgaaacataacagttattgagtaaaggttgacaggatgattctagcctgtcttccttttttatctgaatccatcctagactggccctagaagaagggcagctccttcagagaatggaaacggaagattttgggtggctattcctacccaagtccttagactgtcaacagtatttctgatcccgtgcctggcttttctgtttcctgtgcatggtggcggattaggtttggattcaggttgggtttggatctatcacgcagtgtcttctcagtcccatttgtcaagttcactcagcagaaacacagactattgatctgcttttgccagggaaggctcagctgcctccagtggagtagggaaattgcttcccgtctccctggcctccttcccaaaagcttctgcaaatttccaggagagccctaagtgggtcccttgcataggaaggctgggcccaggtgttgggatcaccaccaccctccctgtggctgggcaggattcctgaggtagccgtgcagataccttggatctgtccgtccctggatgatcctcttcctgctcgatacctgcagtgagattggagccatatttctgagttctagctctgggctgttcctggctacatagagttgcttttgtctgtcccagcttgtgcatcccatgggtcagggctggggtcagagtgacgtggccctcaggggccagccaggagctcgaccaagacatgctggtgcgcgcatcttctgactcagctcaagcaaggactctgggctgttgagaaggtgatgggaagggattaatagtcccagtgtggtggagacgggctgtcgctgggagggtggggtgggcctgcggtggtggttgtaactgtggacatgtttactttcttagcctgggttattgatacacaggtgctcctgtgttccacgttccctgtgtcttacctatttcataataatttttaaaaggtaatgaggcctaacttactccctgtcccgccatcaatgagactcctcacagatggtgtggagggaagccgcctcccttcggcctccctttcctgagagaatcttggtggctctgcatccccagtggccctggacatgctctccctctgcggtctgtctgtctgtccgtgttccctggttggttggctgggttcacagtgagctcacctggacaaacatgctgggccccttccagcctctcaagaatctcatcctcccctgaggagggattgctgtgctcagggactagacagagccgccggggctgggtttccctgaagaggccttgctgcgggagggatggggccgagcagctgcttgtctctgtcacctcttctctctgtcctgttccccgttaaccaagaagcacgaacctcacacagagctcacccatgtcaggcagctttctggcatcttccatgtcctcatgtatttaatcttaatgcaccccactgaggcaggtgccgagaatactcccgttttacacgtggggaagccaaggcacaggaaaggaaagcgatttgcccaggttcacctgcagtcaagggcatgggcacacttacaccccagacagcctggacccatgctgggccgcgagaagagggctggcagccctgtgaggcaggcgggcaggaggcaggcaggcctcctccccagctgccccagcacccgtgtgcccccagaggggacggctcagagtcaggaggctggtgagcagggcccagaggcgcctcctgaggcgccattcatcttggcccccctggctgtcaggaaccccgacttgctcttgatgcagtgtctgagcctgggagggtctcgctccagaacaggtgagtgggcttctctaggcctcctgttggacactaggaggtgatggtcatggtttcctcttctctcctctagctcagtttgcccagctggcccagctgagcccccaggagcgtctgagccgggagacggccctccagcagaagcaggtgtctctggaggcctggttgcagcgtgaggcacagacactgcagcagtaccgcgtggtgagtggggtcctgggcctctcctgggcgtgggtgccatgaagtcagtctctggggacccgagggagggctgggaccagcatgagagcagaacctgggagggcaggaggccttttttcctgggggccttgcgaggcagagcagcttggggagagggaacggcctgggccctgccctgccatttcccagcgaggccctgcggtgttctctgggagcccagaaggggctgctctcctcccttccctcaggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtaatggtgtggggcggccagcgggcagggcaggaggggctggtggggatcccggctgcttctgcgtcctgtgctggctcctgcagcaggccccctccatcctgggacagctcttgtttctccagggagcctggttcctcaatcagactttggtccccatcctgtgcacctcccccaggaagggggctgctgtcctgggggtgggatggggctcgggtgtgtggggtgatgcttgggctgtttgggcctagtcagggtcgcccctcctgtgtacgtctctaattctgggaggcagggagctctgctcttcccatgggtgggaagtgtggcgaaagcacagagccttcctgggggaacgggagctgtgtcttggggcctggcgtctgtgcggaggagccattgtcctcctgttggccttggggctctcgtgcaggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccaggtgactgctgcctgtttgccatgcccaggagcttggggcagctcctgcctgcgtggggggagccgcaggtgccttccagaccagcagatccacttcctgcctctcatccctcccaactccatctccagttgctgtggcccttgcccagtttctcctgtggacactgcaagagatgcccttgggctgcagcccatgccagcttctgtgttatctcactcccctctccatcctctccctggactctcacggcttccccaggaacagaggctgtgcccgagctcttcacctcctgagcccctcgggaggcagccccacccccaccacagagggactgagagccctttcccctgcaccagcccctcatcatgcatctgtccctgtgtcccctgcagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaagtaattgtgcagcttcctctcattccctgctacttgtctcatgtcctggcaacaggaaaaaaagaattctgcctcctgtgtcagatccctgtttgcccttctggcctcttctgggcatcagcaaaggaatataaggaagttcttgggcctggtgtggtggctcacacctgtaatccaagcactttaagaggccgaggtgggcagatcacctgaggtcaggagttcaagaccagcctggccaacatggtgaaaccctgtctctactaaaaatacaaaaaattagccgggcgtggtggcaggcacctgtaatcccagccactagagagcctgaggcaggagaatcccttgaacctgggaggcagagattgcagtgagctgagattgcagtgagctgagatcacgccactgcactccagcctgggcaacaagagcaaaactccgtcacaaaaaaaaaaaaaaaagttctcttaggaactgttttctgtgaagatagtttgatcttgtttcattttgtagagatacgtccgagaagattacatgtatgtgttatgtagctaacatttcctctaaatgacgtacatttttagcaaacttctctatttcctgctaccccaaattatattatttactccgcatgtcctgagaccctggcatgggtttggagctggtctctctctgatttgcagtgattacagtggcgagatcttgaacaactgctgcgtcatggagtaccaccaagccacaggcacccttagtgcccacttcaggaatatggtgagggtggaagaagaggaagaatgaatttttccctggtctttgaggggaacaacttatatcttacgtttcatcttatgtttcttctttgtagtccctgaaacgaattaagaggtcagaccgtcgtggggcagagtcggtgacagaagaaaaatttacaatcctgtttgaatcccagttcagtgttggtggaaatgagctggtttttcaagtcaaggtaaagccttccctcagctctgcgtgtgcgtgtgcgtgtgtgtgtgtggtgtactttatgttacaaaatattttttttttatcacatagcatcttcttctttttgactgttggtaaactgaaaatggactgacctcaccctgagaactgtttcacttaggttctcttaagacatgaacagaggccaagcacagtggctcatgcttgtaatcccagcactttggtaggttgaggcagtcaggtcacttgaggtcaagagttcaagaccagcctggctaacacagtgaaaccccatctctactaaaaagtacaaaaattagccaggcgtggtggcacgtgcctataatcccagctactcaggagaatcacttgaacctgggaggctgaggttgtaatgaaccgagattgtgccactgcactccagcctgggtgaaagagtgagaccctgtctcaaaaaaaaaaaaaaaagacatgaacaagcaaggcccagtgcagtggctcacatctgtaatcctaacactttgggaggccaaggcaggaggattgcttgagttcaggagttccagaccagcctggagctggttgtgagaccccgtctcaacaacaacaacaaattaaaaaataaaaaataaaacatgaacaaacaataatgaactgaactagctggagaggtagactacaaaatggatatgagaaacattacttgggatgaatttgagtaaaggttgtggtaagttttaaatttgttatttgtattttcttcccagaaatatctccaatagtcttttctctctcctgttctccatgtaactttgagaaactttatccttcagaaatatctaagcaacattgcttgtaaaatatttaaaatttctaagattgtgccagtatgaaaagtcatattattcctggggccatttagattctgtgtctgagaggaacattaactgaaacttggaaaataaaagtgttgttataataagaaaaaaaaaaaagagagaaggagaagaacttgaggctcgtgggcgctcagccttctcttgtgtctttttagaccctgtccctgccagtggtggtgatcgttcatggcagccaggacaacaatgcgacggccactgttctctgggacaatgcttttgcagagcctgtgagtgtattcctcgggcatgtgggtcccaaaatcaatgccggtgtcatgaatctcatttatgtattatccttttaaaaagcataggaaaaggccgggtgcagtgactcacacttgtaatcccagcactttgggaggccgaggcggttggatcacctgaggtcaggagttcgagaccagcctggccaacatagcaaaatcctgtttctattaaaaaataccgaaaaattagctgggtgtggtggcacatgcctgtagtcccagctacttgggaggctgaggcacgacaatcacttgaacccgagcggcagaggttgcagtgagccgagatcgcaccactgcactccagcctgggtgacagagtgagactccatctcaataataaaaaaaaagcataggaaaaaagacgctgttttctttagtgggaggcagaatagaaagaatgtggaaagtggaaagaacatgggcttgacatcgggccagggtttgaactgagactccaccatttcctcactccatgaccacatgggcagttcactttacctctctgagcctgagtttccagcaagtgtctgcagcacagggatactcttgctctacagcattgttaggaagattaaattagataacatagaaaatgcttgccacacagtcagtactcagtaaatattattttgaatccttgggtgaaactatgaatgggatttgggactcctaggttcactccagaggttagatctctccagaggcttactttagcatagaagttgcttcataccctcttcctttcaataaatgaagatgctgttaaatgtcttttccaaattttagtttctgtgattcattctaggtctcatgaagaatgagatactttgcctcaaggaagatataatttggtggatttatgcacccaaacgctatctgaatcccactagcatgctgctcgatgagcattttaaagatctcataggctgggtgcggtggctcatgcctataatcccagcactccaggaggccaaggcaggcagatcccttgagctccagactagcctaggcagcatagcaaaatcctgtctctacaaaaaataccaaaaaattagccaggcatggtacaccagcctctagtcccagctacttggggggggctgaggcgggaggatcgcctgagcccaggaggtccaggctgcagtgagccaagattgtgccactgtactccagcctgggtgacaaagcgacaccctgtctcaaagaaaaaaatttttttagtaggcaaaggtcatttgttacatatttccaatagagattagtccataaaagcatgataaaagggttatcatttgggacataagagcatgtccttctctaagtatatccaacaaaccttgattatgttttgttttgtggctgttagaatataggatttgactgttagttcaacagctcatttacaaaacagcatggacagcatgggttaccttccagttgtgtgtaaagaaggtgaaatggaaccttctggctcacgtggagaggcttaacgtttcccaacactcctctttagagaaaaagtattttactgcaaaggtgagatttttaagagatttaccatacttcacttacaaactctgaatcagaagctcctttttgaaactgtctgtctgcctcttgtcctgataagcctcctagataagattgccacatctcttgtttccttccctgcctgtccacagatctcactctctgtgtacctttggcatctcctgcaccatgtaattactcaagtatcttgtctaaataaataagcatttttaacattctcagctatgttaatgactacttacatcttatgctatttttttttttttaatttttttgagacagagtcttgctctgtcacccaggctggagtacagtggcattatctcggctcactgcagcttctgccttctggattcaagcgattctcctgcctcagcctcccgagaagctgggattacaggtgcatgccaccacgcccaattaattttttatatttttagtagagaccaggtctcaccatgttggccaggctggtctcgaattcttgacctcaagtgatccacccacctcggcctcccaaagtgctgggattataggcatgagccactgcacccagccgaccttatgctatgttaaaaaaaagactttcagctgggcacggtggctcacacctgtaatcccagcactttgggaggccgaggcgggtggatcatttgaggtcaggaattcgagaccagcttggccaacatggtgagactctcatctctactaaaaatacaaaaattagctgggcgtggtggtgcgtgcctatgatcccagctactcgggaggctgaggcaggagaattgcttgaacctgggaggcagaggttgtagtgacctgagatggtgccactgcactccagcctgggcaacacagtgagactctgtctcaaaaaaataaaaaataaaaaataaataataaagacttgtggccaggcacagtggtttatgcctgcaatcccagcactttgggaggccaaggcaagcggatctcttgagcccaggaatttgaggccagccttgtcaacatagcaaaaccctgtctctacaaaaaacacacaaattagccaggcatggtggtgcacgcctgtagtcccagctgtttgggaggctgaggtaggataattacttgagctaaggaggcagaagttgcaatgagccaagattgggccactgtactccagcctggatgacagagcgagaccttacctaaaaaaaaaaataattgtggaaatttattctccatatatatttgcctatgtgtcctgtgggtcaaataacataagaacattgcagcattgttagtaatagctaaagatgaggctgtaacactgatgcccatctatgggggtctggtgaaatttctttatgtgctgatgggaggtctcccagatagaggattaagtgaaaagaggaagatgcagaacatgtggattttgtgctgtcatttgtgaagaaaaggaaaaggtatatgtcattgctggcatgcatagaatatctttggtgggatacacaagaaactgtgttaggtgcctttaaagaaaagaactgggttgctgggagacagggatagggagtgacttcactgtgtagccgtctgtgctttttgaattttaaatcatgtgaaaatcacctattgaaaaaagtgtttgtaacaaaataaaatggagtactatggctgaacgggttgaaaagcagtttattaaaagttaatcttctaacctatttctcaataaagccatccaactcaaaatttccactcttccataccaagttgttttactttgagctagaattcttggcagaaggagtcgagggcaatgattccacgtgtgtacacacatgccgacacgtgtgcacacatacgcacactctctctgtttgtacctagaggaccagtctttcagatttctaaattcccaaggtgtttacaatctaagagccagaccttggttatgttttggtttgtggccgttagaacataggatttgactgttagttcagcagctcatttacaaaacagcatggatagcatgggttaccttctagttgtgtgtaaagaaggtgaaacggaaccttctgaatttcacagaaccgtgtaccccagcagagtctgaatttatcctcaggccctgcaagacaaatgtgtgtaaccactcccagccatcagcgtttttcttttgtggcttgagggaataaatcatgcaactgttttctcatcagattctggcctctctccctctcagggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggtgaggagcccagctgccagccgctgttagatcagtccttcccaaccagatgctctcaggagtctccctgccctgggcccttattcttcatgtctctaataaaatgtaccgaaagtaatagaagcttctgactagatggacaacttgagagttacccaggtcacgtgtagaaaattacatctttgcatattttaaataagttgacctttgtctacagttaatgcattttcttcctttgtaaaggaaatagagcaaagcagatgttaacatagctcatgagaagcaaagcttttgaggggatgcgaactctgggcctctctcccctttactctcttatgttccccatgtgtaatgccagatcaggctcctatgggaccctcaacccacaaagagggatgctgatgaaagaaactcctcctctagcatctgctaattcagacgtcactttgattttatttttattcattttttttttttgagacagagtttcgctcttgttgcccaggctggactgcaatggcacgatcttggctcaccgcaaccgccgcctcctggtttcaagcgattctcctgcctcagcctcccgagtagctgggattacaggcatgcggcaccacgccccgcaattttgtatttttagtggagacggggtttctccatgttggtcaggctggtctcgaactcccgacctcaggtgatctgcccgcctcggcctcccaaagtgctgggattacaggcgtgagtccactgtgcccaccctatttatttttgtttatttatttatttttgagatggtgtctcgctctgtcacaaggagtgcagtggtacattctgggctcactgcaacctccgtctcccagattcaagtgattctcctgtctcagcctcctgagtagccgggattacaggcacccgccaccatgtccagccaatttttgtatttttagtagagacggggtttcaccatgttggccaggatggtctcaaactcctgacctcaagtgatctgcctacctcagcctcccaaagtgctgggattacagacgtgagccaccatgcccggctatcaccttgatttgaatttaatttttgtttcttttcctacaccccccacccccaaggtgttttaaatgtttaatttggagcctaacaacgtgcatttctcagaagctcccaggtgacactgatgcttctggtcacagaccacacatcgaaactagcaagggacgggtcagcccagtcccaggtgaaagtgtctgtagcaggagcccactgggtgctggtaactgcagtttggtattttccccttcttccctcttttcctctccatggggccattaggtaaaactcaggtaggcggggatatttgtatgcctctgacaagggtagatgtttgtttcccatttaatttttccaattaaatatgtgtataatattccaagtgttactctggtgttcttatgttcactgttgtatctccaaccaggagaatttaccaggacggaattacactttctggcaatggtttgacggtgtgatggaagtgttaaaaaaacatctcaagcctcattggaatgatgggtgagaatcattatttcttaaggcgccgacagagtctgaaggtcttctctctggcatcgtaagtcacactctgcttctgtcctttgtccttggtgatccagggccattttggggtttgtaaacaagcaacaggcccatgacctactcattaacaagccagatgggaccttcctcctgagattcagtgactcagaaattggcggcatcaccattgcttggaagtttgattctcgtgagtgcccctcccttcttatgtccaaagttagctgctttcgttacaaaattattttaacaaataatttagtgggtacttactatttgttgaggtcagtactaattatgggaaacataaatgtatagccatgacatactcataataaggcagcctatgaaaaatactattatgggaaacacaattgctaatttggttatacatgaaagtatatggcagcatggttacacatgaacatttaaccatgacatggctacctatgatacaagagtccgtgcagaatctcagttgcttccctcttaaaatgtttgccttattgtactactctgcataaagcttatttcagtgaagaatttgatgatttggagttcttacagtagtaaaaatattcctttatcctaattaacatatggatattgccatcaaccatttctacccaagatgttagttcttttctttttttgaaacagggtctcactcttttgcccgggctggagtgcagcggcacaaacatggctcactgcagccttgacctcctggcctcaagcagtcctcctcccttagcctcccgattagctgggaccacagacgtgcaccaccacacccatctaatttttaaattttttgtatgttgcccaggctggtctcgaactcctgggctcaaacaatcccccactttggcttcccaaagtattgggattacgggcttgagccactgcaccagggcatcaggaaagttagttctctcctctgaccctcacaataagggtagcttgctggttcattttctgtgaattaaagtttttaataacttttggctgggtgcggtggctcatgcctgtaatcccagcactttgggagcctcaggcaggaggatctcttgaggccaggagttcaagcccagcttgggcaacatagtaagaccctgtctctaagtaaataaataaataaataagttaattaggtgggcatggtggtgctcatggtgtgcgcctgtagtcccagctactctggagggtgaggtgggatgatcacttgaccctgggagttcaaggttacagtgagtcatgatcacatcactgtactccagcctgggcaacagagtaagaccctgtctcttaaaagaaaaaaaaaaaaaggctgggtgcggtggctcacgcctgtaatcccagcactttgggaggccaaggcaggcggatcatgaggtcaggagatcgagaccatcctggccatcacagtgaaacccccgtctctactaaaaacacaaaaaaattagccgggtgtagttgtgggcacctgtagtcccagctacttgggaggctgaggcaggagaatggcgtgaacccgggaggcggagcttgcagtgagccgagatcgcgccactgcactccagcctgggcaacagagcaagactccatctcgaaaaaaaaaaaattcatcacttttaatagctcttatgctttctctggttgtgggcatgcttcctagcttttatatatctttgtatgggaaatcagggattgggggccagtaaaaactgtttcttctactgagggctagaatactgtttgaacttgaaacgtctgagatcattggatctcttgggaagtgatttttgtattacctgcttatctacccatggcttttatttttatttatttatttatttatttatttttgagatggggtctctgtcacccaggctggagtgcagtgtcatgatctcagctcactgcaacctccacctcccagcttcaagccattctcctacctcagcatagtacctgggactacggatgagtgccaccacacttggctgatttttgtatttttagtagagacagggttcatcatgttagccaggctggtcttgaactcctgacctcaggtgatccacctgcctaggcctccaaaagtgtgggattacaggcatgagccaacatgcctggcccctacccatggcttttaaaactatttcaggccgggcacggtggctcacgcctgtaatcccagcactttgggaggctgaggtgggtggatcatgaggtcaggagatcaagaccatcctggctgacatagggaaactccatctctactaaaaatacaaaattagccaggtgtggtggcgcgtgcctgtaatcccagctacttgggaggctgaggcaggagaatcgcttgaaccagggagttggaggttgcagtgagccaagatcgcaccactgcactccaacctggtaacagagtgagactccgtctcaaaataagtaagtaagtaagtaaataaataaaagtatttcatctataacccatggttatttttaaatggagatttctattggagccattataatggcaagcttgaatttatagtatgttggggttttaagatttcctaattcagaaatcatgtttagaatgtgattgttctgtttattgatctagaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactggtaacaatgttcgcattctgatttgattttgttgtgtgtgtgtgtgtgtgtgtgtgtgtgtgtgtgtgtgcatacctgcgtgtgttatctctcttgtgtgaaaacccacacaattaccattcagtgagagcagtttgagcattttccagggcagatgtaaaccttgggctggattcttcagtcatacagaaaacacatctaccactaaccccaaatatcaaattgaagaaaacaaattctttttaatacaagcttagatcaaacaaaattaggtaaaattttgtttttcatgacagagatggttttattgctttctgagtttagaagtattacatatttattataaaattttcagaagacacataaaggcataaaaaagaaaacaggctgggtacggtgggtcatgcctgtaatcccagaactttgggaggccaaggcaggcggatcatttgaggtcaggagttccagaccagcctggccaacatggtgaaaccctatctctacaaaaaatacaaaaattaggtgtggtggcaggcacttgtaatcgcaggtactcgggaggctgaggcatgagaatcacttgaacccaggaggtggagattgcagtgagctgagaccacgccaccacactccagcctgggcaatagggtgagactcagtctcaaaaaaaaaaaaaaaaggaaggtcgggcgtggtggctcacacctataatcccagcactttgggaggctgaggcaggcagatcacctgaggtcgggagttcaagaccagcctgaccaacgtggagaaaccccacctctactgaaaatacaaaattagcctggcatggtggcgcatgcctgtaatcccagctactcgggaaggctgaggcaggagaattgcttgaacccgagaggtggaagttgtggtgagctgaaatcgtgccattgcactccagcctgggcaacaagagtgaaactctgtctcaaaaacaaaagaaaagaaaacaaaaaaacagataccacacaacatctctcatctagagattaacctctatggatgatttagtgactattcttgcactctatatatagatatgtattatacattgcatcacccgttgcttgaacttcctgtgtggaggttatctagcagcagaacgaagaccataaacaaggaaacatattcaggccgggcgcggtggctcatgcctgtaatcccagacttttgggaggccgaggcaggcatatcacctgaggtcaggagtttgaaaccagcctggccaacatggtgaaaccccatctctactaaaaatacaaaaagtagtcaggtgtggtggtgggcgcctgtaattccagctacttgggagactgaggcaggagaatcgcttgaaccagggaggcaggagaattgcttgaaccagggaggcagaagttgcagtgagccgagactatgccactgcattccagtctggtgacagagcgagactccatctcaaaaacaaacaaaacacaaatatattaatttagtgatgggcgccctgaagacaaataaagcaaggtagagggatagagaagtggcagggaggagagtggaggtgttattttactagagtggtcaaggagggtttctctgaggacatgtttgttttttttgttgttgttttgtttgtttgtttgtttgagatggggtctcactttgttgcccaggctggagtacattgctcactgcagtctcaaactgctagactcaagggatcctcccacctcagcctcccacatagttgggactacaggcatgcaccaccaatcctggttaattattttatttttatagatatggggtcttgctgtgtttcccagactggtctcaaattcctgggctcaagcaatgttccttcctcagtcccccaaggttctgggattataggcatgagccactctacctagccaggatgtgatgtttgaaaagacctgaatgaagtgaggaagctagccatacaaagatctagagaaaaacattgtatgccaagagaacaagtacaaaaatcctgggttgagaatggccatgtctggaaagcctcaggagggccagggaggctggagcctcttgagcagggaagataagtggtaggaactgaggtcaggacactccagccttggagttcagggtgaaaggttggagtctagaccatatcatatgtaattttttgtgactttttttttttacttggaaatatatcctaggtagctgggcatggtggctcatgcctgtaatcccaacactttgggaggccaaggcaggtggatcacttgaggtcaggagtttgagaccagcctggccaacatggtgaaaccccatctctactaaaaaacatacaaaaattagccgggcatggtggcaggtacctgtaatcccacctactcaggaggctgaggcaagagaatcacttgaacccgggaggcggaggttgcagtgagccaagatcacaccactgcactccagcctgggcaacagagcgagactctgcctcaaaaaaaagaaatatatcctatgcagagttacagctcagtaaatgtaatcttccaacctcattttgatgactgcatacaatcccactgtatggtgagttacatgttggttatttaagatacttataatttgggcctgggcacagtggctcatgcctgtaattccagcacattagaaggcggaggaggaaggattgcttgagcctaggagtttgagaccagcctgggcaacatagtgagactccatctctacaaaaaagaaaaagttagctgcgcttggtggcgcatgcctgtagtcccagctactcagaaggcagaggctggaagattggttgagcccaggaatttgaggctgcaatgagctatgattgtgccattgcactgtagcctatgtgacagagtaagaccctgtctcagaaaaaaataaaatcctatttctggcagcatttctttgtttttaacttcttagccaatctataaaatactctgtacactgtaaagcacaaaaaacatgttatgaaaaggtcgctcctgacacttgaagccctagaagaagattagggtaataagcaattggtgaaccctgcagcgtttcaccctcttgggctacttaaatgacaagctccttgtcctataatcatagtgtgatcgtccttgcctagtataattaactttgtactgattcccatattcacgtacccagaaacaagacttcattctcccatgtcagataatcacattcttaccacctgcttacctggatttccatagtcagccttctgaaaaggtaactgtggttgaccagatcacgtgcaggtttatctgctcatctgccacatcccagtggggattctgtgggaagcaaaggacacatcgcattcttggcaccaacagcactcactgggactagtgacatcaaagtaccccaaatgcagaaacaccaggcgtgaaggagcgtgcaggtgctgggaaaagtagccttccctttcctgaaagactagacactcagagttagaggaacctcagacatcatcagatcagatcagcggctctccagtgcctaggcctttccattagatccctgacgtgtatgcacctcctgcttgaaaacctccggtgatggccaggcaccgtggctcacacctgtaatctcagcactttgggaggccaaggcgggtggatcacttgaggtcaggggttcgagaccagcctgaccaacatggagaaaccccatctctaccaaaaatataaaaagtagctgggcatggtggtgcgcacctgtaatcccagctactcgggaggctgaagcatgagaatcacttgaacccagaaggcagaggttgcagtgagctgagatcgcaccactgcactccagtgtgggcaacagagtaagactctgtcaaaaaagaaaaaaaagaaaacctccagtgacaaggaaatcagtccttcctaagataaatcatttcttttcctggcagttctacttagaacattcttccctgcatgactgaacatttgtcctcttatgacctgcccctcctggtcctgattttatcccctgggtcaggtagaacaaatcctgtctctctgctgcatcttggactttaagcttttcaaggtgtttttttttttttaattagtatgcaattagtgcttgacttagatttgtattgaagtacatagtttccatggtttgaagaatttattgaaacatccaagccaatttggaagatatcttgaatttcagttttagtgctgaccttctcctctaccaggtcttcctaacagattgaaatattaaatgcttggccaagtgcggtggcttatgcctgtaatcccagcaccttggggggccaaggtgggcagataacttgaggtcaggagttagaaaacagcctgggtgacatggtgaaaccccatctctactaaaaatacaaaaattagccaaagtgtggtggtgtacctgtaatccagctactcaggaggctgaggcatcggaatcatttgaacctgggaggcggaggctgcagtgagccgagattgcaccaccgtactccagcctggatgagagagtgagactgtttcaaaaaacaaaacaaaaaaatattaagtgcttgtgtcatatccttagataagttaggtggttgtgttctgtcctaagaaaagatgtgattcataaggaagatcacatttttgtttcacttgagaactttgatttactacattcttcccttggcagctaaagctgttgatggatacgtgaagccacagatcaagcaagtggtccctgagtaagtgtccaggtggctgtggctctccttctgcctctttcctcctcccccagaccctgcctcccatccttatcctggcccagctttccgctcccccggggaaactgtctcagccctggggaaggacctgggcttggtgatgctatgccagtacctgaggccccactcctgtagctggagccccagggccgagtggggcactttgtccttctacaccctgagaaagacaaagataccccttggtcccctccccaagtcagctgccctggcctccctggcagctgaagctctgttctcttccttctgcaggtttgtgaacgcatctgcagatgccgggggcggcagcgccacgtacatggaccaggccccctccccagctgtgtgtccccaggctcactataacatgtacccacagaagtaggtggcattcttgtgggggtccacaggggaggaactgggggcttggccccaggctggacccctggagggctggggtcaaaggaatccagagctcctctaggtctgagaccacacagccctggcccgggctctggcctttgggagggagagatttgaccagaagtgattggtggtttagagtcgggttgggcaaatgtcatctgttcccctctctcaatatggagatttttcttgctctaaggactgagtggagttgtgatgtgtctggacagccggtgtgagaggtaacaggggagggtatttcagtctgagttgctgtacagccagctgtttgaatggttgttcttttcccatgaagccccaggctgagggcataggctggctcagactgctcccctggtggcctgtggggcttggggtggtctctggcaggctttccccttcccttcatccctcttctttccctcccaagccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgt

SEQ ID NO: 12711 - DNA, 44499 bp, Human
  misc_feature (1)...(44499): n = A,T,C or G
taacatctctctctccacctgtcactaaccagaaatactattgccttggttaagttttgggagggagggaaaactttcctatgtgtcttataagggaaaccaaaactataattaagaccacagcattattattatattagactggcttgcttctggatttaataagtagtttgttcctgagaaaacaaagtattaggtagtagccaaaggtccaaacacatctgtcacttcctacacatccctacatgagccccttgagggagaagagctgtctatggctcttgaaatcccccagcaacttctacaatgtggtaagctgtaaatgctcaataaacgtgtcccatgagaaaacaattgtctggaaatcaaggcttctttctcctcctgaagaccatgccgttttctccatgatagatatccttgctacatgactggagatagctctcaatccctctagtttgttagtgttacatattttttatttctcccatcagttgtttgctaaatatatcttaggggaaagggagtcccctacaattactgcactgttttaagtgattttaagttactactgatagcacgtgctgttttcccacaataatttatctataaaatcactcccttaattgatcaagcatctgtgagttgtaaaatttcttttggagcaaaagaaaccaccacaaacatgtgcttcaaccacagaatgtgactgaccatggttaatgggaacatcagtgcttctgccctgtgagttagaccaaaattatttgtccaatataatagttaagacctcacaagcccaaatgaaataccaatgttaggtacgctacagctgatttgatccagccaacatctctaaagtcatttgctttaaattttcaagagtcagggtattactcttattatcagagcagccaaacatcacatttatgaaccatcacagaacacagatcctttgcccctaagtcagacaataggacaaaggtgcaatctgtaagattctgggagtataagtaaaaagagaaagaaaagttgatttagaattaagtggacttagaattactggccagtattcaactatgtgagaacctgactcactcctgaagggaaagctgtgccagcaactgctgccaggtgttccgagtagtgaatgcattcaactagccaatttagaaagagcgtttatttcagtctggtctactaaactgctctcaagcacagcactgttctttcccagaactggagattcaagccaagcaaggttacccattccagtgacaggaaatggcaaatatgattaataactccttgtcatctaaatcactccactgttggataacttctagccctccttaatagtcttgtgtctcttgcaaatataatttaattttatcttctaatattttatggatgatgaaactgtgagccaaagtcactaagtatagttgcatcttattcttaaaccaattctttatcaaatttgcttagtcaaagttgcctttgaaattccactaagtcagacattaagtacatggtatacaatctttcacattagtatttacatatcacaaacactcatgtaccatcttttaacaaatcaaaagcagctagttttccttccaacatcagaacaaatctgtttgttcaaccatacaataaatgaggtagttggcttcacatctggagaccgtgatgtttgaaaaagtctctaaacactagaatcactctcaatacagcaagaaactcaaaccattagaacgcaaagggaaccgagaccacctgagtacacaggtagctcagtggggctgtcctcactgaacgaacactgaacacaattgcatgcactatttacatggcaccttttttggtcccagtcctgtacaactgtgtaagatgatgcaactgcactgtacctttcataaaatcctcccaccgaggctgtgattcaggaaggcccaggacccagggtttcaacgtcccaccctgggaacttccacaaggtctcactgttctcagttcatttttctttccctgtgccttgcaaaacatgccatatgttaggtcttcaatgcttgactaaatacactgcaaccagatttgggaaaggtataaaatgaacacttgaaaatctaagtgtcacaaactccctattaagagcaggcaagatctcaaaatattttcccttcaccaccctattcctttccgcaaggcgaagccctaatagtcaatagggaaaaaagaactcattcatctgtaaggaatggaaatgctacatgcaaaacccaagactggaagtttaagaaaagcctcatttgctccagtacagtatataacgttccttcaggaggaataactcagaaaaggcattaaaaatgtgggagacctcagcagaaaaacaccagcatagtatctagggagtgaacgggttagtggaaatgaaaacattacacatgtgtaccatgtgtacatatgctctatgaggcaatgtgtatagacaactagaaaaaccacacagcctacttttctctatagtcacacaaactcattgggtaaatgagttagaaaaagagaaataaaattgctcctttaaatcagaatcaggtaactgcttaaatacataaaataccaaatcagaagaaaagtctaaagatatacttttggtaacttcataaaattcagcctcttttgacaattttaaataaggctttttttcttgctttgtttttgttttgtttgggaggattacagtttagggataagcttttcaagttcactgtatttttctagcatcaatcctgaagtcttgtatttcacatgtcagagtaatctgcactagtattttgagcaactctcattttatggtcagatgtggcagaagttttcctaaccatattagtaggagctttcaaacattttttaaaggaaaaaaaaaaggcctgtcttgtggtgcttcttcccaccactccattgatctgtgtggcaagggttcctacaaaattcccagggaaggggtaactttcagtgccataaaccccattcacagtaaggattttcaactacaccctaaaactatgatggttctgggctcctccaacatatagctcagtgaagatcatcttgcctgagaactctgaggtccttttcactgctgccaagaacataaaactaggagagggtatctgaatggtgaatgcaaagtcagcctgcactgtgtagcagtttacatgatgaagccgaatttaagaactgatctgctagatggatcccactggtagaaatgatccccttgccaaggttaagtgtcacctctaaaggaagccctaagtccaaatgagccttgtttacaaggtataatataaagagacccatccttctaatagctaagtgacctccaatcccaaagcagccactctgggagaccacacacaccacagcaatgctatcatggttggtaacaaggaatccctctttggaaacagctttctaagcttctagcatttttaatacccgcaaggtaaactttcatcctttcaggctgtagttcattgtgctaacaattcaagatcaaatcttgtgagccagatggtacaatccaggtggatactgtaaattttcatcagtatcaaaaacagcgactacagaataatgacaaactttttgtgtggttcataaactgattccaaaagtgactgcagaactagccaaaaagcaacaagtttgtactaatagctactatttattagatagtctgcaaagcactgtgaaacattacatacattatctcaattattttttatgaaaaccctatgaggtggatatttacgtccacgtctacagataatgcaagagtttctgaaagaataagctacaaacccgtgacatgcaatttacctattaaatgaatctaaaagtttaaaaaagccgggcgcagtggctcacgcctgtaatcccaacactttgggaggctgaagtgggcagatcacttgaggccaggaatttgagaccagctttgccaacatggtgaaacctcgtcgttactaaaaatacaaaaattagccaggtgtggtggtgatgccagctacttgagaagctgcagcacgagaatcacttggaccgggaggcaggagttgcagtgagccaagactgtgccactgcactccagcctgggcagcagagtgagactctgtctcaaaaaaaaaaaaaaaaataagccacttgcccatgatcacgctgctaggaaaagtcaaaccataatttaatcctaatctgtcacacacaaagacaacattgacaggaataaaacttacttccatgtaggagagatgcaagttgtcaaagagaagcagaatcactttatcatatacagaatcaatgtcatcactgtctgaaaaaagatgctctgaacaattcttccagtttattgattctgaacctgccatgtcttcaaaaatggcattattagtgaagctgctcaacaagtcctctgaaacaaaacagctagcgaaatgggtatttgtatttagtctaaattatacttttaggacttcatcttatagctataccctgaatcgatatgcttaataacattaggattgaagttatcactgtaatagcaaaagaacaacctaagcattcaccagtagcagattaaatcaattatgttatatctattcaaaaaaattttaggcagccaaaaaaagaatgaggttccttgctacttacatgctggtatagaatgatctccattaaaaaagaaaaaaagaaaaaaaaaaggtgagggctagacctccatgtatagttactatttgtgttacacgtgtttgtttaggcacagactctttctcaaaagtataaggcgaagtggtaacagtaacttgtcaaacaggagccaggagccagagaacaggggtgggagaggccctttatatgaaattacttttgtatcttgtcccatggcaaaagttaattattcaaatttttttttaatttaaaaacaatacaagctgattatacatttgacaaatacaaggaatttctgactgcaggaaaaaacaaagcatcaactacaaagagaagcagaaattcttcttgagctgctgattttactatacatttgggctatattttttcttaagacaatcactacaaagtaataatataaataccttttttaatgtgaaaaggtataaaatctcctttaaaaacttttcacttatccatcatataacatcaaatgtacctgtaatcccaagtatgattcttttgagaaggaaaaaagtcagatcaaatacatcattaaggaaaaacatgcacactaaatagactatgaactctactgggacaaagaccattattttgtgtattttttcattccccaattcctgacaggattctcagaatcgtttcttcatgaatagcaaattgacttattggttaaattagcaactacagagctgcctaacaacagtacaaaataaatgaataattcaccagaaactagctctagatactaattttaattactttgcagcaacataatttagtaccaaatgtttaacaagtacccattataattactaaactgtgaagtcactattatttgtatctgaccagctatacaaaactcatcaatttttcttttgaaaaaaggtagtaaaaatcgcaaacgataaagaagacactactcattaaaaggtcatgtttactaatctagcaccataattccagtcttagaacctcccatgcagttggaaagggattatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaatcagtatatcctgaaggcagtgctggaggcagtctcatgcactagggggtttcttcttggcatccaagtcctttttaatttcttcaagttttttagccaggtttggtatctttgaagagaaaaaaggttattataattttgcatctacctaatcaatattcttgtacttctcttcctccaaagataaatggttttacaagcttttatcttcctccaaaagagatctgctaaatagtggttatttctttttgctttcttttttaagatagggtttcactctgtcactcaggctggagggcaatggtgcaaacacagctcactgcagccttgacctccagagctcaagtgatccttcccgccacaatcccgcaagtagttgggaccacggacatgccaccacccctggctaatttttgtattttttgtaaagatgggctttcgtcacactgcccaggctggtctcgaactcctgagcttgagcaatctgcccacctcggcctcccaaagtgctaggattacaggcgtgagccactgcacccggccaatagtggtatttcttagccttataactgcatgtgaaagatatcagaagttgtcagataagtatgctccttctctgaaacccacttctacttttgtatacccacttccgctcgatctggtgccaagtaaaggttgtgcatataaacaataaatgtgacataatgtagcctttgcctagaaaactgtatgactcaaacgaaggttgacaaaggaattccctttgtcatatgaaaagctttataacaaatcaagttagtatcatgtttcccttgcttgtctttttcaaactcctgtccagaatccccattcataggctgctgcaccacctggttttcaacatcaccacctataaagtgaggttaatacaacttcacaaaactctgtccccaaatgtgctacacttagaattttggagatggaatatagatctatatttttcagtccccctacccagatgcatctccaaaattctaagtcatctctactactggatagtggggttgaaaatattatccaattaatttttaaattctcacttatcacatgatttcccaaagaattttaagagcccaacttaatattactctcggctaacaagccacagctgaggatgatcatgagcccagctaaactgaagggattttgccctcttgtggtgatatggaggacagctgtttcatgagttggattactttttcaaacaatggcaaaccattctacaatattcaggagttttgcctcagccatatggactacatttatgctggaagtcacaccttacctcaaacaaagaaaagtcactctaaaacagttacatggaatcaaggaagtcatggatatggccacttacatcatagttctgagccagatacattccaaccacgttgcccagtgtaaatccaagctgaaaaaatagaacagtaagagtgatagtgcatgccgagtcctgtgccagtctgattccaaactaaaatacatagacaatatcttcctaagaagcttaggacagttagaagaccttgatgtccagtctagggctgtgtacaacatgagagtcacatttttcttctataaacacagagatgccctctccagaggctaaacagcatacaaaagaataaatggtgacaccaaccaaacataagaaaaaaataaaacaacaaaaaagaataaatggtaacactgtataaagctaccctaaattctcttatcccctcacaacccacataaatacttgactacaagtcctggaaactcaagccaaagttcagatttttcttgttgcatgctgcaatttttttgtctttttttggttatggatattgttattcctttttaaatcaaataaaaattattcagtttttaaagtattcagtcaaggccgggcacagaggctcacgcctatatcccagcactttgggaggccaaagtggtagatcacttgaggtcaggagtttcagaccagcctggccaacatggtgaaacctcgtctctactaaaaatacaaaaattagccaggcgtggtggctcacatctgtaatcccagctattcgggaggctgaggcaggagaatcacttgaaaccgggaggcagaggttacagtgagctgagattgtgccactgcactccagcctgggagacagagcaagactctgtctcaaaataaaaataaataaatattcagtcaaatcataggatctcagagaatgaagggactcttcacagtttacaatctcttcatagttcaaaagaggaacttgaggcccaggatgggaagggacttctccaaggacattcacaacaaggaggacaggacaatctacattagcttcacactcaaaaactaaaatatgtgattacagaaaagaagagaaaactctgacacaccactgagagcacatatggcttagcactctgccacaggtacagtctaacaggcaggacatttaaggccggtgggaaacacagtgacaagagacgggtgcaatttttagaaaactttaaatatttatctcatttggtgactattttcctaaacaaaaactggttcatgaaaatttagatatatccaaaagggccaaggctcctcagctttgagttttaatgataataattccctgttttcctctggtaactaagaggctccatctggagcttaatttctcattttataaattcaaactagcatcaatttttttcatcattttctttaatcattgttgcttttattcaatcaatacacagcagagaggtttaaaaaaataaaatgtggcacttaacaccatcaatcacatggcatgactgaaccttctcttcaagttggagatgcacacaggggaacagaatgcagctgggtccttagtacactttaaacttactaagcttgaaacaccaaaagtataatttaaattggtttgttgttagcaataaaaatcatagaagagtctatcttatctctaatcatagaccgttctgatcatttgattaatcagatatggcctgcaaaatcctacttttaccagtgttgcaccttgaaggagaatgatttttttctcctatgggttgaaaccaggtaggaaatggttttccaaatccagaaggagtattaaatttgcttaaaagaagagaaaacaagtcaaatgaaagtattagctctaacaccaaaaagaaaaaacatgggatttaaaaactttcaaaaaaaataatcgagttctggttccaccactatcaagcggtgtgcctaaagcaagacacttaacctctctggagctttgctgatttgagcttcctgatttataaaacattatactcacaatgtaatgtccagctccaacatgctaagattcctagttcttaccaaatgtgtctctaaataaatgtggcatgtctaacgtggcttcattttggcaactttgccaggtatcagggcacataaaaaactcatgattattttaaaacacaacacaaaacaaaaaccatgagcctctaaacaagtcatatcaattccagtttcagaatactaccggatctaccaaaggagtatcataagattaaatacacaagaaaaatatcactaagagaaatgttgggaaaaatgcatgaagccagaaaagcatatacagtatgtcattcacgggatggtcagtaggcaagtttagacaaaaaagtaaaacctaaatctgaggaacagtgactcagtctgagaggttagactggagtcagattataggaggtcttggatgagtctgaaacctccttgcaggccaagaatgcctaacttcttccaggccaagacctggaaacctcatcagtagttctgtcagctgaatgccatcacaatgccctgcttcccccatatcacatggtcaccccttagtattccctgtagagaagactgtggcataaggaatgcaatgctttcttcccaagctcaacactaagtgcattactatcacaccctctctgtaataattttgagactttaggggtatgaaaaagtagcttcttttcacagaaacattggggacaattaatggtaaaacactggaagtttgagaacagaggactgagatgaggaaagtagtgtacaggaaaaatagatgggaagaagatactggagctaagagccccaaaagagaagtctagactggcacagagcagtacacaacagaagaatcgcattgtcagctctataaatagagagtacactaagaatcagtgaagctccacaatccattatccacaattctgaaacccaactcaatccaaactacatttcatcataactcatttggtagcaaaagcatatctgacctgaactaacaggagcctatttatgtcattatcacactttagtgtgaataatcattttttgctatagaaatagaaatctttaaatataggatcctgccttagacctcctcgctggagaatatgtctcacaccaaaaattttaatacatttagattacaaagtgctatcccagatgctgctgggggtgttaagtaccgaggtacatgatgcagcttattacttttctaaaatctgaaagaaatctgatttcccaaatacatacggcccctaaagattttgattaagggactgcagaccttatactaaaaatcaacctcatatttagccccatgaaaggattaaaaatgatctctgcccttagagaacttatatgatgaataggaagaaatgctaggtaaaatagttatataacaacagaaggcaggaccctgcacaggattttcaatgttaacagatgctccaaacatcagaactaggccatgcattaagtggcaaaatgaatgacacaaaagtgattcttttaagaaatcatacttgaaaaatatatacctcaggttgatattaaaggctctaaatatgctaagtgttcacatttaaactggtgatatggtttggctgtgttcccacccaaatctcatcttgaattcccacgttgtgggagggaccaagtgggaggtaactgaatcatgagggcaggtctttcccatgctgttctcgtgatagtgaatatgtctcatgagatctgatggttttataaagaggagttcccctgcacaagctctctctttgtctgctgccatccatgtaagacgttacttgctcctccttgctttctgccatgattgaggcctccccagccatgtggaactgtaagtccattaaaccctttttcccatgtaaattacccagtctcgggtatgtctttatcagcagtgtgaaaatggactaatacaactggtaaaggaaatgcgaagaaaactgaatgtggaaaatcaaggcacgagatgggaatggacatgtgatgactggcataaaagaaacaggcctgactggaaaagagaattcgagttaaagaatggagagaattaagtatggaaagctggaaaggtctagatgttgggcttcaacaagcaggtagggcagccaggtacaatggctacgcttgtaatcccagtactttgggaagacaaggtgagaggatggcctgagcccaagagtttgagaccagcctgggcatcatggtgaaactacatctctaccaacaaaatgcaaaactagccggatgtggtggcatacatctgtagtacccagctactcctggaggctgaggtgggaggatcacttgagcccaggaagtagaggttacagtgagctgagatcatgccactgcactaccagcctgggnnnnnnnnnnnnnnnnnnnnnnnnnnnnnnnnnnnnnnnnnnnnnnnnnnnnnnnnnnnnnnnnnnnnnngagtttccttcacatgcaatcatggtagggagacactgactactctgccctcagcaacatgatgaaagcactgcctgagaagcactctcccggtacctatactcagaaaaggctgaggaaacaaggacctattagatgatgaaaagatgtaggaatttaaaaaggtaattttttttttaagaaaaccaagtacccattagagaaaagccgattactgtggtggcaaggaaagaagactgaattgtttctattgatcaataaagatcaatggaataaagtggagagcccaggaatacaccataaaggcttatggtcaagtgattttcaacaagagtgccaaggaactcaatatagaaagaatagtctttccaagaaatggtgctgggaataatcttttcaagaaatggtgctgggacaatgggatatccacatgcaaagaataaaggtggactcctatctcacactatatacaaaaattaactcaaaatggattaaagacctaaatgtaagagctaaaactataaaactcttcaaagaaatcataggcgtaaaccttcatgagtggggctgggcaaatagttttcttagatatgacaccaaaagtacaagtaaccaaaaaaaaaaattggacttcatcaaaattaaaaatatctgtgtttcacatgagtggggctgggcaaatagttttcttagatatgacaccaaaagtacaagtaaccaaaaaaaaaaattggacctcatcaaaattaaaaatatctgtgtttcagagaacaccatcaagaaagtcaaaagacaacacacagaatgagataaaatattttcaaatatatatctgataagggatgtgtatccagaatatataaataattcttacaactgagtgacacaaaaaaactcaatttaaaaatgggcaaattggccaggcacagtggttcacacctgtaatcccacagtttgggaggccaaggttgggggatcacctgaggtcaggagttcaattaccagcctggccaacttggtgaaaccccgcctctactaaaaatacaaaaattagccaggcatggtggtggacgcctgtagtcccagctactcgggaggctgaggcaggagaaatcacttgaacccaggaagcagaggttgcagtgagccgagactgcaccactgcactccagcctgggcgacaaagcgagactccgtctcaaaaataaataaataaaataaaacaaaaataaaaatggacaaatgatgtgaaaggatttctccaaagctacaaacagtcaacaagcatatgaaaagatgctcaacattagtcactgaggaaatgcaaagcaaaaccataatgaggaactacatcacacccactagaattactttaacaaaaacaataagagctacacgaaatgttggcgaggatgtggagaaattgaagccgtcatacattactagtgagaatgtaaaacggtgcagctactctggaaaacagtccaaaagttcctcaaaaagttgagcataaagataccacataatgcagcaatcccactttagggtatatactcaacagaactgaaatacatatccacacaaaagcctgtatacaaatattcctagcaggattactcatcatagccaaaagtggaaacatcttgaatgtccatcaactggtgaaataattaacaaaatagaaataaacataacaaacaaggtgcaagataattattcagaagttactgaaaagacatgagacctaaataaatgaggaaatggatcataatagtgtaatagtgtaaggccaggcacagtggctcacacctgtaatcccagcactttgggaggcagaggcgggcagatcacatgaggccaggagtttgagaccagcctggccaacatggctgtttctactaaaaatacaaaaattagccggggatggtggcacacgtctgtaatcccagctacttgggaaggtaaggcacgagaatcgctcgaaccaaggaggcagaggttgcagtgagccgagattgcaccacagcattccagcctgggtgacagagtgagacgctgtctcaaaaacaaaacaaaacaaagacataatagtgtaaaggtttcagaagcataagtcatcaggagggcctcatggaaaaagatcaaagtggggccttgaagagtatttaggaaggcaaaaaggataaagggaaaaccggccgggtgcaggagctcacgcctgtaatcccagcactttgggagaccgaggtgggtaaatcacttgaggtcaggagttcaagaccaggctggccaacgtggtgaaaccccatctctactaaaaaatataaaattagccaggtgtggtggcatatgcctgtaatcccagctacttcggaggctaaggcaggagaatcgcttgaacccggaggctgaggcaggagaatcgcttgaacccaggaggcggagggtgcagtgagccaagatggcaccagtgcactccagcctgggtgacagagtgagattctgtctcaaaaaaaaaaaaagcaacagattacaataacacaataacagcatcataggcagtgtgcacaaagcccccagcagtgccatcatgttagcttcccgccaaaagcatccttaaaataactctagctaaaccttacgattaaggaagcagtagcttccctcaggtagtgttggtaactatctgcaaagaggtgtcttttactgcagtaaaagaaaggggggtgctcactttggcagcacatacactaaaactggaatgatacagagatcagaatggcccctgcgcaaagacgacacacaaatttctgaagcactgcatttaaaaaaaaaaaaaaaagtctaggagcagtggctcaagcccataatccaacactttgagagactgaggtgggaggattgcttcagcctgggagttcaagaccagcctgggcaatatagtgagaccctatctccactattaaaaatagtaataataaaggggaaaaactgcagtaaaagaaaaggggaaaatcacaggaacaaggtctcttcaagatagggacaaagggagaatattttaatctgaggaggaatatgaataatggaaggacgttatcaccaacacaagcaagtgcagtggttttcaaactgtccacaaatcacaactgtaggagaaacatcttagacggttccaaaatgtgtaatgacaacgcactgcttaacttgtgactgtttcatcacttctaaacctttcctatcacctacccttctgagagaagctaatccccacttgagaagaaactcaatcagggttcaaatgaaccctgcaaaagaaaaactgaacactatctgaatccttgttgagtgctcctgtttttaagttctttaatgtgttaactcatttttaatcctcacaacaaaactgtgaggtgggtttgcattttcagatgtggaaatgggagcacagaaaatttcaatagcccacccacgctaccacagcttgaaaatgatgggaggcagagttcaaactgagaagtctgactctgaagtttaatctcttaaacactagaacatgatggtcattttttaatagatgaaatgactgcacacaaagagaaatacttgctcaactttagagtcagtggctcatttgacagaggtggaatcaatgtgaaaagtaatgctatccacttatttaaaaaaaaaagcaatgaggtggaagaccagagggtgagagaacatcagtgttcagttacttctgagctaggaatataattgacagctttagcatctctccttaaatactgagaattctgaattctcaaatcagaatctgaccaggcacagtggtggctcatgcctgtaatcccaacactgtgggaggcctaggcaagacctgtctctacaaaaaaaaaatttaaaaattagtcacgggtggtagtgcgggcctgtagtcctagctactactaaagaggctgaggtgggaaggctgcttgaggccaggaattaaagactgcactgagccatgattgtgccactggactctagcctaggtgacaaagagaaaccttgtctcaaaaaaaaaaaaaaaaaaaaaaaattaacacacagtaaaagtttattgcaaaaccaaatagactcattctgcaaaaccacttagaaagttaactgtaattgaatcatgtcctctcagtttatcaatgagcaacagatatagtaagcagctcaattacatcattctatactctggagctaagtgataccgcttttaatctagtgtttactacaagaaaatgactgtcattattctgaactcctaaactaacatctagttaggacactacagaaactcctagaggcaaaggagcagccctgtcttagctgggcagattaaggacactcttttgactaattggatttaacaatccattaccatctttcaaaaggacaaaaggggtgcattttgtgttttaatctctttgataaagatacagcatttggggccgggcgcggaggctcacgcctgtaatcccagcactttgggaggctgaggcaggcagatcccgaggtcaggagatcgagaccatcccggccaacggggtgaaaccccgtctctactaaaaatacaaaaattaactgggcctgctggcgcgcaccagctactcgggaggctgaggcaggagaatcgcttaaacccaggaagcggaggctgcagtgagccgagatcgcactactgcactccagcctggcgacagagcgggactccgttaaaacaaacaacaaaaaaagatacagcatttgagccgggagcagtggctcacgcctgtaatcccagcactttcgtaggctgaggtgggttgatcacttgaggtcaggagttcgagaccagcctggccaacttggtgaaacccgtctctactaaaaatacaaaaattagctgagcatcctggtgcgcgcctgtaatcccagctactccggaggccgaggagggagaatcggttgaacccgggaggcggaggttccagtgagcccagattgcgccactgcactccagcctgacgacacagcgagactccgtctcaaaaaaaataaaaaataaaaaaaaatagaggttgaaagcatcaagttttgaatgcacaatagcttggcagaaaaactttcacttgaaaatttgatgagcaactcctggaaccttcaccaagcaatttttgaaatataccgagttttgccagaaaactcgtttttaactcaaataaggagccaagagaaatagtctgcttactcatgcttacacattttgggaaaaattacttgtataccagtgtctgactcattcctccaactctgaaaggtctgatgaggacttagcctctcggacttcgtgaggtggctaatttacggtttattacctggccttcctacctcctcagaaaagccaactagcagggctccacagcagggaccggccggcgaccatgtaatggaacaggagcgcagaaagaaaggggggcggactacgaaaagtcatcaaggaccacacaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcggcatacttaaaatcatggtggaagctaagggaagcaaggtaatatctcacatggtagcaggtagtagaaaaagggaggggggagctgccaaacacttttaaaccatcagatctcttgagaactcactcactatcaagagaacaacagcatgggggaaactgcccccgtgatccaatcacctcccgccaggtccctccctcgacacgtcggggctacagggattacaattggagatgagatttgggaggggccacagagccaaaccatatcaccatttaacaagtaaactcaagtaagttgagtttactcctaataggatctctctctctttgccattctcgaatgccagggaaaggaaaactgatgggtcaagatggtgtcagatgctccacaatcaactacaactagaaagggcagggtctctgaactaaagtggctgccaagagggaagagggaagggatactaggagatggctacaacacaccatactttccagtctgtccaggttaaaacttgactcactcaagacttaaccagtgcttctcaactttaatcttcattcacatcacctgggcatcttattaaactacaggttctgattcagtacgtctatggtagggcctaactttctgcatttctttcaaccccaaatgatgttgctggtctatggaccagactttgagttgcaagatgccggactgtgagctacactgagggtgaggacttcacctgttgagctcatgactccatcctcagcgcccaacaagtgtctggcacagcctctgaacgcaatataaggatagttattaaaatttatttcgtagaaccttatcctctccttaagataaggcttaaatgaagcctagcttttcctctaaggctttttcaaaggtgttttctctaaataaacacagggcatggagaagcaaggcaggactcttttgttccccactgctacttccagattatcccttcaatatccttatataaaaacacttcctttacttttcctgtttaccattagctcccccttccctttttttttttttttttttgcagtggggtctagctctgtcacccaggctggagtgcaatgccgtgatctcggctcactgcaacctccgcctcctgggttcaagcgattctcctgccttggccccctgagtagctgggattacaggcgcccgccaccatgcccagctaatttttatatttttagtagagacagggtttcattgtgttggccaggctggtctcaaactcctgacctcatgatccacccgccttggcctcccaaagtgctgggattacaagcgtgagccaccgcacccagcctacctttagcccttcttaatgtcttaatctgttgatttctgaggcagtctcctcattcactgaaggctttggcatctaacccacagccttcctttcagtgccacattatcgtaattttgggtgacttcaaggccatatgcacttgtactttccagatctccttccttccagtgaccttcaccttcactccccttcagcagtgctctaccgtgatcgttaacactttgtcatatcctagacctgtgaagtatactcccaaatcctacctcctctcctatcagccctttgaccttagccagatctccactcagctattccatattctcatgagctatgagcccccttctggaaggcttcagtccttttctgtctagtctataccccaagagaccagcactttaaggaccgttactctcaattctcttatccagtggtcttctctgatacttgccttttaaaattctaatttttgatctccaccttttccagtcccataccagtgattctaagcactaaatggagaaaagatggatcattcagcaaatgatactcatctaaccaggatcattacgtggaaaaaataatgatgttgggttcctactttacactttgcacataaattacagataacataaatggcactgcacacataagtaacagcttaaacaagacaaaaaatattaaaagagtaaaagagagaagttattttataatctacaaatgagagtggaagctttttcacatcgccaacatgatacaaaacccagaagccataacagattgagaaaatcaactacatcaaaatttaaaaattctgtaaacactttttgtgaaataagtgacagtgctaacttcctttatataaagatctgctacaaatcagtgagaccaatggctcaataaaatatggccaaaggatttgaacagttcacagaaaaggaaatacaaatggttcaaacatatgaaaagatcctgtgggtggcatttatgttaatactaagagaaatgtggattaatactataatgaggtaccatttttctccagattggcaaaaatcagaaagcttggccaggagcggtggctcacacctgtaatcccagcactttgggaggctgaggtgggcagatcacttgagtccaggagtgtgagaccagcctaggcaacatggtggaaccccatctctacaaaaaaatacgaaaatcacctggctgtgatgatgtgcgcctgtagtccagctacttgggggtgctgaagcaggaggatcgcttgaacccggaaggtcaaggctgcagtgagctgtgactgcaccactgcatgccagcctgggtgacaaagtgagaccctgtctcaaaaaaaataaaataaaataaaatttaaacagcttgataacatactgtgttggaagaagtaggggaacaggcacagtttacacaacattgaggggagaatgatttgttaaaactttcatggaggcagtttggccagaactataattttaaataagcataactttttcctagcaattgctgaaattatgctcaaaaacattcattgtagaaaaaggttggaaacaatgttaaccaataaattaacgattaaaatcatgctatatatctacattgaaatacttgtgcacgagaaaagagctttatgtgttgatatggaaatatcctcaagtgaaaaaagcaaggtgttggtatgctaccatttgaggcattgacaaaaatatcagtgggaaggaatgtgctattcaataaatcataaaattatccatatggaaaaaagtaaacgtagattataccattcacaaatatcaatgccagagaaattaatgacctaaggaggaggcaacatttttaaatgccaaaagaaaatacagaagagtatctttatgatttcaagtgggagaaaatttttagataaagagcacataccatcaaggaaaagatttgacacattaaaatgtaaacaagtataccataaaaaagttgaaaagataatccaacagactggttgtctgaaaagagaaaactgaaaaaaattgaagccattctgaatggcttcaattcagccatgtgtaattaagcaattacatataaattcaggatgtgtaattacctcatacacatcaaaaagaaaaaacccaatagaaaaaaaaatgggtaaagccttttgaaggggggaaagaatggtacacaaaatatgcaaatcaattgagataatattttatacccattagattggcaaaattaaaaagcatgacaactgggccgggcgcggtggctcacgcctgtaaccccagcactttgggagaccgaggtgggtggttcccgaggtcaagagatcaagaccatcctggccaacatggtgaaaccctgtctctactaaaaatacaaaaattagctgggcgtggtggcatgtgcctatagtcccagctacccgggaggctgaggcgggagaatcgcttgaacccgagagatggaggttgcagtgagccgatatcgtgccactgcactccagcctgggcaacagagcgagactgcatcttaaaaaaaaaaaaaggccgggggcccatcccggttgcaaggttttttaagaacaagatatttgaagtatccctccatggatcacttgttataatgggaaacacatattttacaacaaagatgtgtgtcaaataccaccttaaccaagtggtcaagcttaatataattggacacactgatatgcacctcctcctgatgtgatacactgaaggcacatatcagctgtacaagtgtggtattctggccacaactgtttaacctgtttaaaagaaaacaaattgtaggaccttttccaaaacagctaaaaaatgtcagttataaaagcctcccatcctccgaaaagccagggaactgttttagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccgggttcacgccattctcctgcctcagcctcccggtagctgggaccacagacccctgccaccacgccgggctaattttttgtatttttagtagagacggggttatcaccgtgttagccaggatggtctcgatctcctgacctcgtgaaccagcccgcctcggcctcccaaagtgctgggattacaggcgtgagccaccagcgcccggccaatgtgtgattcttaattggatcccgggttaaaaaaaaaaaaaaaagttataaagtgcatttttgggacaattgaggaaattttaatggacagattagatatttttattgtattttattgtcaaatttcttggatatgataatggtgttgtggttaggaaggaaaatatccttgttcttacttgttaaaatatttagcaagtaagtgtcatcatatttagtaagtgtcatagtgtctacaatttagggaagaaaactagcatatatatatacacacacacaaaaaaagcaaatgtgcaaactgttgacaactggcgaatctaggtgaaaactgtatgggttcatggtacctttcttccaactcttttgaagatttaaaattgttcaaaataattgggaaggccgggtgctgtgatcccagcagtttaggaggtggaggcaggcagatcacctgaggtcaaggagttggagaacagcctggcaaagaaggtgaaacctcatctctactaaaaatacaaaaactagccgatcatagtggcgagcacctgtaatctctgctacttggaaggctgaggtaggagaatcacttgaacccgggaggcggaggttgtagtgatctcagactgtgccactgcactctagcgtgggcgacagagcaagacttagtctcaaaaaataaataaataaataaataaataaataaataaataaagttgagaaaacactagacaaatatttagaaaagattatgttgtatattaacagctgttacagcccagattaagttcagacataatttctatattactaactgaccaaaactacagtagtaatgactaggaagagagtatgtacctctttttgattttctaacccaccaaactgattcactcagtaaaaatgccatatttaaatcctgcatttatttaaaatttaaatgtagcttttcaaaacaaactatccaacactggttttatcctctctgcttgcttcggtgaagagtgcgtgctgcacctggcgccctctctccatgccccaggtaacagaatgcagaggtcaggctgaatgtcagcctctccccgctgtgtcacacaaacatttctggtcagcagtatgatgcagctgcaggcctgcccgcctctccctcccacacacttctccactgcccccgattctgatccacagtcagtggtaatttgggacaaaatgataagaaaacaatatgaaacacagtaaatccaaaatctttatttttttaagactatagtcttgtagtctgatagtaaagggaggaagccttaacttgcaaggatatgtacaacatactttttatttctatggaatggaatcaaacccagacagagactacagaatatatactagaaattagcaaatgccaggaacggagcaggaaaaagacaaatgaggcctaaacacacaaaacccttcactgggatctgttgactgcagccagaaccagggctggatcacacaatggaggcaggtaccagggccgcaggaagggaagtagctggggcagggaaaggcccacactgggataccggtttagcaccaggtaaatcactcttggtatttatatacaaaatcagttggctctatttcttagacatacacacagaaagcaagatttgatcattactttatgaatctgtcactttgcaataccggtattatcaagaaatagggacaactcactcagattcaaatttcagtagcaggaaataaatatcgaaacaccatcattggccctcagtacaaaacctctacatcacccaatattgccctccctgcccaaccccaaaggaccactccctggtggctgcgacttcactgctgccatctccaatacataccacaggtgtcatgcagccctccttaaggctggcaccgtaggcttaaacaattggctgagaagcaggagagaaacacgccaaaggttctgtgctgcaaacacgacccctcttttttttacaccacaaacttctttaaggatctggtcactcaattggagggataaatagctttttagaaaaagagaagaaagtctttaaaaaggagaaagtgtaaatctgattactccaaaccagtcatcctttttttttttttttttttttttgagatagagtctcgctctgtcaccccggctggagtgcagtggcacaatctcaactcactgcaacctccgcctcccgggttcaggcgattcccctgcctcagcctcctgagtagttgggactacaggcacgtaccaccacgcccgggtaacttttgcatttttcagtagagacagggttttgccatgttggccaggctggttttgaactcctgacctcaggtgatccgcccgcctctgtctcccaaagtgctgggattacaggcgtgagccaccatgcccggcccagtcatcttcttaaagtcatcttcttaagagcagttcacagattctcaaagtctgttaaacagaggtgagcatggacctggaggcagcctgggtggggcaggtgtcctccaggcatgtgcctgggcagggctgcaggagctggtggagtgggcaggatactgtgctcagaggtcaggctggccatctgtcctccacagaaaaagctgccaagctagggtgttttggtctaaaaattcttggtggagacagggaatccctgaagggaacacttttttttttttttaagttatagtagaaatggggaaggaggacaagagcttttttgggggggtggggtagggagggggacagactcttgctctgttgcccaggctggagtgcagtggtgccatctaggctcaccgcaacctccatatcctgggctcaagcaattatcctgcctcagcctccggagtagccaggattacaggcatgcaccaccacgccaggctaatttttgtaattttagtagagacagggtttcaccatgttggccaggctggtctcgaactcctgacttcaactgatctgcccgcctcagcctcccaaagtgctgggattacaggcgtgagccactgtgccaggccccaagagcttttacataaaaatttaaaaaacaatttttaagggagaaagagaaaaatagtctctcaaatggttctgaggaaacggaaaggaggatgatggagacagtgtttattgctggcctgccctgagtaactcagctggcctccatctggagtttcttcctacttcaggcctcttcaggctccaactctgagctgcagtcggagcccccatcaaaggcagaggtggtgctgcccttggcattggtgtagaggatgctgtctgaggagggatagttggcctgtggctgggcacttgacctccccttcggtgcacggacttcctccttcagaagagcattctgccgctgaggtcatcaatatctcagtggcgtgtggtttttcccttcgcatatgctggatatactctatggccttctctccttggagtgttgggactgcgtcccacaaactggaggctgcctttgatgtggtccctacgatttcattccagtgcattatgatgggcccattcgtcagccgcagattgaaatctctgttgttgcttgtcactctccaccccgacgtcatcattatcactcacttcctacaacccagggagcagccactgcagcagcagtagtcggggaggcggagggatagaggaatctgaggaagtcactgacaagaagcagagttcccctgcctacacacacacactcacttgctctcactcacataaaacacaggcaagaaccacctcctcactcctaaaatcccagttcaaaatttagctatatgtcttgtctgttaagaaggcttcatacttcagaagtttataaaatgctttgatttcacgcctaggctctttgctaatcatttctaggttcatacctgtgctccagatgacagagataaccatatgcctgaccagtggagcactatgcactgtaactacattttggatccatttatttattctttcacatccaggacttttatttattaacagaatgttttccagctaatgtttatatctggtgggcggtaaattaattacaaaatataacactgacaaagcctttatatttttctttttttaaacctgacagcataacttcctctaagataaagatgttttaaagatgcttgaaggccagatgcagtggctcatgcctgtaatcccagcactttgggaggctgaggcaggcagatcccttgaggccaggagtttgagaccagcctggccaacatggtgaaaccccgtctctactaaaaatacattagctgggcatggtagcacacgcctgtaatctagctactcgggaggcgcaggcaggaaagtcacttgagtccgggaggtggaggttgcagtgagccacgatcatgccactgcactccagcctgggtgacagagtaagaccctatcaccaaaaaaaaaaaaaaaaaaaaaaccacaaaacccaaaaaccaacgcttggaagccatagaagttttattgtaagcatttaaaaacaacaacaacaacactaggctgggcgcggagactcacgcctgtaatcccagcactttgggaggccaaggtgagcgaatcacaaggtcaggagattgagaccatcctggccaacatggtgaaaccccgtgtctactaaaaatacaaaaattagctgggtgtggtggcgcacacctggagtcccagctactcgggaggctgaggcagaagaatcgcttgaacctggaaggcagaggttgtgctgaatcgagatcatgccactgtactccagcctggtgacagagcaagactctttctcaaaaacaaaacaaaaaacaaaacaaaacaaaaaaacactatgacactatagaataattatcaattttattctatagtgttatagcgtttattctgttactaaatgaaagcaaagacttcctctcagcagtctctcctatgtattaggctgaagtaattgctgtctggaaaaggaaatttgcagtttcggatgatgtagttacttgaacatgaaaacaactgggtaagaaatagagtggtgatcatgtaaatgttttgtcctagtgatagccatcatattaattatatgagaaatattggcagatgattaatttgagaaatttcacaatcatttctaaggaacaaacacaaattactgtagagtcagctctccatatccccacgttcaaaatctgcagattcaaccaaccacagatcacaaatatttgggggggaaaaaaccagtgtaacagcaaaaaataatacaaatttaaaaacgtagtattaaccactatttatatagaattcatattatattaggtattgtaagtaatctagaaatgatttaaagtatacaagaagatgtatctatattatatgcaaacacaatgccattttatataaggaacatgcatgccaaaacataggttttggtatccgtgggagccctagaaccagtaatcaccagataccaagggacaattgtattgtcaacttacgtgcagaaaagaaaaaaacaaaaaaaaggaaaacctaaataattttaggaaaaagcttgactttttcagacattttcacagtattgagtacactattctataagagcatggctatattttagtaaccctgaatattgttaatagtgtaatgtagctacaaagggtgaaaaaattagaattttcagactatgcctttaatctggcattcagaataatatctctatgggaaaatcaccactgttgaaggtttatttgttagattcctgataatgctgatcaaaagataaaagatcaaaagattaaccatacatttgttttgtttttttaaaaagtatttattttttactagtgaggatggaactaggggaagaagtttacagaaaagatgtccatatacaaagaaagaaatagcaaaatatttttggtcataatttagaaagaaactaatctataaaatggagacaattctccccaattcatctctctcatagaagagcataagcacgggctctcagttccttgatatcctcaagaggccacggatacgtctgacaagagcctgtatgaaactatatcgagatcgaacttttgaatataatccttcaatgtccagaagtttcttttgtagtgattctccaaaagcgttgattgcatcagcctgaagctagcggtgacacaaaagacattttgttaaaattgttgtctcaaatatttcttttattctaagtcttccaatttaaaacactttagaatttttgtaatgtggttctttcaatgtaaatacttttgaatttttgtaatgtgttactaaattaactaaacattcacattttctaccttagaattttttggtttaattctcatgtttttcctgctttcttttcttgtataaatttaaaaacctgctttaaatagcaatgaatgttgatgctgatgctgatatactaacatacacacaaaaacatttcctgaagggccatacaagaagtcagtaagactggcgggggagggagggaaggagaatgcagggaaggaagggagggagggaggacaggagggtaggtgggaaagaagcttttactttttacttcattttgcaatttttaaaaacccacttgcatgcttttgttttcaaaaaatattaatgtggggatacacctgttatatgctttagaattcatatatattctagaatgcatatgtagtttcagatggatctttttgatgttatactaaaagactaaaattaagtacaatattagatcaatctacctgttttcagttttgcattaaaatcacaacacagagtgtgagattatttattaatcctgcatttttttctagctttttcacaaagcagtctaaatgaaatagtaacagttattacttcaaaatatatttatttttgttgtcctagctactcaggatgctgaggcgggagaatcacttgagcccagggggttgaggctgcagtgaactgtggtcacaccactgcatgccagcctgggtaatggagtgagaccttgtctctcagacaaaacaaacaaacaaacaaacttctgaataatcttctttggctaattttgcacatggcctcaattaacactagttctcctaaacaagcctagccacaaaacgaattccttttataaagtcactaaggggcgaatgtagtctggattgggatgggagcgtggtattcatgatatccagcaagctgtgctttggaggctgctgtaactgcacctttcattcccaaccttgttttaagaaaaatagcaaaaagagggatttgggaggagcagaggctttatcaaatcatggctaaggacattcagatggctagcagaggatctagctgtaattcattttccctaacatcacacaccctgatacctgctttgttagaaacataactttgctattagtttaatatgaggttttcattgtaattgtttttggcatactcttcattcattctaacactactgatcaacaggttagtaagagcacagtgttgtgtactatggtctatgacggcgggatttgtattggctgctctcaatctcaccattaaattatttcctgaaaaataagtgctgagtgatactttgtacctaaaaagttctacaaagctaatcaaaagacatcaggagtttccagatcataatgcctaccaatcacggaatgcttaccatgttctaggtacaacactagcagcctcacatacatgaaacctcacttaattctgacaaaaccctctgaggttgaatcctcctatttcttagatgaagcaattgaggctcggaagttaagtaagttgttcaaagtcatatagctgttaaaatggtcaagctagagttcaaaccaggtgtctgtaagcaaccctgaaaatcataatcttattaacataccaggctttcctttttacttacttacttacattcattcatttatttatttatttattggagacaaggtcttgcttcactctttcattcatttattggagacaaggtcttgctctgttgcccaggctggagtgcagtggtgcaatcacagctcactgcagcctcagtctcccaggctcaggtgattctcccacctcagcctcccaggtagctgtgactacaggtgcatgccaccacagtatgccaatttttttttttaagagacggggtctcactatgttgcccagactgctctcaaactcctgggctcaagcaatcctcccgtctcggcctcccaaaatgctgggattacagatgtgtaccatcacacccagcccttttactttaatgaagaaaaataaaagaatatgagaatagaaccttacctggtctaaatcatgttggctcactatagccagcccacttctaaaatctagattggtttctgaggcgaaggaatctagagataaaaaaacagagtcataccggctgtgcaagtacctatctaccacacagtggaggaacctgatgacaatgaataataacaatagcaccatgaaaaacacggctcaagattgggaactcaattttcaacttttagcaaatggaagcccctagaaagcatttcactggtccagaccagggttctcagcttttctctatttccttccacctaagggatccaatatatggccatcagtcacagaggcccactccagcaataagaatcagcataatagcagacctcctccattcttctagagctggatcagccccctaactgcagcaagaagctaaggaacagctgatgagcaggctctagaatattcttatgctcagcacaatgtcccgtgaacagaaagtaaaatgcaagaaatagctacgtctagtgactaaacagctcttgattcacccaattcactctaagtaatctggaaacaaaaataaaaaaaaactggtactagcttttcaaggcacaaataggtatttatggttcattaatttttagcagaaagtttaccttgcagtcttctgcttttaaacaaggttctcgaggcaaataaggaatcttgagaatccgtgggcatgcaatgtaacaagtagtactccagatggcgccaaagaataaataggcaggtctctatgataactataccagagctcagattaaaggaacataatctcatcaaatatgttttacacaccagtttcggaggagaagaaaaaaggacagactgcactcacttaatgaggtacccacagcctcagtctaacagacagggtctcactgaaggctcctcaagaggaagcagcaaggtgtgctgaggaaagaggtggggaccttggggtcctgtgccagcagtctcatgtccctaccttcttccctaacagaaagtgcccatgtattttatcagtattaccagctactctaaaagataagaacaaaaactatgatttggaaatacattaggcatttactgggaaaaaattaagtttatctccttccacctggttttggtgcccaaataatatgagaataagtgaacagttcctatatttcaaggtcatcattcaagtgcatgatttcataaaggatacaagaacaaagggaaagcagtttagctcgattgttgatcaccttcaccaagcgccgtcttgctagaacatatttctgagcagtggagattttatcaacaccagcaggcatcacagactgacacaactagaagaaacaaatgtggtattagaatgacatcaactggaatgaaatttttaatgaaaaactactatcagcaggtcaccatgataaatgctatgaaaaacactcaaatttaaacatccttgcagataagagtttttatctaagaagctagcaatttttaaaaattacagccaaagaagcaaattcacaaatgaacatttatctgctgccttttgaaaaagtctgtccctgaaacacagtcagggttgctgatgaaaccctgaatttcctgtcacattaaaacaaaccaagacaaaatgataggtttttcaaacagtagctataacaatcccatggagaatttctaacagttgtcaggtatcttctgcaaaaaatacaaggtagacacctagagcataactaaaatctgatcatcaaccaaagctcccatgaccacttctcaatgtggcacacacacaagcacagttgttccagctaatgttctgatgctgggttccacagaaggcgtactgaagtgaggctgatggaaggccacgcgcttcatgatgatgatgcaattcctcttacaagtacaaacatcactgattagctacacattagaggaaggactgccaggcatgaacccaaaatttcaggggttacctaaacccagtcattgactcctgcctcaccctgttcctgccagctacatgcctttgggtaagttatgcaagtcttctgtgcctcagtttcctcacatgagaaatgagaatagaaacaatatctgcccgggtgttaggtagaacatgtagttcagggcctggcatgttgtagacactcaataaatgtcccctgagtttaccagaaaagtggcaagagggagtaggcatggactactcataagagtaacatggaagtttttagaaaacttggtgcaaaccaggaatgacaaagtggctcaacattcaggctgcgacaggacaccaggaagcttcagcactgccttaggaactggccaagagatgccttacattcagctgtgccaaatggaaaaggcagcaagctacttagtagcaatcctggtaatgcagcatctttagttattaatactgtaagtagagggaatgcttctgggtcactgagggaaggcagtcaagtctcatatgctatcccatttgtttgaaagatttgctaaacagatattgaagatgctgaaggcacagagacatttacccaagttctattaaaaaaaaaatctgtaacagaagcctttctcagaacagattttagagtataaatgacccaaaactcttcattcaaaggccagctgcctttctattttcttgaacaggtgctacacttcactgtttttcagtcaagagtttctatgcttataaggctggtgctacggcgaaggagtcttcttcaaatcacacagaagaatcattccaattccttcagtcatactgtatacgttgtctttactcagtctgagtaccctggcctagtaacagcaatgatttctcaagtccccccagctcattataagattcgtacctcttttatctcatctgggggaagctgctctacattttgtagcttgctgacactctgtcgatgactgtcataatagctgaagaaatcattagcactctgtttcagcaggtagatgataatgcctaaaccaggcaggcgccagtatggaaccactggagcttgggtatctaatagaggtgatgacataaaacaatgttccacttataagcatttcatatgaatttcaaatgacctgttttaaaacaagggatgccccagaatttaaggacatgtaacctgtcattaaaaccaacccaagattacttttaaatgccatttataatttaaagaacaaatggttaggagccactgtaatcaggtacatacataaggctggaaatcctgcgagaataaagaaannnnnnnnnnnnnnnnnnnnacacacacacacacacacacacacacacacacacccctccacatcaaaaacaatatacacaattgtggggtttcttaacaccaagtgactaattcctgctttgcctgatggctctagttgtatggattcatttctggtctgcatctttctggttactaaattgccagctcaaagtcattctttcaaagagacaagaatagtaactgaaatattcaaaaaatataaatggatttaaactttaaaaaatcttttgccacaacagctacattacggtagtaaaacaaaatgatctgccttttacctggctactggctaatgaagatgcaaaggaacagtgggatgtcataaaagttgtttgcagagggaaaactagaaagcaataacaatattatcctaggacaggcacggtggctcacacctgtcaacaatttggaaggctgaggagagagaatggcttgaggccaggagttcaagaccagcctgggcaacagagaccccgtccctacagaaaagaaaaaaaaaatcatcctagagatagtctgtgtagtgcaattagagcaatctcctctagtgactaagggatttcgtggaaacattgtggcaatttctttttttttttttttgagatggagtcttactctgtcatccagcctggagtacagtggttcgatctcggctcactgcaaccgccacctcctggtttcaagcgattctcctgcctcagcctcccgagtagctgggattacaggcgcatgccaccacacccagttattttttgcatttttagtagagatggggtttcaccatgatggccaggctggtctcaaactccttacctcaggtgatccacccgcctcggcctcccaaagtgctgggattacaggcacgagccaccacacctggcccaacactgtggcaatttcaagttcaatttggagataatctttgtttaatgacccaaactgccatgaatactgaaggagagatctacatttgctttttcttcactatcaactcccttaactttgctctaaagtctgactcatagatctttttctttctttcttgtttttttttgagacaggtttcttactttgtcacccaggctggagtgcagtggcacaaatagggatcactgcaacctcaacctcctgggctcaggtgatccacctcaacctcctgggctcaggtgatccacctcaacctcctgggctcaggtgatcctcccacctcagcctcccaagtagctaggattaaaggtgcacgccaccacacccagctaatttttttgtattttttggtagagatgaggttttgccatattgcccaggctggtctctaccttctgggctcaagcaacgtactgccttagcctcccaaagtgctgggattacaggcgtgagccaccacacctggccaatctcatacatctttatacagaggggaagagacagaagagtcctttgtctgtggatgctgccaccaactaagacatcctagcacaaattcagtttgccaggtatcctcttctagtctacagcaagatgtgacagttttcacaatacattgttatagagagccttctcctactgaaattaggtatcctggtccccagataacatttgtataatctctaccctggtaggaagatacccacaaagaggatgattgaatgcttggaggactccaaagcatttcaggaattcttaccatactaacttgcccaagtctagaaaatatttgcgcattcagaggctatcaggtttgtataaacctttcccctcatgccttggcctgattccaacatgcagatattggaatccccccatggtggcccctttttatcctatcttcctggcagcaaacttttttttttgttagaggcatgatcttggctcactgcagccttgaacttctgggctcatgtgatccccctgccatagtctcctgagtaactgggattacaggctcagccatcatgcccggctccaaatttctgaatacaggagaaaacaagaactatatagaattaacttgtttaagccaaaggaactattttacatgtccagtctaatttaactattttactctataaaatagaactacaaatctttgtagctacttccccagtttctttaagacatcctgtcacctaagactactccctttcaatcactgaaagatacctttaaataaaggttattttattagctattaaggacttagtttgtcttaatatgacaaactaagattctaccagtcagtactcttctcccccatccatggcataaaacgaaaaagcctagacataatacaaacagaagcagacactggtaggagaaggcagagattttgtgacaaaaatcagaatagtagatgcctgggccggagtggaaggaaacaatcaaatgcaatcaaaggcaggaagaaatctttaaggaacagggaattgttctgtattttggctgtggtgatggttacccaactttatataattaccaaaaagcattcaaactgtatacctaaaatgggtgaattttgttgtacataaattacaacaacaacaaatttaatactactagctaggaccttttataatagaatttatctaacaaagttcttagcataatttatataggataaggttgaatgttgctaaactaatatatttttctttttttctttaacttgaagttctgggatacatgtacagaatgtgtacgtttgttacataggtatacatgtgccatggtggtttgctgcacctatcaacctgtcatctaggttttaagccaaacatgcattagatatttgtcctaatgctatccctccccttgccccctatcccctgacaggcactggtgtgtgatgttcccctccctgtgtccatgtgttctcattgttcaacttccacttatgagtgagaacatgtggtgtttggttttctgttcctgtgttagtttgctgagaatgatggcttccagcctcatccatgtacctgcaaaggacatgaactcattcttgtttatggctgcatagtattccatggtgtatatgtgccaccatttatttatccagtctatcattgatggacatttgggttggttccaagtctttgctattgtaaatagtgctgcaataaacatgtgtgcatgtgtttttatagtagaatgatttataatcctttgggttaaactaatttttttttttttttttgagacaaagtctcactctgtagcccaggctgtagtgcagtggtgtgatctcagctcaccgcaacctccgcctcctgggttcaagcaattctcctgcctcagcctccagagtacctgggattacaggcgcgcgccactgcacccggctaacttgttgtatttttagaagagacagggtttcaccatgttggccaggctggtcttgaactcctgccctcagttaatctgcctgcctcggcctctcaaagtgctaggattacaggcgtaagcaaccacacacccggccactaatatacttttcataatgtcattttatactattattatactaaacacatattttttgtgattaagtaattttcagggatagtaagatcttgaagaagatgaaaatgtgacaaaatttttctcacagatctcaaacaaagacttcctgaaatcaccaacagtcaattccattatccccaccaagatactaatgggctttttcttctgagtgttccataggataacagctttacccattatcctgccccatattcaaacattccctactgaatcattaaagaattatagggtaagttggcctaattagtatctaaattgtatttcgttatgttatagaaatttggagctataataaaaaacccagtttagacactgaattcagcttaacatgatttaacatataaaactgtttgttgtattttcatcttttccacccagccacctgactccccaatttagatcctttgagccctcaagtgctattcaaaacatggttcctctagatttactctcagtaaatcctgaatttctctattctctccagtcttgtacataggtctaataataatacctcccgctcaactttaaaacttatttaaaatgtttcccattaatgacacttaaaagaaaatactgcatcttactggagccaagctggagagctatgtcataaccatagcaacttagttccttcaatacagaatgaaaaactaagctcaccttgccgcggtccatctctattaactgtttctgaaaggctaggagtgaagagacacacagcatgctggaaggtaggggaactctgtaacatgagtgactggcaatattccattacattggcacaaatctataatcaaaaaacagtaacaaaaatgttaagaccctgaaatgtctcaattagcatgaaaatcgagatttgaagaagaaaaggttatcaatcaatttgtaaaatgactcacatctgtgtattcttttttttttttttttttcagatggagtctccctctgttgcccaggctggaatgcagtggcgtgatcttggctcactacaacctctgcctcttgggttcaagcaattctcctgcctcagccaccccaagtagctgggcacacaggcacgtgccaccatgcccagctaaattttttttgtatttttagtacacacaaggtttcaccatgttggctaggatggtcttcaactcttgacctcaggtgatccatccgccttggcctcccaaagtgctgggattataggcgtgagccaccgcaccaggtccacatctgttatttttatcaacattttccaaaaacataaaaaccttagagaagtcacatggttcttacctgctgcatagccagttcaatctcatctttcttgcttactttatctccctccacattatcgtcttgaaatttaaactgacgcagtctgtcagagccaccaaagcgacttagtagtcctaagcactggcgctaacaagaaaaagatatcttgttaaatgtatttaaaattagtaacctctctttcttgagggatagaaacaagaaaaactcagtggagaatggaatcagtccttaaggcatctaatatcttacttaaaactgagccaactaaaagtagcattattaaaattcaactttttgcaaaggtatttgattggtagctaacagatgaaaagagtaccctttttttttaaagcaataaatcccagtatcatctaaatgtttgccaaataactttctgcattatatcaaagtaggtattaattctttggaagatactcattaaatgaaaaacaagtttataaacaaaagagaagcaaaatgagagggcagtcacaagatggacacgtttgtgataattttgtctaccaaggcacaaatctaaaagctgttactcctgtggttgctcccagggacttcataaaggggttacaaacacacagatcaccttggaagataaatgcaaatgtccccagtttcaaatgttaatacttctcacctgagaatacagtatttcccatggttctcaaagagaaaggacaagcttttcaatattggcagtatatccagaggttagccgatggctttcaaattagagacatgggttccaataacaggtacaactttttgctctgtgacctggaatttctcacgcctgcatgttcacatttctaaagtggtaataacaattcctatcttataagatggctgtcaggattccctgagacatggtattatatttaaagtgcttagcacaatgttctgcacatagtaagtgtattttaaatgaaacatatattttaaaaattggtaatacaatatacagatttagatacatagagaggtatacacgtacataatacacactgtcttattattttatttatttattttggagacagtctctcactctgttgcccaggctaaagtgcaatggtctgatctcagctcactgcaacctctgcctcctaggttcaagtaattcttgtgcctcagccccccaggtagctgggactacaggcgtgcaccaccacacatggctaatttttgtatttttaatagagatggagtttagccatgttccccaggctggtctcaaactcctggcctcaagcgatccacccacctcagcctcccaaaatgctaggattacaagagcgagccatcccacccggccactgtaagtttcgataaggcaaaacatattaatgagactataatataaacttattttgccaaaatagttctatctatgtttaacatttataaatgtgtgtttgccgcttcttacagataaaatagatgcattcaaacatttccgaagctcaccttatgaaagatccatcaaaaaggtgtcttcctccataccaataaaagatgacttaaaaaacccaaagtatttgggttttgtgggtgagagtacaatcttttctggaatgctgtttgacaattatgatttcaaaatgatgtactatgtgtataccctcggtcccagtgataccatgtgttatttaatccagagtaaaatatgtacacaaaaatgctaatagtagcatttttcttatgaaatcttgaaaaacagcgcatgaaaaaaggactagttaagaaaattgttgtatcaaaaacaatgggatataaacactagtacataaatacaattactctgcagtcaatacaaagtaaagatgctcagaccaaaccaggccaagaggctcccagaaagactgataaaatatctaattgacaaactaatatgttagaacatattgagaggagattacagagcttgtaaagaatctggggataaattagtaataagtacataaaaaccaagcaaataaaaaagaaaactctagggcaaacagtctgctcgtggcttattcacaaatgacatttacacagtcataataatgtaacactaaatattaatgtaaccaaaactatgatgtaattatattgagtttcagggggtgttatgggaaatgtatacattgtatgatggaagaaaaggagtaaaaacatctaaattctcatctcctccccatcccccaacaatggaaagtcaacagatgattactaaaattagaaaatcaagaagcagcaatataagcatattatttagaaaaactaaagaaccaaaacagttgaaaggggtttcccaaatactagggggcacaatggggaggatggtatattttgtaacatgtcttataactgctatttaaagaaataagaatcagttacctggaatcttccaatatgtccctgtagctccattagagacccttcatttacatcaacgtcaagttcacttaatattcctataaaatgtagaatgctttaaaacatattattataataaacaaaaacattaaaaactaggaagagaggttctaatattttatattgtttatgtgcatgaacagatattcttgccataaaaaagttttgagaactatgattttacaaagactgtaagtacctgttatatattaataaca

SEQ ID NO: 12712 - DNA, 28843 bp, Human; identical to SEQ ID NO: 11812

SEQ ID NO: 12713 - DNA, 94133 bp, Human; identical to SEQ ID NO: 11901

SEQ ID NO: 12714 - DNA, 24276 bp, Human
tggagagagcccacacggagactggagatgtagactattaagagcactcagccacagagtcactttggttgtgtcacttaacctctgtgctcttctaagctccattcctggcttgtgttgcagggatgttttgaggatatgttgatgtgtgtgactccttctctgtgtgttgctattaaagacattaagaactgagctgagtaacaaactttctagaaatgaatgaagaaaacatagcaaaattatacctatttttttaaattgaagtacaaagaaactgtagctataattatctttcttgacactaacagtacatgattcctaaatgctattgctcacctcaagtcaatgtcactttgtattaatggatttagtgtcatgtatggtcttgttttttgaggtcgtctgatgaaatcagaatgatttcacttaaggcaaggcatattaaaatacaaattcgtaaagataataccttgatgtttatgtctatgccaaacttgctctgctgagttcctggtggaatgaaaagactgtctttttttaattgtgatttgtttatgactaacagcatggatttgagacagttatgaaaatgccatggtatcattctgtaaataactttgtctatgtaattgtagtgtatacttattattgacaacttgaagaaagtacataaagtacaaaataaaagttacccatattcttatcagccagatctaactaattttaccattttcatatctctgtgcatactcttaataaaaaatggtataatacatttaagcagatttgcatcctacttgagcaatttatttttataaaatatgcttttgaaacataatattttatcttattaatgtaacaacatttatttaattgggggtccaatgaagggtattagatgtcttttttcagtatcatatataaggcaatatgtacattgctttgcttgtgcatttcaattaggtggaaaaattgagcaaaggaatttgtaagcttttattttacactgtcatattctttcagtgaaatttgtactactaacttacagatttacctgcagtgtatggaaaccccaattttactgtatcctcaacatagcaatgttaatttaacaaggtaggagatgttgctgatgtcttcttggtaaaatcattaaacagacttcaaccagatgttgaaataacacctggctattaacaaccgttaaacaaattgaagaagcatctttaaactcaatcctgaaagctcttcctcaagatttgaaaagctgtaggcaagagaaaaagaaagaacgcattaattttggaacctaggggtccatatgctgtctacaaatcaaacccattagctttgcttaccttatggtttggctatcacgtggaaataatcttgactgtcaagaaaagataaaagtgtacattaaaaatacattgcaccttatctcacggaagcaggtgaagaggctttcattccttaagcagattgactctaccttttgttgctcgtgtttaatggggactcaacacaaatgctagcaacatgcgatctgagcatgctgttctaggagcagtgtctgccatctgtttgggctaaatggaactggcccagcccttgcttccctgcccctgaaacttgactattggaatttaattacatggttatatgattaaatccagtagatggaaaggttagagctaatgtccccagaggtgaagcaggccccaggcctctgaaacagctggcatcggggaagcaagctccttcctagcacacaaaggaaggagaaataataaactcttctgaaggtgatgctggttttattttattacctgtagtgttattgagaaagaatttcaagctcacaagtccagaaagtgatttgaaagcctttatagttttaaagtcaaaatacccaaacaacattgtttctcctgatttcgctctccgatcctttttgctctatttgaataattttgagagcctggaaaatctggacatattttctgaaggttaaggaattaggaaagcaaaagagaatctgggattcatttccagtagatgagttgtctctttctaatgtccaacaacttaatgtagtggtggtgtcagcatcaagatagatatttcctgatggattttgacctggatagtgaaattcagcatacttttaagaagccccatcagaagtcagcaaatgaagagataccagttttgcaaacaatctcctggattttagaaggcagtgttgtcctggattttacaatactgtgctacacagagcatagcaagaggtaatacagtccagactcagaaggctaggatttgcattagagagcaaagcctagctctaccacttcctggtgttagcaaattacttgacctctcctcaactcaattttcttatctgtaaaatggactaataataatatctgcctcacagaattgttaatcaggattaaactagatagttacagccagatgtgtataatagagcatttttaagtctaagttcttactgctgttaaatcagatgatgggctgggcgtggtggcttacgcctgtaatcccagcaccttgggaggccgaggctggcggatcacctgaggttgggagttagagaccagcttgaccaacatggagaaaccctatctctactaaaaatacaaaattagccaggcgtgggtggcgcatgcctgtaatcccagctacttgggaggctgaggcgggagaatcgcttgaactcgggaggcatgaggttgcggtgagctgagatcatgccattgtactccagcctgggcaataagagcaaaactctgtctcaaaaaaaaaaaaaaaaattcggatgatgggaactttgatttttttctcctgattcttcatatagttgcaaaatattcctttcttagaggtctatgaagtacttctatggctctttgacaaattctcctctacatgaacagagtatgttgtgagaattcaaattatcacgtggatttatggcagtgtcatatgaacttctagccacaactgtggaatttgcagcatcattttggtgataaaaaaaatattttggccaggagagattaatagagaaggaggctgtgttactcagaatccttccaaatcctcatttctctttatatcttcgttggtttggctttctttctttctttctttctttctttttttttttttttttttttttttgatggagtttcgctcttgttacccaggctggagtgcagtggcacgatctcggctcacctcaacctccgcctcccgggttcaagtgattctcctgcctcagcctcctgagtagctaggattacaggcatatgccaccatgcccagctaatttttgtatttttagtagagacgaggtttcaccatgttggccaggctggtctcaaactcctgacctcgtgatccatctgcctcggcctcccaaagtgttgggattaaagtcttgagccaccgcgcctggccagtttggctttcttgaattccaaggcattggacacttgttacttttgtttacaaaaagcttattcacaaaggatggggcaatttactgcttgcacctgggaagctgtgtctttgccaaagcaacagtaacttgctgagatttaggccaagggggaggtgtgacatgcatattaactccttctgtgactactgagataaaagggaaaataacctttaaatgcagaatgacacagtcatggccaggcaccctggctcacgcctgtaatcccagcgctttgggatgcctaggccggcggatcacctgaggtcagaagttcgagacaaggctggccaacatggtgaaaccctgtctctactgaaaatacaaaattagccgggcctggtggtgcatgcctgtaatcccatctacttgggaggctgaggtgggagaatcgcttgaaccggggaggtggaggtttcagtgagccgagatagtgccactgcactccagcctgggcaatgcagtgagattctgtctcaaaaaaaaaaaaaaaagaatgacacagtcattgcaggcatggatgaatattttctaagagtgagcatggtgaatcacaaatatcaattcatttactcatctgttctatgggtcttgttcctgcaatgataataaaatttgcctgcatttccacagctaggaaagagtgatgcctgacttgaactcagccctttgcaatctcaaagccttcattttttaccatgatgttatattgtaccgtgcaaagcaatacaagtatcataatcataattacaccagtatttatggacctctttttgtgggctgtgctcttccaaagcactgtaaaatgctttctatgcatcctcatatcaaaagcacagtgaggtgaatgtgatattagctctactttacagaggaagaaactgggttgaacttaggtcctgtgagtcaaagcccaaatgcttgttagccacatcatgttagaggatataagatcatgcttctgacttgctaagtgcatacgtaaagcattaagaagtgatataaaatggtggcaaggatttgggtgaaaggatctggaaacccatattgtaggctgatctacgacaactcagtgtgtcaacttagataaacccattaagacattctagaaaataaaggaaatcaattgatgatcattacacatcctggcagatgagcgttctgaatgttactaacgaattattgccacatatctgattaaggcgatcacaaaaagagagatctccctctgaaaattattgactacatctggtgttgccacttcatcagttttcttttaccttttaatgcctttttacagtacattgtttttatctgaagcacttcacggagctaccttaataatggtctccaatgactttctattttatttatttatttttgctattgtgtcagttaaaggatttatttcttgtgccatgaaatgtgatgaagattctgatgaaatctatgggatctttccttagaacattacactaatgcataaaaacacatctctatatatgtcttgggtggcatccagtgccaaatacctcgtggggctcaagaagaatgggcctgagtaaagtcttttgaatttgagaatttgaaagatttcataaatttcaactgctaaaagtttgagaaaagtcagttaaaaagtgattatagaaggaggaatatgaaacaatgtcttagatatttgtgggattcaaaaatagaattatataaacaacattaatcctggggaatgttagagacaatcttattcaaagtccttattttataaattagacacattatctacaaaaatagaaaattgactttgatattgtgaaattacttaatggatttctctctacttttcacttggccctccaactcccaacataaaatcatgagtagaggcaattataacagcatatgaaccccatatatgttataaatttctttttaaaaaaatatgtagagagagttttcattcccttcaaatttcagttggggcacagcaccattatggcccaaagaagagagtcttgcaacctgttttggcttgaatttctctctataagtttgtagggataatagaagaacagagggctaagtgaaatcttgctctgtaagtaggagaaagatgaggagatgaacagagtgataactatagcttgggtgacaaatacaagcttactactgctcatttcttcccaatggaatcaaatacttcctgttactatttttcctgatacttcctgttactatttttctacccatagcaggggttggcggtatcaagtagacccatgtgtttgttgttctaaccactgaatgactgactacgggcacgttgtttaatgactctgaatgccatttcctcatcatttgcaactttattggtaggttaaaaaaaatctgcagagatctcagtatacctagcacatagcaggtatttcacaatgataatttttactataattatgtagccaaacattcaaattagaaaaatctctgctagtcatatagtacttgttcaaagcacacacatgcaaggttactatgtaagttcataataagcatcgcattttcaaacttgaaaaactaatgaaacacattttcattagtttttctaggtgtcttctgctaatgccatcagaagctcaagataatggttggccccatcagagccaaagtgaacatactctagtatttaagttccaactattatttaaaaatcacatgtgtatgtatagtattggtgctgtttctgtggagaatctgtttctgttttcatatgtgtattatataatactatttagatatctatttatcatatattattaatataggatctgttatatattattaatatagaatctgtttctgttattcatatatattatatagtataatacataacatataatatattattttatatattatatagtataatacataacatataatgtattattttacatattatatagtataacacataacatataatgtattatcttatatattatatagtataaatacataacatataatgtattattttatatattatatagtctaatacataacatataatgtattattttatatattatatagtataacaatatataatgtattatttcatatataatatattattatatgtattttatactatttgtttcaatattatatatttatattatgacatatttgtatttataatatctatttatattacatgggctaaataatattatagagatttattataagggatttgctcatatgattatggaggctgagatgccccaagacgttcagtcagcaagctggagacccagatgaaccaatggtctgcttctagtctgagctggatgcctgagaaccaggatagctgatggtgtaagtcctcatctgaaagccagcagtcttgagactcaaaaagaactgacgttttagtttgaccctgaaggtcagtaaagaccaatggctcagctcaagcagtcaggcaggaacaattttctcttactcagctttttttgttctatgtaggcattcaactgattggatgactcccactgacattaggggggcaatttgctttactcagtttaccagttcaaatgttattcttttatccagaaacacctcacagacacatccaagacaatatgagtaatatttagctaaatgtcctggcatctggtagcccagtaaagttgacatgtaaaccatcataccatgaaattgtagctgctcaggatttgagaaagacagaatttgcctgactgtgcatgaattaagcattctgtgtgacttatttttcacgataagaaaccttctccgaggagagacagagcaaagtggcagaggctatttatacaattcagagccaaccaaacagggaagaaagactcacttgtgactgtgaatttagatatagcctactgagctttgcttgtgtcgtaaacctgatgactgcagtcaaaaaggtcaaattcccttgtccaactcatcagagttatgacagtaaacattcatcttaaaattttgctttgcctttcttgaataaggatatgggatcaagtctcatagacatagagtagaacttgggcatgggggatgtgaaaccctatcgacttcaggctggaagttgatctgattcttccaggattcccatatgtcattccccacctgtgccttcaactgaccttaaaagggctgtgtcagtcattttgaaactggactattctcatgaagaagtacacagtactgttgtttccgtgatccagccaattcttagcatgttttctgagcatgacagggaacagatgtcaacacctaacagagatgtttctctttgtttaatctgaaaaactgactactggatcagtcccaccaaatctactttaaatggttaccaaatcataataaatttaatttagaaagagcttggaatgcaatttaatgagcacccttgatgtaagggtttgtagcttatatcctgtcacaattaatatgcaataaacctgctttcctccgttatttccttatagaacctttacttaaacaactagagattttttgttttctttttattttcttggtagtgtgaagagttatatatccaagataccaagactgcagctctggtttgtcatctggtgatggtatcatgtctcatttttaaaagacaaaattgtaccagagcccataggccatagaaatgtaaaaactaccaaaaagtaagacccttctgatagtttggaaaagctctctgaaaatcccgtggacgtaacaaaagagcgggagagggagaagagagagagaaagagaaaaagtaattgcagtattcatttcccctaaaccgatgtagcaatcaactttgcaattaccaagatccatttcactggactttataactggaaatgaaatgagtgagaaatgaggatctctaatgaaggctcagatcctcacccattgcattattatcacattccaccagtttcaacattcactcgccagctttgtaatttgtagcttattttctcacacctcgccaagcgattcacattcatttacattactgccatttaacttgcagacaagaagaaatacggtttcagatctgatgggctcggcattttttgtgtgtgtgtgtctagttgagtttgttttcctgcctaaaacaaatgtctctggagcttcgtttaatttagcatgtcaaactgcttccttcaaaggcgatttggaaatgctttgtatatacaatagacgcaaaaagcccgaacaaacagagtagaaaacaatgcttagaggaggaacaatgaaaacacaagcagggctgcctatctatcagctccaatgagatttcccctgttgttaaatgaactactgtattcctgaattaaaataaactgaagagagggcacaaggtatttcagaataatgagctataaaagacatttctcatttagcatttcttgttcttttatattgtttttaaccataacttcatagtggcaactatttgtctggaagctgaaagatacatattttccagaagtctctggctatagaacctctcattgtttataaattcttgatactacacccttatcagatatattatgatttctcccattctgcaggttgccttttcactcccttgataatgccctttgatgcacaaatatttttaaaattttgatgctgtcctgtcttttttttctttccttcttcttcttctttttttttttttgttgttgttgttgctcttccaatgtttatacaacatgatgagcaggtctcccatagacaccaagatatttaataaatattctctaaaaatggagtctgcatggacttcccaaaaaggaatggcatttaatattgaagtcctgtgaatacagattgactatttctcatatccaattgaaacatttgaaaagctattaaaatgaaacacttttgtaattgatttgaaaggaaatcctgtcttaaatgttcgtgaagctacacattgtctttatttatcacacttagtagaaatatttgtctattttactccagaaatattaatgtgtttcattatgagttgctatcccatacccaactgaatctaataattgccatatgtactaaatcactttctgaaatccaaacattctgaattttgaagacagggactctgaaaatactgtgaaactgcaatgacaatagcagctaacgatgatgtaatgccattttcgtttccaaaaggctttcctgtacatgatctcacttgagcctcaccaaaaattctgtagtgggtattatccttatttcaccagtaagaacactgagttttaaagaggttaagtgacttttccaaaaggaatgaagtgttagaactgagaggttagatctcatgtcttctagctccaaatcctagtggatagcacagtgtttatttgctaaacacacataacaaattttatgaaataacacccatgcaaagtttaaccaaaacagtatctctgtgataccagaaaaattaggcaattcattgagagagagaaagagaaagagagagaaatagatttagtcagctgttcccacagctacagaaccaatctttcatataaatccactttctctggcatttgaggaggatccaggatccagggagttcctgtgcataaggaatgtactatgcataagagtatcaattaccagctaaaatttttttttttcaggaaataattctgtaaagccagactgctgaaactaatcttgtcatattaaggtaggtaggcaaagcaatgtttaaaaaatttcccaacttatattagttatagggtgtcaagatagtaattcttacaaagaaaaccaagcttttttccttctgtgggtcttataattttattatttgtagaggccctaccaccccgacataggctcatttcttctctccctttgggctgttatgccaggacaggaagcattttgtgacgcgcaggatagatttccagaactccccgatgcttctaaatctcctattttggttggggtaaattacccagcacaatttgtaatatcagacagcagtgtgaggagaggctaaatgtcggggccggggaagcagaatgatgagggacaaatgtgattgccgaaagcagggctgaagatgatctcattaatctttcattattcgggcactggtttccaagacagacaacagggacacaaatagaagaggtatgctctggacgacttatgggaccaaacattcccacactgacctaactggagtgccacatggctctgctaatactagtatttaaaggattctgatgtgcttgatgttgcctcaaagatctcattatgtgagtaaaggtgagcatttcttaaatctccatggaaaatactcttagttcatgggtcatcagtgagtttggggatttttatttttaaaacaaatcaacactgtttcagatcatgacaaataagagtaacttgtgggagcatggtatttcctattatttttttctgccggttactaaatctataccccaagggttcaatgccagaattccttttcacagcccatctgcatcggaataaacaatttcccatgaaatcagcttaggtcacaatcgaatttttatcgttttacttatcttttgtgactgtttctgaaaataatccattctaatcctggatttacagaagaaattatttatttacatatttattaagatggtgcaatggaataggcattgaggtagagtagttaacgtctagcgggaaaatataatcaatagaaaagtacagtacaatgtgattatgcctatggttgacaaatgaagacagatgaaactatggcgtcataggagaatgcatgctaggggagtgatggaaggcttcttggaggaggtgttgctgagattgattcctgacagagtaggagttttccatatgcataattcagggaaagctttttctaggagaagaaatatcatacaaatggcacatatacacggagtattctcatagatagaatatttcatcctgaatccactaaaacatgtatggtagttttcatgttctgtcatagttaaaggtatataaagtagattcccatattaaacttatttgagtgcataaatgacacaagaatcagattttctgttgtgagaattgtgtgattattcatttagaatatcatatgataatatctcatattacattctaatatgtatatatttattttaattggctcctctgcatgctacaatacactgaaaacatctattcataacaatgtcaataaattaaattatagaattctgaagtgccttctgatgtacagggaataatttaaattacgccattgtggctttactgttgtaaattttccaatacttttccatcgttttttctttaaaaagattctaggttttgacagaatttatgtgtttcaaaaagacaaagaccatgtcttctcaaacttgactctgtatttatgcattatgttgagtaatttctccaagtatgcttgttgaattgtatttagtgctgtaatcttctgtttatccagattaaaccacaaaaattattttccaactctgctggggaatctagttttatataatcagttgtggccattaacttcattaaacttaacacaaatttaaactcccattttgaaataatttttgtttgcaaaaacagtacaaagaattcccatataccttctccacagctttccaaaatggtgaaatctttacataactacagttatgatgatccaaactgggaaattaacaatgattcaatactattaagtaatcaacagagctgtgaaaatttcaccaattgtccacaaatgttgtttgtttctggtccagaattcaatccataatccattgcatttagtcatcatccttagtctcctctaagatgggatggtcctttgtctttcatgaccttatccttttgaagaggctagacagttactttgtagaatgaccttattgtatgtttgtctgatgcttcctcgtaaataaattcaggtttgcatttttggcaagaggaccacagaggtgttatttccttctcaatgcatcgtatctggaagcacgtggtgttgctatgtctcattactggccttgttaaccttgatcaccttgaagtctggctgcaagagaccaagcttgagattagtctgctttattgcaactagactgagttcatgtactaatctcacattcaaattttaatttgggtaacagttgttgttgagctcacagtgtttgaattcctattgaaagagacaggattgttattaatgtttgcatttcatgaaaaccaaatcagaagtctgaagtttttgtataagttcaaggattcagcacatacaagttctatctctctctttagtttccttccctctcttgccgcccttgggcaaaaccgaaaaagcaaacaggactctgctaccctagtctatcctgtactatgaatgaagcagcattgatcatattttcccaagaaaacttcaatgtataattgcagttctcccattttcagtctcctagcaaaatagccaaacaaatccctttctttctctaagggagtgacttattggctctagctttcctattattgttaaggaatattataaggttgatttatgtagaaaggaaagaccaacagcctagttcttaataataggaaagcaggagagattaaaaacaaaaagagtttaagaaaaaatttccaagaatgtttaattgcgtatgtccatgtgtggggaagatcagtgaaacaaaactcacccctatcaaaatcaggaattcagttggaaatagaaggaagccccaacttcatgcaattaggaaagagattgatgtggaagcacatggagacattaaactgcccaggtccgtcatcacatgatactagggaaccggcaagttgatattctacttgggtgatcctaagttgagttgacgagattattttagtaagacggaatgaccactctatccattttttgtcattaaaagtagagaatgctattgtgatgctgcaatccaagtactgtgtatcattaagtcagaatgtattttaaaaaaatgtggttcagtgtgttaacagattcaatcaagatttacccctgaggataagtggtaagcatgtatttggatcatgaatgtatgatatctatagtttctctattttggaggagctgcctgggaaatcagaggggagaaacccctttttcagttactctaggattcagatgatttagctgagaattttcatcccagcatcaccatatggaaaagaactggtcactcattcccgaggtctgggccagggtggaggaacagtggaagtccttggatccctcaacattcagatatctgggtgacaaaaagagagaagttgagtccaaaatggactatctatgaatctcagctgttttcagtgttctcttttaatctgccagtctcagcattttatctcaatatcaacagagaatgttcatttgacaaagtacattcataacttctctagattccatctttctggacaatgccattcaattattaacctgtctttttaaaaatgatgccatagcattaaattcatgagctgctttccaagctttgtttcctaagatgttcttaaataacaaaacatcctctgtagttatttaatacttccaaaaaggcgtacattttaaagctacttcatgattaaccattgaaatgtttaagcctaggaatttagcaggtctgcaaaaacctaacaccttctaaatctgacttccatttgaaaaactagaggggcatttaactcctattataactgcctttggcttaaaggatcatattgaataccaaagagaagtaaatagattggataaaaggaatttctgtggctggctgctttggtttgttctgtgtaaaacacaccttttaatttaaattagacaaatggcagaatttcctgcctaataagactgccctgactaggggtttggatgtgtcacctccactcttaatcaggtaatcataattaaggtgaatgaaccagccagggaagtggaaagcaagtcaaaaagtgtattgaacaaaaaagacctccaacaagcagaccaccagggcacaatcaggaggaaacatctacagctccaacacatgacttgggaaaagccactagacaccaacaatgtgactgttgaattatagttcacagcaagtttgaatccagactgtctagattgcctaactggttctacattaattgtgtccactgtcttgctacagcccccaaaccctaatatgtgtctttttctctctctctttctgtccattaaaataatccatgatcaatttgaattccatttggccttatatttgcttgttgcctctttctgttctgactctagaattctttcaacggtattgggatttacttgctttagggcaaaaagaatcttttgaatccctaactataccactttagatgcattgtagactccatatcagctagaaataattgctaaagggccctttaaagttttgtttttacaaagtgttaatattgttaaatgtctttttctttaaggaagatttctgaggaaaatttctagaccaagccacagtaagatctgaactctgattgaatgtaaaaagtacggcagttactataggtattaatattaggaaggccaaagtcaagtttatttcttgttattgttttaatggtggaaagaccaaagcaagagaatcatgaaattaattcaaatgaggcatggaagtaaaatttggggtcctagtggttcaagaaaatgaagagcagcaaacagattccagatcagtgactattagacatttgaatgataactcacaactattcccagtcctcattttcccaaaattctgattcagtaagacaagggtggccacaaagatgtgcaagttttaaagagcccaaaatgttgggattacgggcatgagccactgcgtccagtctagatttaatttcaatatagtattcagggaaagttagcaaaggatatgtcaatgaggtagggatgaatacaaattatcatcataagctgtggttaaaagcagttatacattgctgttgaagataatggacacattgtttatttattagctgtcagttaaaggtcattgacattcaacacattagcatgttattaagtgatatgtattatatatatttaattttattttttattgtagtaagtatatacaacataaaatttaccattttagccatttttaatgtatagttcagtggcattaaatattttaactttgttttacaacatttaccatatatgaacattttcattaacccatactgaaactgtgtaactattaaacaataacttctcattgcccccctgttatattttctgtctctgtgaatctgactgttctaggtacctctataaattgaatcaaataatatatgtccttttgtgtggcttatttcacttagtgtaatgtcactaagattcatccatgttgtagcatgtatcagaatttcatttctttttaaggcagaataatattccattgtttgtagacactatattttgtttattcatcattcattgatggaaatttgggtttttcccctcttttggctattatgaataattctgctatgaacacccatgttcaaagtctgcaaatgtaaggttttcacttggtaaatatccaactttgtatttcagaaagatcttaagtgtcattggcataaaaaaatcttataactttgtaaaataattttacctcaaaaaaagtaaaatcaatgtagatagaagttttaaagaagcaaattttgaaagcttatagactctaaaacacatgagtagccttttaaatgtctgatgtgtaaatggcaccgtgttatgtgttatatatcagtgttcccagtgtgtgataccacctatggtattcaaaagaagtgcaggtggtatctgaaccaacatattttacttccatggttatagatgcatttttttatgcattgagaaaacatggtaaccagcatatcaaatatgagagaatcttaatgcagtgttaaatgaaaaataaaaacaaaaaacagagaatttaaaacatagatttagtaaaaaaaaaataagtagtaagtgaatatggcagaaactgtaaaggcaattcataaatgactgaatttggggaatgtatcatgtattcaggaataaagaagcaaaaaaataaacccattcctaggaagaaaggtataagttagtcatttaagtttccatttatacagagagaaatgacagaataacgggccataacacagtggtaagagagagctaatgtagtacttatatatgcttgtgcataaaagagaggtataaaaaaaattggactggggtttgagccaagaaatgagaggtgatagaaatttttacctcattgttttcagtgctgatgtcagattccctttctgccagaatagcttaaagggaatgatacgattttcacattgattcttttcagcagctccacctggttttcttgccgattgtcaggctcaaaccccaaacgtcacactcaaccacctgttaaactgcatttgtcaaacctgtaggaaaggtatgctagcagagcattatcacagcagaatattttcatttttttctatttcaaaactgtttttatgtgacactcaaagtctggaggagaagcgtaaaacccagttcaaaatatttgatttctttttttcctccatagaaggcaaaagagataggttctagttaggtactcacctatatctccaaagaaactaatgaatcgaatagcttatttttgcatatgctgatgtttggccagatcttgtggcttatccatgatagactgtctttattatttaatataattttctctgtaacatagcaagaatcaacatggtgaatgataagaaataagacattttaatgggaaataaaatcagaagaactggatctaataatgttcctgttattaattagccaaggcattttgaatagctcatttgtctcttaacttaatttttttagttctaaagtgactgtagtaattttttttttcaagttgcatgagtcaggagaggctaggctatgccacagtaacaagcaatacccacagttccatgacctctcataggaaaagtttatttcttacttacgtaaggtgttcagagatgactgttcatttaaattgacttctgaatgtttctgtggcattccaaatggcttgactctgatagcgcctctgtggccacatgtgctgccataatccccaaagtgatggaaaagcatcaagtcacataccagctataaaatttctactgatagttacatatgtcactcttttctgctcacatctaattgggcaaaaaatgtcacacagctattcctaaatttaaagggtcaccttactatgttcctggatgggaagagaactggaaataatatgaattctggtaaggcctacaaaaccagttatttttaggaaaaaaaaatttaagggtcagtttcttatatcatgacgccatatgctgaccatgttatacttgtgaatatttgagctgagagcatcacataagcatgtttgaatgaatttcaagtcagcatttcttaattatctgcccctaaaaatttaggaattagccaaatggacaactccgtggataagcatttcaaggcaatagggtcattttcacttggcattaatttgaattcacatttcatggattagtgcattcttgtacagctatgaagaaatacccgagactgggtaatttataaagaaaagaggtttaattgactcacagttctccattgctagagaggtctcaggaaacgtacaatcatggtggaaggcaaaggagagacaggcaccttcttcacagggtggcaggatggagtgagtgcaagcaggggaaatgccagacatttataaatccatcagattctgtgagactcactcattatcactagaacagcataagggaaaccaccccccataatccaattacttcccaccaggtccctcccatgacatgtgggaattgtgggaactacaattcaagatgatatttgggtggggacacagccacagccaaaccgtatcaagctcttactgtagaactaatgtttgatagaatactagaaggaagccatagtggagtcaaaatgcttagattaaaatcttgccactaaagtcttcatctcgagagttcccctagctgtaaaatggaaatgttgttataatagtatctgtctcataaagttattgtattatattaattaatacatgtaaataattagaatggtgcatagcacatggggcacctagtaagtgccagctatgaatttggtaaactccgtttgggcttttgaagttacccacaattgacttacttgttttcattctgtctctcttattacatatctgtgtgtgtgtgtgtgtgtgtatatatatagttatatttatgtaaagagatagtgagcatatgtagttatacatatgtatgcatgtatatttatctatctagccagctatctatctactctatcttaataagccttaattcccaacatataacaaaatatttccaaagcaaaactctaacccagaatcagtcctattctttggggctgaaagtatagtttgttacagagttgttccttatattttcctgaataaaattatgtccttctgccaaggaacactgtgtctacataggccatataaattagagatagcattttataggacgaacctaactttatctcagcactcctatttggcatactacaaaaaactccttaaatattttgctgaaacatggaaaaagaatttctgttgagactcatattttttttgtaaccagaatgcaagtttctgactgtatttgcctaatacatagtcagattgcttgatacacatggttgattcagattttgcttctaagatagatgctatataacagtcttattaaaatccatacattttgtagtgaaattgaaagaaatattccacattactcatgcatagttgctattgtttgtatgttttcttagaataataatggtgggaaatggcacagaaggaaaaatgcaaacttattttgctttattttaataaaaatgatctttattgttaaaaaatacatcatcactctaatgcatattgtcaaaaaaaaaaaaccaaaaaagaaatttattggcttacataattataccattcaagctgtgaaatttgctttaggtacctctatatgcagagccttaaattgctggctatcagcaagggagatgccaccctccagtgtgcattttgaatatttatggggtttatttttagttatcacaacattgggggggtggccactactaagttttgtgagtagggccacaaagtttagacatcctgcaatgattgggattgttctgcaaaaacgtattatctatatcctgagagctcttaaatgcccttagtgcaacccaaatgcattgtttatacctaaatttagaaattaaaactccatttttacatgcatattcaaagagaacgggtttttgcatattattacagcaaactgagtaagcaaaaaatgcaaatattgtataaatcaagagagggttgttgtgtttgacactttaccaagaattatatactactttgaatcttccattgtatgaggccacacctttcataaaatttgagtctggatcattctcaagttgtagattttgcattcacatttgtaacagtgtatctgatactccttttcacagccagagatgaaaatgttatcagaattagtggagacatgtgaaatgtagacatcgcattaaattgtattagtaagaattctctaaaaataattcatgttcttaactttctatttctgagtttctctgtagcacaatgaaaaacctatatgctgagaaaacatattgaggttaatttctatttttgtgtttcctgtatttaaaacctgttttcgtgatgttccagaaattggaatcaccatttctcaatagtcttttatttctggttttttttttccctgatatgtcctatttctcctgtcttgtattgatcagtatagtctccaaggtctttttacgtaacaggagtactttatatccctcaacatatggtgaggttttaaaacaggagatatattttgttattctttgatgcaatctgaccccaggtcattatattatagaatggaaatcaagtctatagacactagaatcagaatgccagggttcaaattttggcttttctgtttgctaactgtatatttttgggtaagtaacttaacccctttttgtctcagtttcctctgtaaaataacgtttccagacccatggggtaattcataagataagtgactgaattaataacattgaaaaagcatagaactgtgccagacacacagacagcactatataaatgtttgacaaataaaatagagaaaattttaaactatacttataaataaggtatcgctcatatgtaagtatttcaactcctcattttctctactttggctgtctgtaatggttcgtggtgttttatacctatattgactaataccattttcctctttctcttatcactcacagataaagttgttctgttatttatttatcttcataatgggtttaattccaatattttcctatatctctgctttcattttcctgtaaaacttgtgcagaattgcttctgatgatcttccttcttttattcttgacttaactctttaaaattagtaaaaataatctgatgactttattatgtctcctagtacagtcagcttgcacagttacaaattgaaatggattttttcatcataagttgttttattgttattctatgtaacagggccttatattgacttttaagaatgttattgtataagtgttatacatgaattttatttcagaatagcaaatgaaatgttagaatatcattattaaaaggttttttattagcttaagaagtattagtgagaagatgatctccatcaagatgtctctttcctgagcgcctagcctttcagaatttcacttgtggatcagtttgagatattatgccaatcttctcagggttaagtgactgttttatgaccgtccatctaacaatactaaaagaagaaacaagaaaccaggttttatgacttctagtaaactcaataaaactgtgattaaagacaatgaccatattcagtttagtcacttaatatcttatattcacttactgaattaaaaatgaagagttaagagaaagtaatcaataatattttgtgttaaattaattcttactatcttaagctctaagacaaaacttagtgcttttgcaacttttctgatgattcctttcatcccaaaagtagcaaggcactttgtctcagttaattctacagtccattttgagttctgccttggaggccttaagactttacacaccttaaacaataattggaatcatgaatcatttttatctccaagtcaataaaagacccatctttgtaatgtgttgaggaaaaaacaaaatcccaaaccaaaactccaaattactctgtctttaggattaagcagccttgagtattatttcctttgctacttcaactcaaagaatgttgattcaaaagcagttttagcaagacctaaatgaaattttaaagcattttttaaacagcttttattctccggagtcttaataataaaatgagcccagttcctggaaaatcttttcagaattgtggttgagaaatgatgtgcagtgactagtgtgtgtaatatttgagtctgtggaatattaacttaatgaaggattggttgcttattgcaaattcggtcggaaatttggcactgctaactctggtacagtcattctctctgttcatcatcttgtagttgcattgcctattaaaagggtcacaagagcagcgcgctataacttgggctttcttgcagctgcagttctacctaatttgtactttggcactcgaaagattataataaatgaagtgctgccttcaaagtttcagacacaccagttttttcccctgtttggcaaaggtggatttaatttgactttcacgagtgcaaaatccgtctccttagaagttcgtcaaactattaattttatggcaaggacaactgagtacagtaaaccttttcacaaagccagacagcttaacctaattaagtgcttgttttgacaggtggtttaaagtagaatgaatgccatcaagaatgtttcaagaaatgagtctgatgaatgtgcgagtgtgggcatgcaggtgaaaatgtgttttggaaggatatgatgacaggtctgtgtccaaaaagtggaaggtatacatcaagcttcatctgtgcactcgtttggtaatttctgtctcttctatagagattttaagaagatggacagcatcaagtccatatgaaaatctaaagatactggccgggcacggtggctcacgcctgtaatcccagcactttgggaagccaaggcgggtgggtcacctgaggtcagaagttcgagaccagcctggccaacatggcgaaaccccacctctactaaaaatacaaaaattagccgggcatggtggtgggtgcctgtaatcccagctactcgggaggctgaggcaggagaattgcttgaacccgggaggcggaggttgcagtgagccaagatccgccactgcactccagcctgggcgacacagcgagactctgcctcaaaaaaaaaaaaaaaaaaaatctaaagatactgagaaataacattgaccattattaaaacaacttgcaaagtaacttgtttgcctctgagcagaattcaagtatccctttaagagactggaggtgggttacaaaggaaatttcaactttgaatttgatatttctgaatatacataaaatttctcagccttttttctgtatggggtgcttaaattttaagactggagacaaagtagaaatatcattagccagtcctacgactatttttcaggcagcttcttgtatcctttcatgcacatttcaggaaaaaaaaaagaaattgatcaatcttccagactgggattcaaaaagatgttttttaaagaggagtctatagaatttgttctgatgtggtatttcactgtgtgtgcaataagggttggtgttcagaacgtggattcttgatagatttccagctctctatctctgtttcttttccccatcaaggttctgggtcctggatagcaaaatgaaaccaaatcaatataggagccctatagtcatttgatagtgatgtaatacttttgtctaaaaagtgttgatttctttagagtaaacttaacacattgatagtgtcaagactttcagaaagacctatctcagacatcatattcctcatcaaattattaatttatctctctgatgacaggaaataacctcctaaaataattcatataaatttccattttaattttttttcagtgcttgcaaaaattaaaaacccaaaactgtcaatagctgaagtgatatcattgctgatggtgaaaaaagtaatttaaaaaaaacttaatttgcctgaagtcatatattcattaattcttagagctccaattcaatccaaatccttaaaattcgaggaatattctcttaaacattatgattccccagatagtgaatttgtaaaatt

SEQ ID NO: 12715 - DNA, 40037 bp, Human
  misc_feature (1)...(40037): n = A,T,C or G
ctccccagataggattaattgcttccttgtctgtgctcctaaagtactttatacatgtctttgtcctactacttatttcattttattataggtatctaagcaggcacaggctaatgcaatcaatgaatgctcctgaccttgaaaggttgttaggaggattaaatgggataacaaatgcacagttcatattttctttcttcatccctttcttaataatattaataataatctgtattgcagtttaccaagtataaactttgatagtgtaccacactgtgtctcagtcgatctgggaataaacctgtgagatagagatgggattattatttctacattatacttggaggaagtgaagtacagaagtattaaaaagtgataatatgggtgggtcagccgaacgcctgctattgttcaaggccaggtggagtgctactgtctgtaatcccagtgctttgggaggctcaggtgggaggatcacctaaggccaggagttcaagactagcctggacaacatagtgagacccttctctacaaaagataaacaaacaagcaaaagaattaccttgatcatgtgcctgtagtcctaggtatgagggaggatcccttgagtgtaggagttcatatttgcagtgagctataattgtgccactgcactccagcctgcgtgacagagtaagaccctgtctctaaaataaaagtggagtcaagttttcgggttacaaaatttgtgatgtgatttttggataaaatacaattttatatatttatggtgatgttttgatgtatgtatacactgtggaatgactaaatcaagcgaattaatatacccattacctcacatactttattgaggtgtgtggtgagagcatttaagatctactcttagcaattttcaaatgcattatactttgttattaactacagtcactgtgttgtacaatagatctaaattttcctctaactgaaattttatatctcttgaccaacatctccctaatctccctcccccaaatctgtgatctttcttttctttttttttttttaaattaaggaccaatgtgacagtaagtgatctttcctttaaaccacagcgcttcttgtatgctccagccagtatttttccaaattgcgggtagccatgcgttgttgagtagtgagttctgggtactttgcatgtagtaaggatgagcagagttttcattacccggttgcaacgtaaaatgtatttctcactgtgggtccagagtttttaaaaagcatgaaagctcctgtgctagcacaatgccaagttctaaataacgtttattaaatggaattatagtattttattttcattttgtatttatttttgttttctagagctatcgcctccattcgtagctactggacagtagagaccataccatctttatttttccgattcccagtggagtgcttgtgatgatgtgggctcattcaatgtgtgtcaaataaaagtctgaatggatacatcaatggaagggataatatagctcagtgaatgtgcttgaaactaactgctgttctaactcctggtattcttctgattctactgtgagagctgacattgttcagttaatcgtttccaagggccctagtcccgcagacagtgagaccaagaataattcgcattcaggaagtaccacttgcccttagtcaatatggcatcctgaatgacttccggaaagggcaccgcaaaaaaaaacaaaaaaaaccgaaaaaccgttgacattagtcaaaatggccacctttggcttcgctttgtcagaatgcgcatgctcattcccgttcccgtcacctccgcgtggccctgacgcgtacgtcacaccgtagagggacggcgcgggaggaataaatttctctgtgattggttggtgaaggttttcaaaccggagctgtgggcgcggcgctgctctgccgttgggtgaggcgcggagcgaagtgaagggtggcccaggtggggccaggctgactgaagtgagtagtgggggtgccagaccaggtgcgtctgccgctggattgtgataggaagcagagtgttcgtgtggtgagccgtggccgccgcgggggtccgggacagcgggacagcgggacaggctggcagccacagcctctccactcgggcttttctggggtgggggtcgtggcaggtcgaatggacgcggcctgggagggtcgggggcttctgtcttggcgccgggttttgtggaaagccgggggcgtctttttgaggtggtggctggaccagggcaggagtcatcctaaacaagagtctctcagtcagatacgagtttaagagtggttggagtgacaccccatcgttttcgaagggaagagccctggtgtttgagaggcccgggcggcctgcagtggagcccctctacttcgtgggtctcgtatgtctagggaggcaaggcaaggcaatgacatcttgtccttctcatcctgattcttaccctcagtaacaacgaggccttacttgtacactttcacgtacatttctcttcacaggatttcatccgtaggccgagaggtgtgtgtcggaaagtgggggtaggtgggtagataagccctttttttttttaagaaagcattatctttctaatgtgtcgggtaaataagctttccgagttattgtaggtgtttagagaaggcgcctttcctgtagcttaatcattcaataagtatttatcttttggaggggacttaaaaaaatttttgtatatttagggggtacaagtgcagatttcttacatgcatatatcgcgtcgtggtgaggtctggtctcttagtgtccccatcactcaaatagtgaacattgtacccaatacgtagtttttcaaccctcagccccctccaccttcccatcttttgtattctccagtgtgtattattccactctgtatgtctgtgtacccattgattagctttcacttataagtgagaacatgcggtatttgacattctgagttatttcactgaggataatggcctccagttctatccatgttgctgcaaaagacgtgatttcattcttttttatggctgagtagtattctgtggtgtatgtctgtctatatattacattttctttatccaatccttcgttgatgaacacttaggttgataccgtatctttgctactgtaaattctgctgtgataaatatatcaatgcaggggtctttttgatatactgatttcttttttttttttgagacggagtctcgctgtgtcgcccaggctggagtgcagtggcgcgatctcggctcactgcaagctccgcctcccggattcacgccattctcctgcctcagcctcccgagtagctgggactataggggcccgtcaccacgcccggctaattttttgtatttttagtagagacggggtttcaccgttttagccaggatggtcttgatctactgacctcctgatctgcccacctcggcctcccaaagtgctgggattacaggcatgagccaccacgcccggccgatatactgatttcttacccttatacccattagtgggattgctggattgaatggtagttccatttttagttctttgagaagtctccatactgttttccataaaggttgtactagtttactttttttttctttttctttttcttttttgagaaggagtcttgctctgtggtccaggctgaagtgcagtggtgcgatcttggctcactgcaaactctgcctcccgggttcaaatgattcttctgcctcagcctccggagtagctggaattacaggtgtgcaccaccatgcctggctaattttttatttttaatagagatacggtttcaccatgttggccaggctggtcttgaacttctggcctcaagtgatcagactgccttggcctctcaaaatgatgggattagaggcgtcagccaccatgcctggcctgtttactttcattcaataggtatttcttaagtgcaaagtgtaagtagaagacagtcttatttggtcttaaagaatgtgcagttaatttggggtaacagaacttaaaaagataactggtgagtctggtaagcctatacactgttgaaagtactgtgcattagtacatcccttttagaaaactttttggcactattaagagccataaaatgtttttacaccctaatatagcactcctagccttggaaatctagtctaaggaaaacagtcacctgaagaaaaatattgtccataggaatgctcaattcatttattcaccaaatatttattagtcatttaccaaatgtcaggtactgttctaggcatcagggaagaaaacacaaaaatctccgctttcttggaacttaagctagaggagaaacagacaataaactgaataaatatgtaagtatgttagatggagagaagtgctttggaacaaagtaaagcagggtaatgttagagaaaggctgcagtttacaataggatggttggaaagacctcactgagaaagcagcatttgagtaaagatatttgaggtgagagagtgaccatgcaagagattccaggcagaggtaagtgaaaaactggaaatgacctaaacgtccaaagaagagaatagttaaatagttgttcatcaactctttagaacttaatggaaacatgatagaagcaaaacacaaaattatatgtaatgtatgattgtaacaccatgaaataagagtgtaaaatgggcaaagattagatcagatggtacatatagttgtttaggatagtgagatttttgttttgctattaattttttgtttttgttttcgttttgtttttttttgagacagagtttcactcttgttgccagggctggagtgcaatggcgccatcttgggtcactgcaacctctgcctctcgggttcaagcgattctcctgcctcagcctcctgaggagctgggattacaggcatgcaccgtcatgcctggctaattttgtatttttagtagagacagggtttctccatgttgatcaggctggtctcaaactgccaacctaaggtcatccacctgcttcagcctcccaaagtgctgggattacaggcgtgagccaccacacctagcctgttttactgttaactttttgaacatagaagattaataataaacagtatttttgtatctgctaaatgaatgttatagataataaaggaaatcattttggactgaaatggttagggaaggcttcagtgaattggtgagacttattctagaccttgaaggatggaagaccagaataggaagaattcacagggaaaaaaagaggtattcagtatgctgaacttctagtaattttctgaaaaatcacaattcaaatcttcccttccttattttagtcttcatgttggattgagaacattttgtttactctctgcaagtgatttgcttataaagaacatttggtttcaagataatccttctgtccgccagttgtattagagactttcgatacagtgaagcagaagctggacatttcaggaaaagaattgtcctcacattgtcctcaaatgtgttcctatgaaaggatcttaaagtactgagattatctttgagaatggttttccttgacagcagggaatctatattgttgatttcttggaaatctccagatttagcaatgtttgtgggaaagtttttcattaaaacactttcctgaaaaactccagcaacctttcattgctttgtcttaaagtatttaacacccttgatgcatctaaaaaacctgatatataggtctcttaataatgttgtttgaaggaggaggaagaagaggatagagacttttcccaggataccctgcagtaagatctgtaatagtctgtttttctgaaggatgatatctacctcttggctgggtgattgaaattaaattgggggctcaaagcaatcacatccagctgagactctttcatggtgtttccagattgctcccttagggatactcacagattgggaatctgtaacatactgacttctccacctctggggttccccatcaataacagctgagattctctagcaccttttggtttaaagtgctccacaaactgagtttcttgctgcacgcagggatcgtttcagctttcccgaaaaggcagcagtctctgttgtggaaagtgacagctgttttacagctgcaaaagcaatgtactacaatatgactttgtttttgtttcctttcacattagtgtatctcctagctatggactaaataatacatggggggaaataaacaagtattcatgagggtgaaaatgtgacccagcaggaaaattacaactattttcaattgacgttgaatagggtgagtaaattttagctttttgagttacaatttggctgagatatcagagttagtactgatatagaaagatatttttgtcatctataaataattcctgagagtcacttctgtagaatgttaataaaaatatatggtcccctagcatataaagagaagaggattatattctgctagtgccatttttggattaccctaagtaaatctatgttagaggaaaaaataactcttcagaagcagcaaacctcatctagaacagcttgtttaaaagcctagacctggccaaattttgctgtttccttgattcttcttggtctgggttccagctataatttgtgttttatatgtgttgctgtttgtatgacatgttatggtttgcaggaggtctctgagtaggtctgcaacatatatggtctaattgatatttttgtaacttatctcttcaatgtgttgggttggagagaatatagattttggactcagacctgggtttcaatgagaactcgacatttattggttaatttaaggtttctggacttagttgcccattgtctgtaaaatggagataattaagttagtgaggccaggcatggtggctcacgcctgtaatcccagcactttgggaggccgaggcaagcagattgctagaggtcaggagtttgagaccagcctgaccaacttggtgaaactccatctctactaaaaatacaaaaaaaaaaaattagctgggcctggtggtgggcacctgtaatcccagctactcgggaggctgaggcaggagaatcactcgaaccctgaaaattggaagttgcggtgaaccgagatggtgctactgcactccagcctgggtgacagagcaagacaccgtctcagaaaaaaagtcaaattcacttaaagaaaaagtgtacgtgaagtgtctagtttagtgcccgaatcatttcaaagcacctagtaaatactggattcttttctttctaattgtatagtattatttttaaaaatggtctaaaattctgaatttactgatatccttatttggagacagcctaggggggaaaacacctagatttgagaatcactgttttaggatggaagtaacaactatcagaccaaaaccaaacctaaacaaaagaaactcacttcataccaactaaaagataccttatattttggtagtgagattgtaaacttatacattttaaaatttttgtaatattctatgaggtaaatagagcaagtgttattgttttcactttatagatgagtcatggaatttaagtgatttactgaagattatactactggtagatagaagagctaaaggtttgtcccaggacctttttatttatttatttatttatttatttattttaagagaagggggtcttgtgatgatcagggtggtctcaaactcctagactcaagtgatcctcccacttcagcctcctgaatagctgggactacaggcacgcaccaccacacccatcttgtcccaggacttctgctccctctcccgcttttaactgttctttttgctttaaactatattacacgttgatgttgaggtagaatggaaattcttttgaccatagcatcacagatatgtgtgtgtttgttctctgaattaacacttatcaatttttttttgtgagcatcatattaaatgctacatgcttgtgtgtgtaatatagtagtgccgcatgtaaggtttctcccctcaaatttatattctagctgggacacagggcagaatcatatggtaaagtttaattcaagtgcaaagagtttgtatctgagtggcaactgcctgaagcagtaggggaaggactggaggcagggagtgcaattgaagtgagtggtgacaacctgcaagtgataagggggtgggtatggtagatacatgagagaagagtacacaaggtttagtgattatgctgttggaaggggaggaaccagaggtgattctgaagtttggaactgagcgactgagagaatgataaaaatagggaaatcaaaattggaagtcagtagggtatgggatagggtaggtcagtgagtagcgtagttgatggacatgaacaggaagagtagaacagtgtcaggaggctgaggccggagaatcacttgaacctgggaagcagaggttgcagtcagctgaggtggcgccagtggactctggcctgggggacagagcaagattctgtctcaaaaaattaaaaaaaaaaaaatggacaagagaacaggttatattgtaatttaagacttaaaaccccccctaaaaaagcttttttttaaacaaccagttttcaacatcctagcaccatgaaattttcctttttgaattcttggacagatagaagttttgccgtggtattgagctgtcttatagtctcacgatatataagtgaatgccgagatgatagaaagtaataccttatattaaaactactgattagagtcttccatttttacctcaggagagccaaaggaaatcaacatttgaattgactacccaatgtcctgcccctgtttctgtcctgtagcacttagggtatgttgcctatttcattatatgttaaatccatggcatctccatgaattccacagctcttcctgccggttttaatgctatccttttagttttgttcttagtttagagaaagatctttgtaataaatttgttggtctggttgcttagcagcttgctgtgattatgtagcttggaacagatacttgccgtttgaaaatcttggtttccggccctgattcaggtatatgttgcatccaggcttggaactgagaactttttttctattatagcaattatcatatgagtataaatgtataattctgcagcatttaatatataaaatatcttcatgtttatatattctttttttttttttttttgagacagagtcttactctggcacccagactggagtgcagtggcaccatcttagcttactacaacctctgcctcccaggttcaagcgatcctcctgcctcagcctcccaagtagctggaattacaggcacacataactgtgcccagctaatttttgtgtttttagaagagacggggttttgccatgttggctcaggctagtctcgaactcctgacctcaagtgatccgcccgcctgggcctcccaaagtgctgggattacaggcgtgagctgccgtgcccagcctatgttcatatattctttgtcctttgtgcttttttatatattttttcttgctctcatagcttgtggtgcaatcttgtaaacattgcaaaatcactaacccttcataagagttcttaaaattttatttaggaaataaggacctggactagaatgttgaagcattggttaagagaaacacaagaatcctttaatggtatttctgaggacattaaatttctaataaaatttgactttttatttcatttccttgatagttttcataacatccagttaatgtctttctttcttgactgttaagtgaagatcttatttcctcaaagtgttcccagttaaagtctatttggaatagaaccgcctgtaacgacactgttttttctatagtatcagcaggcctttgaggggaaatacaaagtctgaaattcactatacaggacacagtagcaaatgatttttgctttgcccttcgaactgtgaaggtgctgtattgtctctctgatgccagaatgtggtacaacataatcctttgcctctacttagtataaatttattagacgtagttcctgcacgcagcccagcagagagccctgtattacagaaataattcttgtgctgctgagctggcgattttcccacttaatcactcatgtgacgtcatctgtgcttttggtaggaaatgtgctgaccatgtcctgcattttaaaaggcagttgcaacaggggcattagctaaaaatgaaattaaaaatagatattttaagttacattgtaggtcttcaaagcccacaaggaataaactggcaaaattattatattaatcaataggcttgacttgaagaaccacattttcttgttggtcagtcacttgctaatgaactgacatgctctttcctatttgttttctgctccaagtgattggaggggctgttatattcaaaggtctgaaatggttttctaattttcagatgagtcttaaacattccaagtttgtttttataataagaatcacacaaaacatctgttgttagcttgagattcttataatggtagttataaatggaagagtccagatgttggtcactaatggctggattgctatagaatcttttgttgtgggcgagaaggcaggacccctaatgtatatttgatttcttggcagaaagatggatactatgatgctgaatgtgcggaatctgtttgagcagcttgtgcgccgggtggagattctcagtgaaggaaatgaagtccgtaagtcattctgagctggcctgtccaaaggaaaaacagatttcaaatttgggatttttacaaagctgaagtattttccaatcttaaagttgttttccatttgggttacctaaaaagaaagcagtgatcacttacgtggtcaaagcctaatgggcactcattctaaatggtcactaaaattcttttctatagctgctcttaataggttttagccaggcttttttattatctttatttatttatttttttgagatggagtctctctctgtcacccaggctggagtgcagtggcgacatctcggctcactgcaacctctgctccccgggttcaagcgattccttgtctcagcctctcgagtagcagggattacagacacacgccaccacgcccggctaattttttgtatttttagtagagacgggattttgccatgttgcacaggctattcttgaacttctgacctcaggtgatccgcccgcctcggcctcccaaagtgctgggattacaggcgtgagccaccgtgcccggctgcttttttattatcaagattctttttccactgaatagttggcactattttctgtgccatgaactgggaaaaatttactaggatgttgcttttttctttagagtagtagttgtcttttttttatcctggattttctttgtgttctataaagcattttcagttgaagtgggaaaaattcataatttcttcttttttctttttttttaagaatctcattctgtcacccaggttgcgccaccatgcccagctactttaaaaaaaatttttttttaaatttttttaattttttttttatttttgagatggagtcttgcactgtcacccaggctggagtgcagtggtgcgatctcggctcactgcaagctccgcctcctgggttcacgccattctcctgcctcagcctcctgagtagctgggactacaggcgcccgccaccacgtccggctaatttttttgtattttcagtagagacggggtttcgctgtgttagccaggatggtctcgatctcctgacctcgtgatctgcccgcctcggcctcccaaagtgctgggattacaggcgtgagccactgcgcctggccttaaaaattttttgtagagataaggtctccctattttacccaggctagtgtccaactcctggcctcaagcagtcctctcacttctgcctcccaaagtgatgagattataggcatgagccaccaggcccagtccataatttctttttgaaggagatactaggcatttgctttcacctacttcatatatttgatgctaaataattaaggattgagagccaggtttggtggtttgcacctgtattcccagctactcaggaggctgaggcagaagaatcacttgaggccaggagtttgagaccagcttgggcaacatagcaagactgtctctgaaaatattagcggtcgggcatagtggctcatgcttgtaatcttagcactttgcagggctgagatgggtggatcgattgagtccaggagtttgagaccagcctgggcaacatggcaaaaccccatctctctcttttttttttttttttttgagacagaatctcactctgtcacccaggctggagtgcactggtgtggtctcggctcactgcaacctccacctccctggctcaagcaattgtcctgcctcagcctcctgagtagctgggattataagtgtccgccaccacactcggctaatttttgtatttttagtagagatggggttttgtcatgttggccaggctgatcttgaactcctgacctcaagtgatcagcccaccacagcctcccaaagtgctgggattacaggtatgagcacctggccacaaaaaccccatctctacagaaaaaaaaacaaaaacaaaaaaacccgccagtgtggtggcatgctcctgtgatcccagctacctgggaggctgaggtgggaggatcactggggaggcagaggttgcagtaagctgagatcacactcctgtactccagcctgggacagagcgagaccctgtttcaaaaacaaaaaaattagctgggtgtggtgacacatgcctgtggtcccagatactcaggaggctgaagtatcacttgagcccaggagtttgaggctacagtgaactatgattgtgccactgcactcccgcctgggtgaaagtgagacttcaattcctggggggaaataataaagagaattgagatggggtggtgagctggggagaaaaaggaggtgctaagaaaggaacagtctgggaaataaattagcaagaaagaataatggggatgatggtactgacatgtgatccaagggaattattctataccagcttctctttgtattaccatcctgtcctatttcagattttcattaatacctaatttagtaaatgttgctctcaagtcagcctcactggtgttaatgtaagaactgtgtcttgaactttttttatttctatagtacttacttgtggtatcttgcttatgccattcaatattttttttgaattgattgatgtttttaatagctcttatccacttacaggcctttcaaaacaatattctattttctctctctaatagctgctgcatgaccctgtcatctggtaccagctcagtaaccacaatggcatactaattaggtttctctttgaggtcacatcatctcagaagatggatcagagtgtggtggggactagagtagggaataagagatattaaaactcagattcattcagcaaatattttgtgagaacctatcagggcttctagcatttttgagttgagggaaagggatgactaaatggtgtcatggaggaaagggtttgagctgagctttagctgtagggtagaatcccaagaggcagagatgaaagggggtattttagatcaggcgacagcctgagcagagcaagagggtgtgggacttgagggaaataggagtaagggggtgtgacataatcagaaccgtgctttgggaagattaccctggcagaggtgtagtctgcattagaggtggatgctggtacactgactaggaatgacatggttgtcatagctcaggaaagaggcaataacagccctaactggaatggtggttatgaagatggaaggagggagaaatgggtagaagagattgtgataataagacctgtagaaggaggcagctgatagaatatgggggcagagggaagaatctgtggtttaagagtgttgataactagtgctggcttttacctgttatttctgtgtctgtttttccacctataaaataggaatttaaacatctttattttctttgtgggagtgctatgaggatttgggcataaattgagatattagttgtgaaaatactttgggaaatgattatgccaaaaatctcccaagatatttatttttacagaaatcctgattttattgtataagcaaatttttaccttcccatttatttctattataaaacagaggtacattttacctccttctccagatctctaatttggaatgttggctttttttattttttatttttattttttgaaacaagagtttcactcttgttgcccaggctggagtgcgatggcgcaatctcagctcactgcaacctccgcctcccaggttcaagtgattctcctgcctcagcctcctgagtagctgggattacaggcatgcaccaccacacctggctaattttgtatttttagtagagacggggtttctccatgttggtcaggctggtcttgaactcccgacctcaagtgatcctcccaccttggcctcccaaagtgctgggattacaggggtgagccaccgcgcccggccctcatttattttttattttttttgaaacagagtctcactctgttgcccaggctggagtgcagtggtacgatctcagctcactacaacttctgcctcccaggttcaagcaattttcctgccccagcctcctgagtagctgggatttcaggtgtctgccaccattcctggctaatttttgtatttttatttttatttatttatttattttttttatttttttgagatggagtttcactcttcttacccaggctggagtgcaatggcacaatcgtggcttaccgcaacctctgcctcccaggttcaagtgattctcctgcctcagcctcccgagtagctgggattacaggcatgtgccaccacgcctggctaatttttttgtatttttagtagagacgggatctcaccatgttagccaggatggtctcaatctcctgacctcgtgaaccacccgcctcagcctcccaaagtgctgggattacaggcgtgagccaccgcgcctggcaatttttgtatttttagtagagacagggtttcaccacgttggccaggctgatattgaactcccgacctcaggtgatccaaccgccttggcctcccaaagtgctgggattacaggtgtgaaccaccatgctcagcctagtttttatttttttggagacaaggtctcgctctgttgcccaggctggagtacagtggtgaaatcatagcttactgcagcgttgaactcctgggctcaagcaatcctcctacctcagcctccagagtagctgggactataggctcatgccactacaccagctaattttttttttttttttttttttttttgagacggagtctcgctctgtcgcccaggctggagtacagtggcacgatctcggctcactgccagctccgcctcccagattcacgccattctcttgcctcagcctcccaagtagctgggactataggcgcccgccaccacgctcagctaatttttgtatttttagtagagacggggtttcaccgtgttagtcaggatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagtttttatgttctatttttaatttttcataagctgcctgagctttttaaaaaaaatcattggtgtataaattaggaataagtataatttaacatttatcaggtgcctgttgtgtgccagtgacatactaggtttgtgctacactatgcatagtaggaaataatgaagtatatatgacatattgcctgtcttcaagaagattatggtattttagtttcagagacaggatttttttctcatgaaacagaagatagtacaagtatcaaaatatatgcttttgggtaatctagaaaaatttagtgtgtagcaaactgattaggaaaagattcacagaccagatgggacttggtaaatgggtatgtaataggtagggcattccatttggagtgcatagcttggtcacaagtgagaaggcaggaatgcctctgttctgggggcagggacagactggtttagctagaggggtatttattgcatagtggtgggaggtaagtttgattaaactggtaaggtggtcttggatgctggtaaatttaatttgaacagcggcttttcattcattcatttgttcaacagattatttcaagtgtctactgtgtgctaggcaggttacaacactggagataaaagagcaaaggagacatagggtctttgtctttaagaagcttagagagggtagtagggaaggcaaatggaagagcctgttcaaaggcctccgggagtaaatggaaaaaaaaaaatcaggatttctggacccacttaaatttgcttgctgagctatgaaccaaatcctgatttttaaattttaaataaatcaaagatcaccctcaatttgttttgaggaaatttcccttctctttcctcctttttgataggggcacttcatagtttagggtgtacgtaactttttaaaggaggtactgtaatttgaattttataaatctttttttttttttttttttttgagacagcatctcactctgttgcccaggctggagtgcagtggcacgatctcagctcactgcgacttctgcctcctcgagtagctgggattacaggcgcacaccaccacacccagctaatttttgtgttagtagagacagggtttcaccatgttggccaggctggccttgaactactgacctcaagtgatctgcctgccttagcctccccaaatgctgggattacaggcatgagccaccgtgcccggcctgaattttataaagcttttaatgtgcacttcatggcaggctggtaccaagctgaattgtgattcaccaactgaccaaaacagtgccatgattattggtcttcaacatcaaaattgtttctgatctatggcccaaaatgccttctgacccaatcccagcaaactttgctcatagcagaattgtacataaaaatagtatctttcggccgggcatggtggcttatgcctataatcctagcactttgggaggctgaggcaggtcaatcacttgaggtcaggagtttgagaccagcctagccaacgtggtgaaaccccatctctagttaaaatacaaaaattagccaggtgtgatggcacacgcctgtagtcccagttactcaggaagctgaggcaggagagttgcttgaacctgggaggcggaggttgcggtgagccaagattgtgctactgcactccagtctgggtgacagaggaagactgtctcaaaagtgaaaagtaggctgggcacagtggctaacacctgtaatcctagcacttttggaggccaaggcaggtgaatcacctgaggttaggagtttgagaccagcctggccaacatggtgaaaccccgtctctactacaaatacaaaaattaactgggcatggtgacacacacctgtaatcccagctactcaggaggctgaggcaggagaattgcttgaacctgggaggcggagattgcagtgagccaagattgcgccattgcacttctgcctgggcaacaagagtgaaactctgtctcaaaaaaaaaaaaagtaatatctttttttttttttttttttttttttcacatttctcacctgcacacacaaaaagtaatatattaatcaggtatgtaaatgttctgctttgggtctgacttaaactaagctgaagcagtaatttaataaaaggagtatcctaaagaacaaacaaaccagcaaaattaggtcagatgaaaatctttttattctcaaaattgtttttcagttcggtaaatattttgagtgtgtatgcatacggtatttagtttgcaaacatatatgtttttttctttaagctaaaaaaaaaaacccacaaaaaagtagtatgttccagactaacccagcatattatttcttaaaactatttgaattgtaatatttttttaattgttgatatccgcattgtttaagataactaggtcataataacctattttgctgaaatttgtggtttgtaaaaactaaagtttccttattacttggtttttctggaacaaattggtatcctgatttgtaagtttgatatttggtcaaatgattaaaattgtttaaaaaggactatgtattgtttctatgcttttaggttaaattcataggggaaaagtgcccttactacctaagaatctgctagctgtgtgtgaatttggcctagtttcagttttaactgggttagtttgaccagcagcagatgtacaccttgagaccttcttccttgatgttggtggagagtgatccttagagatagacggaggttaactagaaaattgtaaggcacttttgcaaatacattgcagaacagctttgccaatagcaggagataagaatgaatgccaacagggttatcttcttcctttgagatgctgccttggaagtgatgttctctttgcagacatttgaagagacttcacattctgctatcagggatgttccaaaagctagtttgatcttctcttcctgtttttttttttttcaactggaatgtttacatacccttcagggcagtgttaaacagcaaaagcaaattggctttttactttcaaatcaatatttgtataattatatagccaaatggaattgtaggtctagacatctgtaatattaatctacatctactggagcatattacagcagttacatttgaatttgctgtttaacatctctctggtgcagcaatgcgtgactgtaaaggaaactgtttttgttttatagctgtaactgtcctggtgcatgacagctgccccaaaggtatccccctttgattgccttctgttcaggagctttcagtgttagtgttacatctggagccaggtgactaatgagttacatattccatagcagatgccactggctaagccaaaagtaagtggcctattgaataggaattgctacccacaaagttctcatcagagtgacaaacatatccaggatctgctcctagttattttcagctggatttgcccatagttcagctggttccttaattatgaatttcaaataaagctaaccgtaggactcatttattagagcagttatactctgtttggtgcttgaattattaaagattccccctttcctcagaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggtgtgtattgttttccgtgctagaacagtgatgatgcaggagggggaaggcattgtctgacagtttccacttgccaaatatacctagtttcttcttccacattaaagaactgaaagtgacctgttctttaacagcttgcccatgattagagctgaaattgcagactaggaatcttgttcttcataatttgaaatttaaatgtttttgtcacttagacttgaaacttacttaacagacagatttcaaatgagaacttaaagaattagaggaaaagggagggagggagatcctaacgtacttgatctgtcacaagttattggccatccttcattgtttattttaagtgctacccggaatatccatccttacatgagtagctggtactttgtcatacatacaggcaagacaactgtgactcttcttttcatcacccctctctaattcagggtaaaaggctagatgtattcaaccagttgagcaatgtgactgacacagaacactatcattttgatgtgccaggatgggtcataatgcaaaggaaagcctttactgggagggactaatccatcttggtatacagtgttagatgcctcagtaaactcaaattgtctggttccagtgcattatagctttgtatccattttaatgcattttgctccactactttgagaggtgggtggctgctttgatccgtagaagccaatatttgtcctgataaaatgacactaaagtgtttttgctatgtgaaatctattttgggactctcattttgcattattctcctcttggattagcaggttaatccaaaagtcttgtagcagaaacttcgctgttctagatgtagttcattttaccagtcagaaatcagagacacaatctgggtttgatgtgaattaatatgctattggtgtagcagccttcctgaaggtccatttgcataatgctgcattttaatgtcttctggtctgcctgtcccataaacttgaggtgaagctttctcccctggctagttatgatgttttactttgctttggtctgtaggaacgacagattcagctgattcgagagatgctcatgtgtgacacatctggcagcattcaactaagcgaggagcaaaaatcagctctggcttttctcaacagaggccaaccatccagcagcaatgctgggaacaaaaggtggaggaactgcatctgttgttatcctatcacaagcaacacaggctgtcagatattcttgttatctgaattcttaaatatacttcttctagaatgtgtgctgaaaaaagcagaaaaagattttgcggggagagtaggtggggaataaaggcacagggatgtccctgtatattttattttattttatttttaaatctttcctaaggatgttgtttcaccatggatacaattttgatgttggtgctaaattgcacatcaataactaatcctgtgcattgctaagaaacccaaaggtgaaagtggcagttcagcaatactttcagtgtttactctccagagagctcttacagctcttctggtttagaaaggcctctgtgagccaagaccagacaataattttggttccactgcaccactgtttaaaatagtctcaaccaggctttgaatttaacatccccagtacaatatgtagggaaaggtcagctatttattttgttgcctggttgttttatggggaatctttataactaagaagatgtacaggcttaatttcttaaaaagtcagtgttgggtaatactcttgtttgtagaaaccagcacagttgggatcaaattaaacttcattcccttgattttgtgaatttggagtagcctgtaatacaaactcggtagagaatagcacccataaccctgactaactttcaactgcccttataaggtctttgctgaaaaagcaactgtgttgcacctgtactcatgcacacacactcctccgtggaaaccatacaaagtagcctaccacagggtttgagattgtaattgtctctatagtgaagattttgctatgaaattaactgatgttacctgaccagtaggacttgttctgaatgttggtgaattttacattccacagtctaccatgtctaacgttgtattgtttcactgatctagactatcaaccattgatgaatctggttccattttatcagatatcagctttgacaagactgatgaatcactggtaataaacatttgatctctgagaattacctacttttcttacctctgcttccccaggaatatctctcctgtcttctcttctgaacatcctatattactattttattagttgatgtgttatagattctgagctagcaatttaaaatataaatccacatgagctataagaggctggcttatatattagtttctgaagtgagaatatataattcagaatttggcataagttgagttcatttaatagatctctgtgtgccacatgtactaactgattatattttgacttattaaagccccagctaataataaaaatattagcaagactgtatgtcgtcagggtttatttgctgctcttaaatagacttgtgccttatttctgaattagtttggttcttggggaaagcatagtcatacttcacaattagaaggaaaccaaggtcctgggatttcagccagaaaagtgtgattagagtttctaggcactatataatgctttcatcaacaatggttaacatgttaaactatttgttgccctgcttttatggggcggcacacttcttttaacttacagtgatgcttctgcataaaaggtcatctcctgatacagtctttgatatagttcattgatttgtgcatcttttctgttactagctgaaaactagcaaacaaaacaaatcaggaagtttttggtgactggttttctggtatagcaaaacaggtgacaactatttgttacatggctaggagttttctgttcagattcagtgtttgaccagggaaaatacggccattttatagataaaaatattaggcatcacctttctcaaatagggaatgatatagtggaggtctggaatatataataaaactagatcatattatcagttgatttttgagctagacctatgatacgatatttcttgtaactgaagctgaatcaaacaaccagtaactaaattactggaccatgacttggggaagttaaatttatttagctaagctattatttgctgtataccactgtttctagatactgttttcagggatgatcaggagtaaggaaatcacaggtaactactaaaatgaatgcaaatagttaaaataggtgaattgaaatgagaccacaataaaagacaaatagttcttcagtggtggacacgttttagggcctaagttcctaaactgtagaactttttttttttttttttttttgagacagagtctcactctgtcacccaggctagaatgcagtggcgcaatctcagctcactgcaagctccgcctcccgggtttatgccattctcctgcctcagcctccagagtagctgggactgcaggcgcccgccaccacgcctggctaatttttttgtatttttttagtagagacggggtttcaccgtgttagccaggatggtctcgatatcctgacctcatgatccgcccaccttggcctctcaaagtgctgggattacaggcatgagccatcgcctggcaactgtggaacttgtgaagtggcaatattatgcagagcatttgattagacagtggcaatcccttgggggcaagaatcacatctaatacaatcagtatagtgcctaacattctgtaagttctaaaactaattacaaaaataatcagaaataaaggatcagccactggaaatatggcagaatttgattctttaacctcttcttgcctctgtggtattgattcctgattttattataatagcttcaatttttcaaagaaagcacattaacttactatagctctatagctacaacacttgagaccttcccttctctaaccctccccgaattgtacgttaggtagcctgactgaagaagcctttaaagttctctgtaaatttatttgcacagggtttagggatggcctaaccaaaaaaagaaattaatacagtgtaattgtcaacaggattgggactcttctttggtgaagactttcaaactgaagaagagagaaaagagggtatgtatgatttgtttagtctttttttaaaacaaagtaataatggagttatttttggaaattttgccatgatactgcattcctgtcatgttgctctagccattgttaagcacatactacagatgaattcatgctgtggggacagtattgatattcttttttttttttttttttcttttttttgagacggagttttgctcatttcccaggctggagtgcaatggcgcgatctcggctgaacgcaacgtccgcctcccgggttcaagcaattctcctgcgtcggcctcccaagcagctgggatacaggtgcctgccaccatgcctggctaatttttgtatttttagtagaaacggggtttcaccatgttggccaggctggtcttgaactcctgacctcaggtgatccacctgcctcggcctcccaaagtgctgggattacaggcgtgagccactgctcccaaccagtactggtactctttgaagtagtaacttaggacagaatcctgtccatttcactgtttaggctgcatttcaattcattcatacagtggaaaaggataaacttaagtttgttttgaattgtcatatgaatttttacacagaacttttgtgctctaatataagcttcatataatgggatatatagagatctatctgtgtatgcttgtttagggtacttaatgtgtttccaagacttcatgtccttagttaggattacagctgtactttttctggtggtgtcatctaaatttctccatagcttgctcattttttctagggcactgagagcatttttgtacaacatattcttttgaaacagcttattcttcatgtggaaataggcaaagagagagagagagagaacacattgtttgttatttactgtagccctaatccccaggacctgtatccaagttgtttgatggaataattttatcttctgtgcttcagatctgcttggcattaaagttacgggtctttgtctcctttctagcgctctactagccgacagtttgttgatggtccccctggacctgtaaagaaaactcgttccattggctctgcagtagaccaggtaagaatagtcaggccaaggtaacagagattactggccccaagcattaaaacttctctgagtcagcattgcagcattgttttgagagacatgatgtttagttaaagtttttgtttgttttttgagacagagttttgttcttgtagcccaggctggagtgcaatggcaccatcttggctcactgtaacctccaccttccaggttcaagtgattctcttgtctcagcctcccacgtagctgggattacaggcgcatgccaccacgtctggctaatttttgtatttttagtagagacagggtttcatcatattggtcaggctggtctcgaactcctgaccaggtgatctacctgcctcagcctcccaaagtgctgggattacaggcgtgagcctccgtgcctggcctttggttaaagtttttctatgcagtaggatccttatccctatgaatggaattactctgatgtagtaaacaactgtcagagtgagtcttagttgcttgaatatatacccccatgacctatgtttatcttcttaggtacgagatttctttatttttactttttaaagtagagggggagtctctccttgctgcccaggatgactcgaactgcggggctcaagtgatcttcccaccttggcctcccaaaatgctgggattgcaggcatgagccactgcacccagccaaacatcagatttcaacataagaatgtttcaggtcaggcgtggtggctcacgcctgtaatccctgcactttgggaggcctaggcagggtggatgatcacctgaggtcaggagttcgagaccagcctggtcaacatggcgaaatcccgtctctactaaaaatacaaaaatcagtcggccaggcgcggtggctcacgcctgtaatcctagcactttgggaggctgaggcgggtggatcacgaggtcaggagattgagaccatcctggctaacacagtgaaaccccatctctactaaaaatacaaaaaattagctgggcatggtggcagacgcctgtagtcccagctactcgggaggctgaggcaggagaatggcgtgaacccgggaggtggagcttgcagtcagccgatattgggccactgtactccagcgtgggcgacacagcgagactccgtctcaaaaaaaaaaaaaaaaaaaaaaaaatcagtcaggtgtggtggcgcatgcttgtaatcccagctactcagaaggctgaggcaggagaatgccttgaacctgggaggcggaggttgcagtgagccgagatcacgccactgttctccagcctgggcggtagagtgaaaaactctgtctcaaaaaaaaagtatcagactggggtcttaagtcttgactaagactaaggaattttttacctgctccaaaataccctatagtggagggtaagttagattctttgtttgtctttcctcattactacttttgttgcaggggaatgaatccatagttgcaaaaactacagtgactgttcccaatgatggcgggcccatcgaagctgtgtccactattgagactgtgccatattggaccaggagccgaaggaaaacaggtccattgaatttgtgactaaactggactgtgtaaaacaactagcaaaattttggagagttggtttcttagaaccctctggaggcggggattggatgtattgggtagtttcttactgctgcataccgaggaccagagaactgcttgtgtcatgctttacctttgaattgctagcccactggcataactttagtttttcttgaaactgtttttttacatagccattagttctcacttttggctatgataacagattactgtttatctcccagttaaaattggagctaaaatttagaaggagcaaaatacttaagacacaaagcttaaaagttgcttgttttctaggtactttacaaccttggaacagtgactccaccctgaacagcaggcagctggagccaagaactgagacagacagtgtgggcacgccacagagtaatggagggatgcgcctgcatgactttgtttctaagacggtaaatctgtgattgttgtttgtgttttaattttttaattgtgaaagtaataaataccaggaataaagttaaatactttagtgttataaagttaaatgtcaaatttccttcctcattccaattttactctccagaagtaactattggttacagaggtaagtttctttccattctgtgagtaatactaaattaaagagaccaacttttctgaagcaattgttagtacttttttttttttaatttgagacagagtcttactctgtcacccaggctggagtgcaggggtgtaatcatagctcactgtagccttaacctcccagtctcaagcaatcctcctgcctcagcctcctgagtagtagggatacagatgtgtgccaccacgcccggctaatttttaaattttttgtagagacttggtcttgctatgttgctcaggctggtcctgaactcctgggctcaagtgctccccctgcctcagctcccaaagtcctgggattacaggcatgagctactgtgcctggcccattgttagtactttttagtgacacatgtttacattttttcttgaatatatcacctaagattttcaaaatgttttgcttttgtaccattttatttccttataaaaatccaagcaaattaactgaggctcagaggagttaactgacatttttgagccacatgatagtaagtgacagatttcacatccaggttttctttttttctttttttttcttgagacagagtctcactctgttgcccaggctggagtgcagtggtgcgatttcggctcactgcaacctctgcctcccgggttcaagcaatcctcctgcctcagcctcccgagtagctgggattacaggtgcccaccaccatgcccggccaattttttgtacttttagtagagatggggtttcaccatgttggccaggctggtctcaaactactgacctcaggtgatcctcccgcctcagcctcccaaagtgctgggattacaggcgtgagccaccatgccctgccaacatccaagttttctgctctttgtaaacaagttctttccactatcacacactgctgccttccagtgggatgaccttaaacaagttacttaaactctctttgcttctgtttcctcatcttaaaatgaagaaaacaaaacctattttatgggattactgtgagaattacatatgtaaatatgtctaaagggcttagaaaattttttggcacatactaagtgctcaataaatgttagttgattatggctgggcacagtggctcacgcctgtaatcccagcacttagggagactgacgcaggcagatcacctgaggtcgggagttcgagaccagcctgaccaacatggagaaaccccgtctctactaacaatataaaaattagccgggcgtggtggcgcatgcctgtaatcccagctacttgggaggctgaggcaggagaatcgcttgaacccgggaggtggaggttgcagtgagccaacctctaccacgccattgcactccagcctgggcaacaagagcgaaactctgtctcaaaaaaagacaaaaaaaggccaggcccagtggctcacgcctgtaatcccagcactttgggaggtcgaggtgggtgaatcacaaggtcaggagttcgagaccagcctggccaacatggtgaaaccctgtctctactaaaaatacgaaaaattagctgggcgtagtggtgggcacctgtaatcccagttactcgggaggctgagacaggagaatcgcttgaacctgggaggcagaggttgcagtgagctgaaatcacaccactgcactccagcccaggcgagagagtgagattcggtctcaaaaaaaaaaaaaaaaaaaagttagttgattatgatgataattttctaattcatatcactctgttccttctgccctgttttatcccaggttattaaacctgaatcctgtgttccatgtggaaagcggataaaatttggcatattatctctgaagtgtcgagactgtcgtgtggtctctcatccagaatgtcgggaccgctgtccccttccctgcattcctaccctgataggaacacctgtcaagattggagaggtatgacttatgcaagccgtcattgttttatggcctctttattcgcctttcaaaggcttagtgtcagtttttgttctaaaattaatcatctcaaatatatttctttccacaaataatgactagaattgtaagatacttacttgtagaagagtcctgtttgggtttgtctgtctaatacctttctaaaccaaacttctttccccgcccctttttccttcttgctcttccctgcttctccttgcctcttcttccttccttcctccccttcatcccattttggaaaatttcagacatatataaaactagagaaattagtataactaacccctggttcttatcacttaacttccatgattactaacttgtgtccattttttttttttttttttttttttttttttttttttttcttagctctattgcctaggctggagtgcactggcaggatgtcagctcactgcaacctccgcccccctgggctcaagcgattttcttgcctcagcctcccaagtacctggaattacaggcatgtaccaccaccatgcccggctaattttttttggttgtattttttagtagagatggggtttcatcatgttggccagggtggtctcaagctcctgacctcaagtgatccgcccacctcagcctctcaaagtgctgagactacaggcgtgagccaccgcgcctggtcatgtccattctttttttaatgtctctcttttttttgagacagagtttccctgttgtccaggctggattgcagtgttgcaactttggctcactgcagcctctgtctcctgggctcaagtgattctcatgcctcagcctcccaagttgctgggactacagccatgtgccaccatgctcaactaatttttttgtatttttagtagagacggggttttgccatgttggccaggctggtcttgaactcctgacctcaagtgatccgcctgcctcggcctcctaaagtgttgggattctaggtgtgagccatggcacccagcctttatgtctgttcttgatttatcaatactgtcgttgcctcctcctgactctgtccaatgaattacttggaagcaaatctcagctatcatataattttatctgtgataaaattatcttttattcttgctcttatgttagacatacttcataataggttatcaaaatgaagttgcttatttccaaatatttaaccagtttaatccaaactgattaaatccattaagaaattatttattgctgagtgtggtagctcatgcctgtaatcccagcactttgggaggctgaggcaggaaaatcacttgagcccaagagtttgagaccagcctggacaacaaagcaagactccatctctacaaagaataaataaataagttagccaggttagtggtgtgcgcctgtgtttgtagctcctcaggaggctaggttggactattgcttgaggtggggaggttgaaactgcagtgagctgtgatcacaccactgcactccagcctggggaatagagcaagaccctatctcaaaaaaaaaaaaaattattatgtaagtaacattagcaagaatcaaaatgactatcttcctacctactcttcagcaaatcaaatattattttcccctgatcttacaagttcttatccatgcctgtacattttgttttgttttgttttgttttgttttgtttttgagagggagttttgttcttgttgcccaggctggagtgcaatggcgcaatctcgactcaccacaacctccacctcctgggttcaagcgattctcctgcctcagcctccctcatagctgggattacaggcatgcgccaccatgcctggctaattttgtatttttagtagagacagggtttctccatgttagtcaggcaggtctcgaactcctgacctcaggtgatccgcccacctcggcctcctacagtgctgggattacaggcgtgagctaccgcacctggccgcctgtacattttttttacacatgttctgtactctaatatagaaccatggagttctcccctacaggtaggtttgtgtcataatcaactgataagatatgttaaataattttttttactgagaataatgaaagtatacacaatttttttctcttgttccagctttcttctgttagaaaaaaaaatctgtttagagtaataaattattttatattaaaggctatacctgtaacctcattattgcttgttttctgctgtccttgagtggatgagaaggaggtaattatagctggtggtcttattccttgttcacataacagtgtggtgtatatatgaaaaagaaaaagtgtggtatatatgataataaatcagtcctggtgtggaggtaggaaaaataattgagagtctctgttttaatatatgctttgggaataggaatgtaaaagtagacatgatgtcccagtttgagaataagattggaggtggttcttcgcatgtggtcttcatctgttggtctacatggcgtaaataataatttaaagctcttttttttttccagggaatgctggcagactttgtgtcccagacttctccaatgatcccctccattgttgtgcattgtgtaaatgagattgagcaaagaggtctgactgaggtaagagtcaactgtaggagatggtgaatttgttatttgtgttaattcggaggtttttaaataaaaatgtcatcttgataatagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcaggtaagggcagatgtaatacttgaatatgaattcctccacggcagtagtttttcttactctctttatttttttatttattttttattttttagacagagtctcactctcgcccaggctgaagtcagtggcgcaatctcagctcactgcaacctccgtctcccaggttgaagcgattctcctgcctcagcctcctgagtagctaggattacaggcgtgtgccaccatgcctggttaatgttttctatctttagtagagatggggtttcaccatgttagccaggatggtctcgatctcctgccctgtgatttgcctgcctcggcctcccaaagtgctgcgattacaggcgtgagccaccgtgcccagcctctttttttttttttttttaagacggagtctttctctgtcgcccaggctggagtgcagtggcgctatcggctcactgcaaactccgcctcctgggttcaagcgattctcctgcctcagcctcctgagtagctgagattacaggcgttaacggtgttataccatgttagccaggctggtctcaaactcctgacctcaggtgatctacccaccttgtcctcccaaagtgctgggattacaggcatgagccaccacacctggccaccttcctctttttattagctcctgcctagtacaatgcctgaaacatagtaggtgctcaagtagtttgatggatgagtaactgtatgcgtgtcacccttgcctatcctcttgctttctcattacgttattgtgtacagtgttcttcctttctttccttcctctccagttaggttggagctttttcaattcttagaatataccaagtttactccctaccttaaggccttcacatttgttgtctcaacctgaatgctcttacattagatacagtatggtttgctcctttatttctttcatatttctcttcatataccttgtccccagaaacacctttcctgacaaccttgtctagattaacagctctcatttctttctagcttcttgcctgccttgttttcttcatttatgtatcactctacctgataggtatttgctttttgactgactccaccaatagaatgtaggttccataagataagggctttgtttacttctgctttatcctcagcacttgtacctggcacatcgtaggcccttaaatatgtctcatgaatgaataccttcttggtaattgtagtcactgcaattgtatgcctgtctgcctagcacatcagttgccaactgctttccctaactgcaaaggccgattttttaaaagttttgacttctaatattgagctgttggccagtatcctgcttgttaatgaaactagagtctgatgtagtcatgaactaatcaggagtttcagaagcttactgtatagatgagactttgtggtcgataacttggaagcccgctgtcaagggaaagaagtctaggcctcttggtgctttcttttcaattacagaaatcacagatgaagacaacagcatagctgccatgtaccaagctgttggtgaactgccccaggccaacagggacacattagctttcctcatgattcacttgcagaggtgagtacagcagaaacttgttctgggagttagggaatttttttccaaggggaagataatgtgggttgagtgtttgggagtatgagggatgaattgttttcttatagaatttatattttggtctgcatttaagcaaggagcaagacttctaatttaatattcttttgcttagagtggctcagagtccacatactaaaatggatgttgccaatctggctaaagtctttggccctacaatagtggcccatgctgtgcccaatccagacccagtgacaatgttacaggacatcaagcgtcaacccaaggtaggcaggtgcgtgtgtgtgtgtatgtgaacttgtgtaatgtgataacttgaaagacagttgagaagccctgagctttggaagtttgctaacagatttgctggcttttaggtggttgagcgcctgctttccttgcctctggagtattggagtcagttcatgatggtggagcaagagaacattgaccccctacatgtcattgaaaactcaaatgccttttcaacaccacagacaccagatattaaaggtaaggcccaagatgtgcttcttcagggacttgactctctctttagttttagtcatatgacctcttcctgcctttgctagagctgtttgaaaattctaacattaaaggaaaatttgtataattctaccatcgtaatttttttttgcttttccatgttctcctttctttatccatatggatatatgttttttaaatatagatataataggctgggcatggtggctcacacctgtagtcccagcactttgggagggaggctgaggcggacggatcacaaggtcaggggattgagaccattctggccaacatggtgaaaccccatctctactaaaaatacaaaaattagctgggtgtggtggcgcatgcctgtaatcccagctaccagggcggctgaggcacaaggaattgctggaacccaggaggcggaatttgcagtgagctgagatcccgccactgcactccagcctggtgacagagtgagactctgtctaaaaaaaaaaaaaaaaaaaaaaaaaaaatatatatatatatatatatataatagtttaaatataattcattcttatttcacttagcatgttgtgagaactttttctcatgtataatcttatttatcatttacttaaatgttctagtaggtattaacattatttttcaatttttcataattacaagtaatgctatagtcaatatagcatttctcttaatgataaattcctaagagtgggatcactgaattaaatggcttgaacatttttatgtgtcttggtatgttttaccaacttgatttattaaatttcttataggcttttgccaatttatattgctaaccaacaattttatatgaataggctggtttcactccagtctcactggcattggagacccattctttcattattgcaagttccttctaagggagcatattgcttcttctagtatagctaaaagtcagatgtttagatgttagatttgtgaagtgtggagttagagaatggcctaaatcaggacgtgtcagctattcattgagttcaaaagatacactagtgtgttacagaatgatgacaaaaatgatctctgggactttgctagatgtctaaccttagctcttaagtgcttcagagggtaatcagcttaaaactagccatctaaaaagatgccttcttttttcccacctctcttaaaaatatgtctgaactttgaagtgagtttactgggacctgtgaccactcctgaacatcagcttctcaagactccttcatctagttccctgtcacagagagtccgttccaccctcaccaagaacactcctaggtatgcagaattggccttcctaggaaataaaaaacaactactttcttagacttcttattatattgaagcttattgaaagaaaaattgcattcgattttagctagcaactagactttaaaagggaacgtggggctataaggattccttctttaaaaaggttctgaaagtctttactatttcccctctctcgttgttggtgactaagaatacttaagcaactattgcaaaatagttgtctagggtttcctacttataatgggttatatcaagtaatattatagttgtttattcaaccattttttatagaatatttttccagttcattctctttttattgtagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaacatgaggctggttttcttgtcttgcaaggtaattttcaatgccttttagaaaatcatttctggggctgggcttggtggcttatgcctctaatcccagcactttgggaggccaagataggtggatcacctgaggtcaagagtttgagatatggccaaactctgtctctacaaaaaatacaaaattaactgggcgtggtggtgcacacctgtggtcccagctacttgggaagctaatgtgggaaaattgagcctgggaggcagaggttgcagtgagctgagatcgtgccactgcactccagcctgggtgacagagtgtgagaccctgtcacaaaaaaaaaaaaagaaaaaattacttccttcaaagtgtcttgactctgttgttcatccccatttcccactctctggacccaccccaggcttaccaccaccgggagtttgtttcttcatttctcatccagtctctctttgtccaaactggagttgtagagttgtcctatgcctgttgtcttgtttaaagaaaccacagtcatgagttgcataatgacagggatacattctgagaggtgcttcattaggtgatttcattgttgtgtgaacctgagtgtccttaaactaacctggatggtgtggcctactacacacctaggctgtatggtatagcctattgctcctaggctacaaacctgtacatcatgtgactgttctgaacactgtaggcagctgtaacgcatggtaagtatttatgtatctaaacatagaaagggtacagtaaaactatggttattataatcttatgtgactactgttgtatatgggatcccttattgatcaaaacgttatgtagtgtgtgactgtacttaaaaaataaaacaacaacaacaactttttaaacaagtctttagggaccagaatggtgcagataaaaaaaaaaattgcctctggctggctgactgcctagaacatccttcactgctggaagtgactttggagtgagctgggatgattaactgagggcacctgcacttggaactctgaagctggtgaacagaatgtatctgagattgaacgtaaacagttgtaggcttaatatgtaactgtggagagaggaggcaacctactggcttttttcccaggagggggcagcttcacagcagggcccatctgcctcagcaaattgacagaggatgggtcccataccccctttcacacacgcctgctaggccttgttttttaaaactgccctagatgctacctcttttcttatgtctttgcaatcctagcgttggcctggttccatatttgctgttctgtagtatctccccaaggtgcattttcagtcactaatgtagaggaagtaaatggattgtgtaacattagtgaaggcaaggctaccctatgcaggaaccaatggtccattaacgaaaaaggaaatggtcctgtgtgtcaaatgttggcaaccatttgctcagtttttgggctaggccaagagaccttagccatgaaaataattctgataatagcaaagggaaatatatacccaccttcaacttctttaacagtacttcctgcggaacagcctgactttccagggccttcttaattatacctcctcaatgtgagggctgtggaagggggtccagtgctttggagtagccatcagtccatctcttactcctaaccctttctgacattcctctcttttaatgcagtttaattttactatcgcacttgctaataaacagaatctttaagttgtgatatttacctttattctccctgatctatgtaagactccctagtttgatgtttatctaactgggcaagcattacatggttggattcagctgcaacaatttgagtttattactgggtgtttaacaacttatccttccttaagagggtgaattcattgcttgcagagatagaagaaggaatgtgagttttggtcagaggacatttagggtgcgcaat

SEQ ID NO: 12716 - DNA, 9278 bp, Human
tgtggtagttgtgacaatgacatgaggctgcaaattgctgagagtgcttgacacatagtaagtgttcagttgaatagtcatggtgagggggaagaagtatagttttggtagagagcttgggatttggccccataagagacccaagttcaaaattgtaactctgttgcctggcagcggcaaagtccttttgtcttcatagtaatgagacagtggacagttcctactggcaagtcagtggtccacacaggggccgcatatcaggctatccaggtatcccagccctcaaagtgggttataaggtatccatccccgctacccccattccaagaaagtggcttctggccaactcaggagggggctggcagagttgcactcatgaagcccggcttcccttcaggaaagctacagagaagtgactgccctgaaatctgaaacttaacgttttttccccagtttcacagggttttgctttcaggtttcttttgccctctgccattctgggcagagcaaactgagccctgtcttccctggatgctatcgttcaggcccttcaacaaggccaggggtctgtcatccctgcccaggatctcagagctagactcctttctggggaccctgggggcacacactgggagggggatgggggtggggagtggaccctgcaacctctccaaatcccacagttcttctggcccaagggtttggaggagattcacagaccctacagtccttcaagatgctccatagtgaatccagtgaactgaaaaaaggtggagagggtcctggtaggagcgtgggcttctgattcagagctgggaccaagctcttaccctgccatttcctagcatttgttccctggggctgtcttctgtccgcataacgggagcaacaccagttgtagaggatcaaatgcagcaagtactccctgtagataagagcgagtgttactactctgcccccgccatcccgccccaacctctatcaccctactcccagattatctccctatgttttgagttgcaggactctctctcagcattttttttctggcggggggtgggggtggtaccaacccagagtccgggccatctggggctgtctctgcttgctttctcaaatctgtagtctcttctcccctgactggcagggccggccagaaaccagtgccagccaagactggatggtctgcctgattcgaaaagttggggcgtgctttctccttcaactctttcaaagaaaacgttcttgtctggatctttctggctgtggtgaccgccggcttgacctcagtggacccactcatttctggaactgtcctctgcaccccgccctgccctaagtcccgctccagatctcaccccatgccacccaatccgacacccgacacacagagtcctagggtccaggagcggccgtcccaacacggggcgcttgcacacgccgacagacctccttggaggagccgctcgcagggaggacaagcccgggactccgccccccgccctgccacgagttccaccgcgagataagagggcccttccccaacgacgcagaatgccagaaggcaatctgggcgcgggttgctgagcccgggcccctccttaacttccccgacccggtctttccccactgatctctccgacctgcccctctgggtagcttcagccccgggtccacgcgctgctattggccctccccgaccgctcggctccaccttcagcgtcgcgattggtcagctcgcggggccccgccccgttttcctggaaagttcttggaaatctgtcaaagtatttcctttcactgctcagggccccagacccggcgacggggcccgcgcaccccgcccgggccccaccgctcagcccgcggttctaggaagacgctgcttccgggaagggctggaacgcggcagacaaaggattaggcagcagctcgccccgccccgctcgtctggcccgcccccctcgccctcgcaggcggtccgcgccactgcctctcagtccctgtcctgcgcccgcgcgccccgggagcctacccagcacgcgctccgcgcccactggttccctccagccgccgccgtccagccgagtccccactccggagtcgccgctgccgcggggacatggtcctctgcgttcaggggtaagcgcggctctctgcccccttcccggccaccacgaggggcgcacgggagaacaggggcttcgtgctagctgccgggcattgggagggcttgacgggccagaggtgactgagcgcagacggacctcaggagcaaggctctgtgtggggctgtgacactcccactccccgcccccacacacttacctcaattcccactgtggattgggaaaccgggggctggccggctaaaggaggaactcacagggtgggctcagcctgggttctcattggagcagatggatgctaacggcacggcgtcccccaagatgtggccaacaatcccagatattcttctgggcccagagcactctacgctagcctgcctgctgccctgcctgctagtaaccttggaccagcccctggccccctctgtcctggtgtcccctctcctgccccaggctagcaagtaggctcttcttgggaagccagccgcagatccttgcctttcctcaggctggccacctgatggtctgcaactctcgggaggccctgggtttggcctggtcctgcttggggtacccccacaatcgtctcacaaccctgtctcagcccagtctgggatcccaatgtgagaaggaccttggctcctgcctctcatcttcaaatttcccagacttgaggtaagggacagtggagaggggatgctgataagacagagtcttgacctgagctgagcattcctggccatccactctgtcctgaacctcagcaaccccttcaaccaaagggtctgatgctggccatggtgatgtgacaggagctcaggaagctccaaggagagaggaagaaggtataaatgggtgttctgcactcagggaggactgggtggctgtgcttatcgcaactggcctggtgccaagtgagggagggtggaaggtgaggccaaggaagaggacatggaggtgctgggaagactacttctcccttgctgtctccagcaagttccttcctcctgtctgcattctgggactcctgaatacctgccccaccactgccttccaccccaggagcctccccctgcattccggggtcccatagcctctttcactttttaccctaggtgagcacccccttgtaagctcagggctactgttgggtgtcagggaacaaagttttagactgctgcgctccaaagcgggcacacacatgtacctagaacacaccagccactgtccccaccatgatgatgacacagccatggacacacccctgcccaggtacacactcaccaggagcttgtggtgatcaacacagctattcatacacccagctaccacatcagccccaaaggtgcccacacctacatgtgggatctgaggaccggctaagctatctggacgtggccacccacagaggttccagcctgactggctagccaccaaccatgctcctgggaaggtagctctgggccccagcaagcaggtcatctcaaaatttggcctccagctctccaagagggatttccaagatcccacagtacagccagggtaggtgtggaaaagtttttgtcaggctgtggtgtgccagagttgtgtggccctttctcactgtgagtggtcatagggccatgatttgttagaacctagagggtcacctataacctacacaggagtcaggtctggctcctgccaccagctcctgcctgcgccttcctgcctcacaagcaatactggcgctgtttgcccatgctgtcctctctacctggggtcccttcccccagctccttcctttggcctggaagacacagctcaggagcaagcagaccctgactcccccgtgacacctgcagttttatgactttgcattataattactcttagtgtcatcttccccagccagtctggttctccttgagggcaaggccatggtttcattatggcggtgtcctgaggcccagccagggactagacccagaactaaggcttggagatgtattttgcaaggagtgagggaggagcagctgtcttcctggggaagtagagccagtccctgctgccctcccaaggaggaagccctagtatcaccctgctgggtgggcttcccctaggagaaagctgctactcagattttggtcggctcagttcccccaaccccagccatccaagaatatggtgttactgaacctctcagtgcatgggttggtgggaccctttattgcggaaaagggaaactgaagcccagtgaagagcaagctttgtacaagatcgtagagcctggtagggctggcttgccagggtgggaactggagtgtggattaggtccctgcccttggtgggagctcatactgacaggaggtgagacttgccagtgcctttagaggccactgtccaccccagaccctccactgggagaagcagaggccaggataggctgacttgtatgggtaggggattatttcagtctctaagtcctggccagtgtggacctaggtccctctgagagacactcctatccatggggaggtagcgtgtgacctcaggcagcctaccataatcctggggcttctctggaggaccccacacagatctatcataggataaatctacttgtctgtcgtagatctatctcaactaggaccattcatcagtgggccatttaatcagcccacttcagccaggagggcacaaacatgaagctactttgcactgaatcctatcagtgtggtgagaacattagacatgcctatagggaatgatctgtgtttttggttgatataaaatagagagcaattaattactgtttagtaaatgcagggcagtggaaaagaatctttcaaaagaggatccccacatggaaacaatcaaggtggcttttgtgatgacaagtggggaacgagatactggactaactgagcccatggctgggtagaggggaagctgaggctcatagtgagatgggccagccagaggtcatgaaactagtctggggcataggggggtctctggagatgggggaagcatgggtcctccactcactgctcatccactgccttctagacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggtgagtctgacgggggaggcaggccttttcctgagtagtctggtgggagaagcttagttctgcctttgagtctgatttgggaggcatagcccggcccaggagagtctgatgggagaggcacagccctctctagggaagcgtgaagctggaggcactgccttgacttgccctggattggttaccccagctaatttccactatgtcccttggccccctctgcacttgcctaggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgtacagagccctcaatggggccgattttcagttgtgtacacagtgtgtcccctttgatcttgttatcattagcccccatttgatatttgggctagcggagaggcccagaaattctatgtggctgagcagtccctgctggggactcattaaggagtggaggagacagggagcagcctctcctctcatctcccctgggtccccttgggaaatgggagctaggagacaaaggccagttagactgcctgcagggtgactgccctggccactgccaggcgagggctcgggggagggtggcagaggtgcatcagccctgagagatgtgtaaacaagaaatgccaactccaaatcgcaagtggagaatacccagggagagagagctgtggactactcctggggtcagtgtcttgagatgaggaaactagtagtcagagaagtcagggctggttctcccaggaagaaggtacagtgagtgcaaaggcaccaaggcatgactgggaggcacgtgttcctgacacacagaactgaagagggcttgctctgtgcagtggggcagggcaattgaatcggggtaggggccagtgagctggcagagtctgacctggggcggaggtgtccgggttctagtccagactggttgggattgggggatcctttcttctctctcagggttcagcacaccaaaagtgtgtggaagagcaatttcaatgaaaacaccctccattaccggacagtctgactttggaacactatctgttgagatcttcctgtgtcccgaagttttccgcacctttgcttgagggccccacaggaaagcttctctaaagctttctaacctttattctggaaacaatcctaaccttcctgttgtcttagccctcaagcaattagaagtcttagagtagaagagacacttgttggcaggttgagagcaaggaggggtgaggagtgacaggctgattacagggaggggtaaggacgaggatagacagcaagaaccatggagttcacacaggaccctggggacatggaggcagtcatggcaaagaataggtctgacgttaggtgagagtgagcaagaggtgggtgatggagggagggctgtctttcctggatgtggtgcccagacccaggtggccagccacgtgccttccctgttactggcggcggcctgagcgcttggctgtctgtagggccagatggcacgcttcctccaggtcaccatgacccagccaggggtatttacagttcctcattccttcagtctgaatttcagctgcttcattgcttccagaatgcctgaggtaacccctctgtctgcttcacccctagatttgagtcacctagcggatgggtagtggatacagaggggccagtgtcaagctgttcctcacctggtgctgcagcctggacagaaagctgctgtggctagaggaagcacagaaaactgctttgtacacagagagaaatgtctcaaggtgcctgccaggtgctgggcatggggcgagggcttgcacctcatgtagcactcaccacaactttgggagtgaagtccaaatattacccacgctacacagatgaggaaaccgaggctcagagcagggaaggggctgaccacggccactcaacaagtggggctcagggcagagctaaccctggggggtcctgactgaccttttgtcccccggattactacatgagatggggaggacagggatggtggcttccaggcaagttgctcttggatgctgttttctatctcctggtatccctgcctgctgagagctcttggccactggcctggccaccaaggtcctgttctcttcaccctggcctcagctcaagccagggcccggctcctgtctggggaggggctgccagctacttctgacccccaacaggttccaggttccatcttcttttcttgtttccctgccagggcagtgaatgatgcctgcccagaccccaatcagagactcagcctaacagatgctgaaga

SEQ ID NO: 12717 - DNA, 31414 bp, Human
gttcgcatcactgctctccagcctgggcacagagacactctgtctctgaaacaaacaaaaaaagaggggctaacatggtaaatttcatgtttcttatcaagtaaaaaggcttgctgacccacaatctatattaggtttccctgttactagcaaggagtgaaggatgtgctatcccaaaatatgtccaaaaattggtatattattttgagctaaaaacaccggagaaattgtagtttcagaaagggctagatgacctgtcgtttcctacagggaataagcagtaaagattcctctgggagtggcaccctctctgtacccgggtcagaaaatagcccttatcaccagagactgggagttggggctgcaatggacctgaataaatgaacttcccaagtaacacttaccttccactaattttacaccctccccaatatttctcctagtgactctcttagaaatgtatcgccccagccagatgccttttgtgctttcttctcaaatgcatcattctttgtctaaaaagtataaaagcatcttgctgtggccacttcttcagacctcactctcttttgaaggtccccatgaaaaactaataaagtgtgtatgcttttcttttgtttatctgcctcttgtcaattcggtttctggctccagcggaagagcccgcagaagcgctgaggggactggagacggtctctggcgcccctacacctgctcagtgagccttcagccccttctccctgacgaagctcccagaggctggaactctggcgcgggaggcacttgggaaatcctcccgaaagcaaggaggagcctttcctagaccgggagcggtcccacgcgggggtacaggttggggcaggggcgaccgagccgggcacaggaactcgcagcagggtagggttggcggctacgccgccctcggtccgcggggaaccacgcgggcttccgggtcacgccgccgcgttccgaccgccctcggggagaggggaggagcctccagcgccgggcggggcgtggttaaggccggtgggccccaccgcagccagacgctgcccgtttaagcgcagagggccgcgggtcacgtggtgggcggggtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtccggcgcgcccgcgcttcctcccccgcgcggccctgccggggtcgtgggcgcgccaaggccggtcccgcgcgaccaggcccgagcgtcccctcctgtcctgtcccgtcccgtcccagcgcgggaggcggcgcgcgctccttccttgttgggtgggctcagccgcggccaggtgtcctcgcaggtgacctcggggctggacccccgagccagctgcgcggatgcagtggccccgtggccagtgtctcaattgttggcgcgcccgtcttatctaggcttcttttgttgtgtttgtcattagttacactcgtagtcaagggtttagacgtcgagattttcattttccttgaaattttgtaaagggggaaaagactgtacttcaggcgtatcagcggcgccgatgcgcgaaccggcgttagaacttggagcctcgggaacccgacccggtgtcacggtggcatccttttcgctctctgctcttggtttttaaaattcacctgagcagccaaacatctgtaccttgatatgtgccgtgttactttagttgaacccagggtggtgtataacagaaataatcgcttgcgggttggcttctgagtttagatcctttcagagttcaggctgttaaccttgctgcttttccctctcaggtttttgctgttcgatctggtggagctactggcgtggtagttaaaggcccagatgataggaatcccatctcatttaggtaatggtatagacactttcagatcattttgtcatgtaaacagaatgatgtttttctaattcaaatggttttttataattttgtcatttggtctgccctaagaggcctgaagtctgtgtgcgcacatggaattcctgtctgtagggagggtcttcgtggcacttactagcacctcttgtcagagtggaatatctggagcagttgatttgggagccaaatacttcaaaagtggggcagccacttcctagcactggaaattaacaagtcagcgtgatgatgtgcccatttctggtttgttcacagaggagggcgttcatttctttagcccaggtctttccagagtggcaggtggaggagattcattgtttctcatgtaataatacaagaaaatcatggcttccactatacttaaggtgactgcatagtcccagttcgcactgttgaacaggtttaatgatcaacagcagggcctttcactttcagaagtgtctcgatttggatgataagctatctggccaccgtaacactggtgcttacagaaggtgaaagtataatgtaggccctcaattcagtagtgacttaaaaaattttactgttggtctgtgttaatgagaaactgtccttttttgagagggagcctccctctgttccccagggtggagtgcagtggtgcgatcttggctgactgcaacctccgcctcccaggttcaagtgattctcctgcttcagcttcccaagtagctgggattagaggcgcccaccaccacgcccggctaattttttttgtatttttagtagagatggggtttcaccgtgttggccaggctggtttcgaactcctgacctcaaaacgatccgcccgcctcagactcccacagtgctaggattacaggcatgagccgctgcacccggcctgagcaaggttttaaagtatggatggggttcgagcatggtgttttggggaactctgggtctgtgtaactgaaggttacatagggtgtctccacagggaaggggaaatggtggtggtgtggccactggcaggggccagcttgaaccttacatattctcctatgaaattagagctttatcttcttattgaaacttatcaggtggggtgtgggatgatcatgtcagtgtttggcaagatcatgctgttcacagcacggaggctggcttagttgggagcctgtcagagttagggatgctatggagagtagcaatcagcgagccatgtgtggtgaagagcagcgctctggtggtgtagagtggcattgcataggcaatcaagggatacttaggaagatgggtctctcgtaagacccgggggtcggttgggtgtggaaaacgagtgagcccgtgataatctagattgggggctctaagaagtttgtgggtggggggaaggtactgaatttaacttaaaaagagtttttagactgggcgcggtggctcatgcctgtaatcccagcactttgggaggccgaggcgggtggatcacttgagatcaggagttcgagaccagcctggccagcatggtgaaaccctgtctctactaaaaatacaaaaattagccaggtgtggtggcacgtgcctgtaatcccagctactcggaacgctgaggcaggagaatcacgtgaacccgagaggcagaggttgcagtgagccgagatcatgccactgcactgtagcctgggcaacagagcaagactccgtctcaaaaaaaaaaaaaaaaagatttttaaaagcagctttattgaggcatagttgacacataataaactgtacacacttaatattatgcaatatgtgagttttgacatgtatacacccatgaaaccatcaccacaatcaaggcaatgaacatgttcagaccccgaaaagtttccttgggcccttctgtaatccatcccttgagttttttttttttaaatgaatttttaatttaaaaaatgtatgtattggaatagagacggggtctcactgtgttgctgaggctggtctcgaattcctgtgatcctcctgcttcatcctctcacagtgctgggattacaggtgtaggccgctgtgcccagctgagttcactttttaacatctgtctgaggcggtcatgagacactgtagtggagccatctgggttgcataatgaatgtgctgtgagatgcacaagtagatagttctttccagaagctttgctgtgagagagaaacagcagttacggagaaggctcctgagcgggtctatagttatttatgttggaacaattctcaggtgatatgtgtgtgtgatctgaattcttcaatcacttgttacccataatactgtaagtttcccagcaagttctttccagttggatttggtagtttgaaaagaggtcctactgatggcttccgaaacataattttaattttagactagaatttgctgcctcctgaatatagattgtgtcttttgccttttcaataaatggtagtagctagaattcggttatttaactactaacacaatctttcttcttaaagaatggatgacaaaggagaagtgaagtgcattaagttttccttagaaaataagatattggctgttcagaggacctcaaagactgtggtaagacttatctttaaaatacagcattaaagggcattagaaatacatttggaagagaaggaatcgcaaattttcagtgttaaaggaaacttttattatcttactgttgtgaaaggtatagttatgttgcattgtattagagccttcaaaaacgaaaaagacatttgagtgggttaaaaaaatgaccttagtttgatttttaaattaaattaaaaatttttttttgagccagtcttcctttgttgcccaggctggagtgcagtgatgtgatctcggctcactgcagcctcgatctctcaggctcaagtgattctctcgcctcagtctcccttaaaaattgttaaaaaataatttggaacttcatgtgtcttttgtattgcttgatagcagcatagaatatgtgaggtatttttggctactttgtgaattagccttttcatctctcatttctgagtgctagatctgataggagcagatattccaagttgaagcagcctacaggcactttagcccgtgtaaatgttcaccattgccgtttgtagagtagagggaaggctgttagaaacaggcagaatcctctgttagtttcttccatcagttttaagtgttaaagtcttggggaagcctcttagtgcagcaacacatttctctgacatcagctgcttgaggaatgaatttttgaaaggagttactaaactgtaactgaatatttgtattaacttaaaaaaaattgaatcgtaagcctgctgctgttgagacagatgatccgaattggtctttttatctttcctgtgttttggttgtcttcagttattttctggtcactttttaagttaatatttatttttcttgtcttgtagtatgccaacgtaggttggcagtatgctgcctaatccaaatttgtgtgtgtctgtgtgtttttcctttcaggatttttgtaattttatccctgataattcccagctggaatacacacaggagtgcaaggtatgaccccaggccctttctcagctgctggtgtcagtggtgttgagctgggttatgtagtggagagcggggcatcggggtcgcagggagcacagacttgaagtcagactgtccctcatgttgattcccaaactggagtcaggcggggtgtttgctttgtgacactgaacagttttctaagtttgaaagcttgttcctttggagggggagggttcaatggatgatgcgtggtgaacacccagtagtgctagcccttggggctgtcgtctgtcttgccctttttctcctcactgggctgacagcacatctgggtctgggccctgggatgcctcacagccacctggagtggaggtttctggtgaggagtttctttttctgtttcctgaagtttcctttcctcaatttgttgtctttgtcttgtccttactctttctttcttctcctaggtgttgattctaatccacattaatgagatttgctgggtgtagtaaactaggctagagggagctgagctaaaattggcagtgtggcaccttgggcgctgacagaagctgctagtggttggggtagggctttctgcatttttgtgactgttttgctcaatggagttcagggcggactctttggtgaggagaggtgcatccccaccactgtcctgcctgccctgcagtggccccgtgtgaagagaccctcagcccggcccttctcaaacctgtctgccctcaagcgagtcgggtgtgtgtctcagggtcctcaacccattttagtcaacactcactaaagacccttaggcctttgtacatttttaataaccatttttataacgtgggtgactaagaatgttggcagtatggtgattcctgcaggtagaagctgctgtctgtgagctctggtcagttacttttctacaaaacacagacttctcctgttctgtttagtagaaggaattaggattcaggttcttgaatgaagagttatgggcaaaaatcagggaacattgtatttaaaagaaaatttgttttgttaattagtaaacattccggggaacgttcattaaagaatgacaaactgcagagtttgtgaagcttttgaagagagttatatgtgttttttcttattaattaaaaatatttttaaaaaatttttcttagactaagaatgccaacattctaggattctgctggactagttcaactgaaattgtcttcataacagatcaaggaatcgaattttaccaggtattatgtttatcatttatgtttgttggttaaagttcagtgatagcattctggcagccttttgaattcagtactgaatatatatatatatattttaaacattttctagagatggagtcttgctctgttgcccaggctgcagtgcagtggcaccatcatggctcactgtaatctcaaactcctgggctcaagcaatcctcctgcctcagtctcctgagtaggtgggactacaggcatgtaccaccatgcctggctaatttttctttttattattttattttattttattttatttttgagacggagtttcgctcttgttgcccaggctggtggagtgcaatggcgcgatctcggctcaccgcaacctccgcctcccaggttcaagcgattctcctgtctcagcctcgtgagtagatgggattacaggcatgcatcaccatgcccgggtaattttgtatttttagtagagacgggatttctccatgttgagactggtctcgaactcccgacctcaggtgatccacccgcctcggcctcccaaagtgctgggattacaggcgtgagccactgcgcccggccctggctaatttttaaacttttttgtagagacgaagtcttgctatgttgcccaggctggtgtcaaactcctaacctcaactcctgccttggccactcagctttagtctcttgctggggattttattctttttttttttttttataattgcaagtaataaattaaaaaaaaaaaaaagaaaagaaaaagggcttggtggcccatgcctgtaattccagctctttggaaggccaaggtgggtggatggcttgagtccaggagtctgagaccagccaggccaacatgatgaaatcccatctctataaaaaatacaaaatgttagtcaggcatggtggtgtgcgcctgtagtcccagctacttgggaggctgaagtgggaggattgcttgagcctgggaggcaggaggttgcagtgagccaagatcacagcactgcactccagcctggatgacagtgagaccccatctcaaaaaaaaaaacaaaaacacaacaacattaaaaagtgggcaaaggccaggtacagtggctcacacctgtaatcccagcactttgggagaccgaggtgggcagatcacctgaggtcaggagttcgagaccagcatggccaacatgacgaaaccctgtctctattaaaaatacaaaaattagccaggttggtggcaggcacctgtaatcccagctactagggaggctgaggccagggaattgcttgaacctggaaggcggagcttgtagtgagctgagatggtgccactgcactccagcctgggcaacagagcgagactccgtctcaaaaaaaaaaaagtgggcaaaggacatgagcagacactttttaaaagaagacacacatgcgaccaacaaacataaaagagctcaacatcactgatcattagagaaatgcaaatcaaaaccacaatgagaaactatctcacactagtcagcatagccattataaaaaagtcaaagaataacagatactggcaaggttgtggagaaaagggaacccttatgcactattgctgggagtgtaaattagttcaacctttgtggaaaacagtatggcgattcctcagagagctaaaagcagaactactgtttgacctagcagccccattactgggtgtaatatgcagaggaatataaattattctaccataaaggcacatgcacgtgaatgttcattgcagcactgttcacaatggcaaagacatggaatcatcctaaatgcccatcagtgacagattggataaagaaaatgtggtacatatataccatggaatactatgcagccataaaaatgaacaagatcatgtcttttgtgggaacatggatggagctggaggccatcatccttagcaaactaacacaggaacagaaaaccaaataccacatgttctcacttctaagtgggagctaaatgtaagttatgaatgcaaagaaggaaacaacagacacggggggctacttgagcaggggagggtgggaggagggagaggagcagaaaagataactattgggtactggacttaatacctgggtgatgaaataatctgtaccacaaaccccgtgacatgagtttacgtatgtaacaaaccttcacatctatccctgaacctaaaagttaaaacaaaaaacattcaaacattgcaagatatgtaatatggaaagcaaatgttccctataatcccgataaataattattatgaacagtttggtgcatattcctctatttttaaaaataaatacaaacttctttttaacaaaaaggggaatgttgtatataaacttttgcagctagctttttttttttttgtccaaagtgtatcttggacatctttctatattttattctgactgggtagtattccactgtatggatggactgcagtttaaaaattttcttgttattggacattggctggttttccatttttttgtgattacaaataacccttcagtaacatgcttgtacacacttctttatattagagggagagttgcagtataggtacgaacatctgaaaagctgaaccagtatcgccaaatttcttctagacatgtgtattttcactagcaatataggaacttctgcttttcatacctttaggaggactggatattatcagtctatagacatttgccaacctgagaggtagaaagacttttttttttttttttttttctgagacagagtctcactccgtcgcccaggctggagtgcaatggtgcgatctcggctcacggcaacctccacctcctgggttcaagcaattctcctgcctcagcctcccaagtagctgggtctacaggcgcccagcaccacgcctggctaatttttgtatttttagaagaggtggggtttcaccatgttggccaggctggtcttgaacccctggcctcaaataatccacctatctcggccccctaaagtgctgggattacaggcgtgagccaccatgcctggccgaaagacattttaatttgcattttacattactagggaagtaagcatcttttcatttgtatattgtccatttgtattttgttaacttcctcttaaaatttttttattttgtaataattattttgagacaggatctctgtcacccaggctggagtacagtggcacaatcacggctcactgcagcctcgacctcctagcctcacgtagtcctcccacctcagcttcctgagtagctggaactacaggtgtgtgccagcacgcccaacttaatttttttttcctttttttttttttgtagagatgaggtcttgctgtgttgcctagactggtcttgaactcctaggttcaagccattcttctgccttggcctcccagagtgctgggatttatgggcatgagccactgtgtgtggtcaaaaatattttttttactgtggtaaaaaaacatacaacatttattatcttaactgtttttaagtgttcagttcagtagtgttaagtatattcattcacattgttatgaaatagctccagaacttttttcatcttgtgaaaccaaaactatccagtaaacaactccccttatcccttccctgcagccccagcaatctctattttactttctgtttctatgaatttgactcctttttttttaagatggagtcttgctctgttgcccaggctggagtgcagtggcgtgatctcagctcactgcaacctctgtctcctgggttcaggcgattctcctgtctcagcttcctgaatagctgggattacaggtgtgcgccaccacgcctggctaatttttgtatttttggtagagatggggtttcaccatgttggccaagctggtcttgaactcctgacttcaggtgatccactcacctcagcctcccaaagtgctgggattacaggcgtgagccactgtgtccggccgaatttgattaccttttatacttcatataagtgaaattatacagtatttgtccctttgtgactggcttatttcatctaccataatttcctacaggttcccccatgccatagcatgtgatagggtttcctttttaagactgataataccgcactgagcgtatacaccacattttgcttatccattcatctgttgagggacatttgggttgcttctgcctcttggccattgtgaatagtgctgctgtcaatacaggtatgcagataccgcttcaagatcccgttttcagttcttttagatttatacccagagtgagattgctggagcagatggtagttctgtttctgaatattttagggaaccgctatactgttttccatagcagttacaccattttgcaatccctccaagtgtacaagggtcccagtttctccatatcctcaccaacacttgctgttttgttttgttttgtttttgatactagccatcttaattgtggttttgatttgcgctctttgttgattagtgatgttgagcacttttgtgtgtgtgttttggccactttgtgtatcatctttggagaaatgactaattcgggtcattgtgcctatttttaaaatcaaattactattatttgttgaattgtagttctttatatattctgatattaacaccttcttagagatacaatttgcaagtattttctccgaatccggaggttgcctttccactctgtggattgtgtcctttgatgtacctgcctgtttcttttcatctgttccagcttcctgacctattaagcatgcttctgagatctctaaggggaactaatttagagggtgttaagagttctttcaggttttaattttgttgacctaatgaaagtcatataatttagaatgtatggttagagaaaatacacctgtgtgttaatgccatggtgctttgctgtaaggccatcatcgaaatcttagtaatgactggctgggcacggtggctcatgcctgtaatcctagcactttgggaggccgaggtgggcgatcatctgaggtcaggagttcgagaccagcctggccgccatggcgaaaccccgtctctattaaactccatctttactaagtgccgtctctactgtctcaaaataaaaatacaaaaattagctgggtgtggtggtgggcgcctataatcccagttacttgggaggctgaggcagaagaatcccttgaacgtgggaggtggaggttgcggtgagccgagattgtgccactgcactccagcctgggcaacaagagtgaaactccgtctcaaaaaaaaaaaaaatttgtaatgaccaataggagaactttaaacaaactttagacaaattccatacacacagaaatagaattttgtacatgtgattgcatgggaaggatggcttgctttctgggggagttccctatggtaatcatttaaaagtctgtctttctgttctctgcagtgggaaagtataccttaaggttacctagatggcttcagatcttcaagaaaaaagttaaaaagaaagaagactctagcacatcctaattattatagttcttaagaagcttacggctcctgcccctgacttgcgcagcagttcttcagtgcagtgtaccatgagcattaatgtcttgggggctctgtacagtgttctgtaatatcggaatatttagggtacattgaaaatgtgcctggattataaagtactgcatttgtatggagtcttatgaacacatctgctagaagaagggagctcctcccaggcccagtgtagactggagtcgaggtggaggccaagcagaaggcagatctgccatggtctgggaggtggccgagttaacacatggggtcctggaggtgtcagtttcttttggccgtttcctggatgaggagaaatttgttgtaaattgctcttaggtgtatccatgtgctccacatgcccaggcatgtggaggcacagataaggattttggagggaaacagcctacccaggctataattgctttgttaaggggcaggttccctaatccactcttggagccttgtttctcatctggctaatagggccagtgatgcctgcctctcagtcgtggcaaagagtaaatgagttaggaggctctgtaaagcaccaagcatagggctggttaagtagtagctgtaataagtacaagtgagaatgttcatttcacttagtgggtttcttctgctttttattctcagagcgcactgtaaggatcttctgacagtttgctgttattgatttatttattaattgagactgaatctcgctctgtcactcacgctggagtgtgatggtgcaatcttgactcactgcaacctctgcctcctgggttcattcaagcaattcttgtgcctcagccttctgagtagctggaattacaggcatgtgccaccacgcctggctaatttttgtatttttagtagagatggggttttaccattttgtccaggctggtctcgaactcctgacctcaggtgatccgcccaccttagcctcccaaagtgctgggattagtttgccgttttttaaatgaagatcctgtttcttaaactctgcttcaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggtaagaggaagcctcccctgaaaaaaacacctttccccagttgtcccctgttcctgtagcatcctaatgtgtcaggcacgttagggacaggttcctctagccgtaacgtcaccgctctgaccactagagggcactctgtatacccgtcagctcctggagccattcattctatgctgggcagacaggctgtgagaggacatgggggacggtggaaaggatccaaagacgaagtctgtgtttatccttgttggttttacacagggaatgatgaaacattgaaggggtttaataagcttttcctaaaacattttccccctaaacaggctggcactatgtcgaagctgcccaaatttgagattgaattaccagctgcgcctaagtcaactaaacccagcctttccgaaagagacatcgcaatggctaccatgtatgtccgtgtcagagagaattccatcctgtgattgctttcagtaatataaataatagaaggagtgtgttacaagcaccacgtgatgccctgacccctagaacacataaggaggactccccttgttctgggtattcagtgtataggtcctgtgaacatagaaaacctgcagtgtttttggcattcctttttgatttttatcagctttgtgatgctaaggaattcctttacctttctagcctgataaaacaagaacattgaaccaatttatttcttagtatctttgttttagaatttcttcttctttttttttttttttcgagacagagtcttgttctgtcccctaggctggagtgcagtggtgcagtgtcggctcactgcagcctccacctcccaggctcaaacgattcttctgcttcagcctcccaagtagctgggattacaagtgtgcgtcacctcgcccggctagtctttgtatttttggtagagacagggcttcaccatgttggccaggctggtctcgaactcctgacctcaagtgatccacctgccttggcttcccaaagtgctgggattacaggcatgagccactgtgcctggccaagtttattttttttaaaagctcagttaaataataattgttctaaataagaaaatagattaagattttatgtaacagacatggaactaaattacgtatatatagaggtatattttcttttactttttttttttgtttgtttttgtgatggagtcttgctctgttgccaggctggagtacagtggcacgatcttggctcactgcaacctccgcctcccaggttcaagcgattctcctgcctcagcctcccgagtagctgggactacaggtgcgtgccaccatgcccaactaatttttgtatttttagtagagacagggtttcaccatgttggccagggtggtctcggtctcttgacctcttgatctgccctcctcagcctcccaaagtgttgggattacaggcgtgagccaccacgcctggcagtacggaggtatattttcatttgaaaaagtggatatctcagtttttaagtttgtaatgaaaattttaaacacacaatagagactaataaaaaagaacccctgtatgcctgtatctgattcgacaatagtcaaaattttgcttctaagttacttctgattcttctgtggcctaaaacagtggcccaaactttcaaactttatggtagttagtataatgttctttcatttcttcttcctttttttttaaacgtactcttctgtggcattcctgtttatttttaaattttttttggagagtgtcgctctgttgcccaggctggagtgcagtgttacaatctcagctcaccacaacctccgccttctaggttcaagtgattttcctgccacagtctcccaagtagctgggactacaggcgcatgccaccacatctggataatttttgtattttctgaagagatggagtttcaccatgttgcccaggctggtcttgaactcctgggctcgggtgatcctcccgcctcatcctcccaaagtgctgggtttataggcatgagccgccgtgcccagccagcattcctgtttagacaatagataaagtgagagcagtcctggctgaagtggaggtggggacctgttccctcccaccttggtctcctccttgtccctgggcaggcccagcacagagtttaccactggactagaatatgcattcaggaactgttcacagcaacatttattagatggcacttaaatagaaaaggctgagcatggtggcacacacctgtaataccagtgactggggaggccaaggcagggggatcgccttgaggccaggagttcaagaccagcccgggcaacatagtgagaccctgtttctacaaaaaaatttaaaaattagccaggcacggtggcacgtgcatgtagtcctagctactggggaggctgaggtgagggaagatcgccaaagcctaggaggtggaggttgcagtgagctgtggttgcaccactgcattccagcctgggtgacagagggagaccctgtctctgaaaaatgaaaaaaaaaaatagtgattatattttcctgttattaaggaatatacattcattatacaaaacttggaaaacagagaagaaaatgaacttagcatatcactcaagtataactattacatgtgtttctttccaatcattttagactctatgcttaggtttggggttttcttttaaaatattatgatcaagctgtgtttagtgtgtgttctcttttccacttaactttataataggctttgagtaactgcatgtttctttgtaaacacttgttggcagcaaaatactccattaagtgaatatcttataatttacttaaccgtgatgccatttagaacaaaggaattttgaatggccagatgtgatttatgtctgtttgttccctaattagatacgggcagctgtatgttctcttcttgaggcatcattctcggacctccaacagcacaggagcggaggtggtcctctatcatctaccacggtagatttcatgctttgttttccctctctctctgattttaaaatgtgaactgcagcttgttgatctgttttttgctttctatcctacagagaaggtgcctgtaaaaagatgcacatattgaagttaaataggacgggaaagtttgccctgaacgtggtggacaacctggtagtcgtgcatcatcaggatacagaggtacaagctgtctgcgtttctaccaaagttaaggttgcttaaaagccttgtgaaaattggtggctgggcacggtggatcacgcctgtaatcccagcactttgggaggccaaggcggacagattgcttgagcccaggagttcgagaccagcctgagcagcatggcaaaaccccacctatataaaaaatacaaaaattagccgggcgtggtagtgcacgcctatagtcccagctacttgtggggctaaggctggaggatggcttgagcccaggaggtcggggcttcagtgagtggagatcgcgccactgcactccagcctgggtgatggagcaagatcctgtctccgaaaaaaaaaaaaaattggcaaaatgtctgaataagactagaaagtgcatttttatgctaagagttttggtcttccagatggaaatgggtttggtagtcttaagtagtttagaaaaaagtgattgtgtcagttgattaaagataattcaaaactatttcagaaactaacgcttgagatttgaccttggaagaaggtgggaatccgctccattccacgagtacttgaactctctgttgcaattgtgagcatggatgacagtgctgggggataatggttttgaggccgtgtggaccaggacaactagaatgggtcctgtgggctgggcctctgatataaagaagctgcttccctcctctaccctcccagagggtggtgacgctaactctgtgacacgtgaggatgtttccagttgaaatgacagagatctgcttaggtcactttgagtgagctcatcaaaggaagcatgtcataaatgcaggaaatacttgtgagaggagataaaaatattaaaagagagttgtgatgttaatgacaaattccttctcaagtaagagctagcctgtagggaggaaatgcaaacacaggcttttaaactgatttaaacagcaagatgggatggaatgaaagcaactgggcaaaccatgattgattttggcctcagtcttgtctttttcccccccagacatcggtaatattcgatatcaagttacggggagagtttgacggctccgttaccttccaccaccccgtgcttcctgctcgatcgatccagccctatcagatccccatcacaggtaacacgggttctgtagaggagtctgtgctgccctttcaccatgtggctgtgttctcaccatgatctttgggagtcacgttaaaagtggagtgaggaataaacagagattcccagatctgtctgattttgccaggggccatttgttccagttttgttgttgttttgagacagtctcactgagtcacccaggctggtaggtagtgtcgtgatcttggctcactacaatctccacctcctgggttcaagtgattatcctgcctcagcctcccaagtagtggggattacaggtgtgtgccaccgtgcccagctaatttttatatttttttaaatttatttttttgacagagcctcactttgttgcccaggctggagtgcagtggcatgatctcggctcactgcaacctccacctgtctgtcacaaggttcaagcttgtgaggtattcaagcaattgaaccaagtattcaatcgcttaaatacttgtgagaggagataaggttcaagtgattctcctgcctcagcctcccaagtagctgggattacaggcgtgcaccaccacgcccagctaatttttttgtatttttagtagagatggggtttcaccatgttggccaggctggtcttgaacttctggcctcaagtgatctgcccaccttggcctctcaaagtggtgggattacaggcatgagccaccacgcctggcccaaatttttatatttttggtagagatgggatttcaccatgttggccagactggtcttgaactcctgacctcaggtgatccgcctgcctcgctctcccaaagtgctaggattacaagtgtgagccaccatgcccagcctgttctagttttttaaaaaatgcaactactactgatcctataagctaaaattatgttgtgaaaaaagcattttctaagatagatgaatctcccttgggaggaaatagaataatttatcttccctgagctttagaatggatagttttgattagccgttgatggtgaaatatgttttaatattgaatacacccgtaacgttttctgtttgccttagctctgtaacgctgaaattaactttggctgtaggtttgttactgtaacctgggatcacttttctctttctcacattccgtgtgacagtgatgatgaatattgcattctttgggactgacagtcacagtaagtgcttcggctgtggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctctttttttttttttccttaaacagaactttattttctcacagttctggaggctagaagttcaagatcaagatgtctgcaggtttgctttcttctgaggcctccctcctggcaggcctctttgcagatggccaccttctcactgtgttctcacagggtctttcttctgtgcctgtccctcgcagcagtctctcccggctctcttttgaaggagattggagtgcagaattggctagtctgaggtttcagtgtgcaagacgtagtcagatggctcacatttggaaccctggtagtaatgttttattctttgtccgatggcattgggcgggttgacccagcctgcagtcaggatttccttgtaccgttcacccgggagttcagaatcgcactctggctgaaagttcagcaagagcaccattgtcagcctgactgccctgtcttgctggaccagccaaaagcttagttactttctggcacagttggaggaaggagctggttcttaacagacgttcaattaggtcttttggctttctgtgttctttcaagcttcttccttttcctttgtaaataatgttagtattgaaagaatagattttgccaagtgattgtcttgtgtctgctgcccacttggcatgaaggtaactgctggtgaattgggggaaaaaaactaaacatttagaacaagcctgtccaacccacggtctgtgggccacatgtggcccaggacagctttgaatgcagcccaacacaaattcttaaactttcttaaaacattatgagatttttttaatgatattttttaagctcatcagctattgttagtgttagtgtattttatgtgtggcccaagaccattcttcttcttcctcttaaggcccagggaagccaaaacattggacacccctggcttagaaccttcagctctgttccggtggtacaggaccagttaggaggcatcaggttctaaccatctggtcataagggaacagatgcgaggcctggtcacagtaacagcccgtgcagagatcaataggaggaaatcaggaatccactgagggtctggggatctaggtagtgtgggctgcaaagcattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttagaacagtgggtctcaatctgactacatattaggatcatctggggggccttaaaaatgaaagctctcacctgacagtgtgtaggtcagccacccaaaggtgagggctgtgcactcggcgcagaccttgacacttaggtccaaagcgcgagtgctcttcgccaaagcttgtctgcctgggctctttcctacctttgggtggtctgttcacaatgaccctttctctgaccagctgattgaaacctgccttctgattgtacctgggtaattggaacagaaccaggagtcatggttagcttgtagggctgcctgcatggctcatgagcagtataactggttgttaacggtccctgtcatgtgaggttttgggggtctgcttcccagacgagctcactgtgcttggacctactctatgcaatggataatcgaactaattatttagataattaagtggctgggcacagtggctcatgcctgtaatcgcagcatgttgggaggctgaggtgggcagatcacttaagcccaggagttggagaccagcctaggtaacatagaccttgtcttcacaaaaaaaaaaaaaaaaaaaaaaaaaagaaaaaaagttagggcatggtcacatgcctgtagtcctagctactctgaaggctgaggcaggaggaccacttgagccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgttagctccttcccccttcctccccgtacgtgctttcagtgagacggaacagttcatttcttccttgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactaaggtgtggcaccgtgcacaacagggcaagtggtcaccctcagagagtggtcctgaagtcctcctccgggcagctgtgaataacactccgagagccaccccgcaggcagcttccctgactgtccaggggcctcgcgtttagcgtggactcagtacatggtgggcaggggcgagtgctagcggaaactgggtttgctttttgttttcatcttttcctggtttagaatttcctataacatgtggattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatacgttttttactatatgtgcattttatcaagaacatatactacttttaataattaaagcaacaactaagaatgccattctcctgcttaagcccattctggaaaagccagactccaccccagggtggatggaaagccggactccaccccagggtgtctccctcatttctcccatcgaccttcccaccggtgtccgtgcccttttctgttctgcatgagcccgggaggtgtgctcctctttctggccttgctgaggaagcctcctcagtctgttaattgtctcttcctgggtaatttctttattagagaaatcttttttttttttttttttttttttgagacggagttttgctcgttgcccaggctggagtgcaatggcgtgatcttggctcactgcaacctccgcctcccgggttcaagcgattctcctgcctcagcctcctgaatagctgggattacaggcatgtgccaccacgcccagctaattttgtatttttagtagagacgaggtttttccatgttggtcaggctggtctcaaactcccaacctcaggtgatccgcctgcctcggcctcccaaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcctacaggcgcacatcaccacgcccagttaatttattataataataataataattattttgagacggaatctcgctttgtcaccaggctggagtgcagtggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgatgctgtaggcatccactgtatgtaatgcattgttgtgccttgtctgtaacccatagcctcatgtgacatccactgtatgtatgtaatgaagtcatttctctcctgtgcatctcgctggtgttttcctgtacagctgctctgtacctgccttgggccaactgaaaagggggtcacccagatgattttttatgtggcacttcattctcctgtggcatcccaattgggaaaggccacaccagatgctggcagtgtgggtgatcagtacatttatgggtcgatgaatggatgagttatgatgttccattgagagcctctggagttaccttttaaactaatgagctgttgtaggagaaaccaaagcacaggactgaagttgatgccacgtgttgacatctttttctattttaaacgttaaaagaggggctaggtctagggaagtccccgtttggaatgaaggactaggagctacacctttgatgtgcccctgaatgcagaggttacttggaaaagagtcagccaggtgtgcggtggttgggctgtcatcctcctgtggtagacacgctcctgaattgctcctgaatggctcagctctgctttggttaggaaggaaaagctacactgactgtactttgcggctttttatcaccacctgccacccgccccgcagatgtttaggggaaccacttttgggcttttgttacggtttgcatcatactgttttatttgctgcctcttaaaatccaggttacctctggaacctccaagtgaaacttgagcccatagtaaatctcttaccagacaaaggaagactcatggactttctcctccagagaaaggaatgcaagatggtcatcctgtctgtctgttcacagagtaagttgaatccttcccccttgctctgattccagtgtgaggcctgtgctgcccaacactttttatcgggatgtgggctacattgttgtgtcttgtctgtgacccacagcctcattctttatgtgaggggtggctatgtgaccccctaggaaaggctgctaaatggaaagatgatttgtagagatactggtagaaaagaacaataaatgggatggttctgaatgaaagtgggcacacaggaggggagtgggccaccacccctggccttcacacacacctctttcaaaatccaagccactcactgcatatgtgtcttctttaagaatcccctactgaggccaggcatggtggctcatgcttataatcccagcactctgggaggctgaagcaggaggattgcctgagcctaggagttcgagaccagcctggacgacaacatggcaaaaccctgtctctacaaaaaaaaaaaaaaaaaaaaaaaaaaaattagctgagtttggtggtatacacctgtggccccagctactccagaggctgccgagggaggattccttgagcccgggaggacgaggctgcagcgagccgtttgtgtcagtgtacctccagcctgggcgacagagcaagaccctgtatccaaaaaaaaataataataataatcccctaccaatatgtgctgttggtgtttgtttttgttttggtatagatggggtcttgccttgttgcccaggctggtctcaaactcccagcgttaagtgatccttctgcctcggcctacccaaagtgctgggattataggcatgtgccactgagcctggcctgctatagcttttttttttttttttttttttaaccgtaaccagaaaggggttgcgaatgacatctagctgtcaggtctttaaagtattgtatttcttagagtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgagcagagttatgcgatggtgagttacatggagtatgacaaagggtcctcctcccccaccccctcccgggtattttctaagtaattatgatgcaaaattgtttcctatatattagaataaggtcgctgagatttgccgcctgccatagggcaaggtggcagtagtgggggatagtggaggagtagtaaattcagggtccctgcatcccacgagctggcggctgcatctcacttcataccttcactgtttttgtttttcccatctgtgtttgatcttgcctgtagatccttggtctactgttatagatgagaaaaatcagtctctgctttgcaatattttgtatatttttctgttatgccagagtgaggacttagaaaattaaattagaaatatttatatttgccacacctttcttcccttttgggaaagaatcctgttgagatagtgacgattcagtgttagcacttagcaggcgtgtttgtagtcaaggtaataaccatggcttatcgccaccaattcccgctgtattacttgtacatcatatcttctgaagccagaagaaaagtttaggacaaggagaatgaattatttcaattccaggatctgattagtcctaggctgaaaatggttttaaaccaacaaaagccccagaactccactcccctttagctgttcatggaagggtaagaggtctgagacaggcactgaagagggccagttgctgggacagtgtccattcctacgctgccagacgtgagggatggctgagtccttttggactctattgctgtgggtgttctgggctgtgggaatcagtaggtctgatcccaaatggcagtttctgtgccgtcccacacggtctgctgggctccataaaccgtcatgactcagcagtgtgggccactgaccagccacatgagcagcatctggagtttcttggaaatgcaagttctcaggctacaccccacagctattgcataatctgcacggatctgaactgcttttttttttttgagacggagttttgttcttattgcccaggctggagtgcaatggtgagatcttggctcaccgcaacctctgcctcctgggttcaagggattctcctgcctcagcctcctgagtagctgggattacaggcatgcgcacaggaaaaagttgtatctaagtagagaaagtgttttccgctcatatcctgggtccacatcgaagaattcagtccttgtggatgaactgtaaacagcacccttcctctaagatgccgaagatcatagtttgtggtttttttctttcaggcggtggaagcagggcagagccgaagcagcccgctcctcaagaggccggtgcggacccaggcggtgctggaccagtcagatgtgtacacccatgtcctgtcagccttcgtggaaaagaaggtgggccgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatgtgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacaggtaccttcaaatcatctgggcccaagttaaaacagaaggaatttaaaaaaaaaacacagtcactgtcttagaagatgactcatatgctaagacaggtctgcctccctgactcagaatgctgagtgactcctgacattattagttggaatgggaagtgtaaggtcaagttggggtctttacctgcatgacgaaaccacttcttgtaatgacagacttttactgtgttggttagaatagccagtccttggggagcctctagtctgttgtagctgaatgatttggaagtgttctttcactttttacttttgtcctcagcattacctacatgaacttgttatcaaaacccttgtccagcacaacctcttttatatgctgcatcagttcctgcagtaccacgtcctcagcgactccaaacctttggtatgcattgccagatttttacttccattgtggttaaaaatggaaaattttaaccgttatctttccaactgaagtgggtctaaaaatgtctttcaggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggtgagaatgcaatgaaaagacttggggtaaccatagcctcaaagagtagcagagggcactggcagctggtgggcgaggaccctgggttagcatttttgtaaacaacacaatttgataacagcccacctagcccttggcccattatttgtagtagagtgaattcagtatactgacagaatctgaattatgctctggaactcaccgaggaggtgtgttttgagtcaagacacatttaggacccagatcaggcacagcccatctcttatagcagatcttggaatatctcttaaagccaggaataagacggcaaatggtggctaagggttttaaagggtctggggcttattaaggtttcagttttatgaagtatacattggttgatcattctcattttttttttgagacagagtctcgctccgttgcccaggctggagtgcagtggtgtgatctcggttcactgcaacctccgctgggttcaagcgattcttctgcctcagcctcctgagtagttgggactacaggtgcgtgccaccacacccggctgatttttgtatttttagtagagatggggttttactatattgtccaggctggtctcaaactcctgacctcatgatccgcctgcctcagcctcccaaagtgctgggattacaggtttgagccaccgcacctggccctggttgatcattctcatctccaaatagttatacaacctaagacatcatctttaggatagggaaggatcagggctgtctaatgaaacttctaggtctatttctagctcaatgtaagacggcatttagttaccataaggacaggttagatagaatctcttccatttagcttttgtatttgtctctcaaagcagatagggtaaccccaaaacttaggaaaacaatgtattttattaaagaaaaataagttaaaacccagtagacacacctacgagatgctttctttgtccctcatttcatgccacatctaactggcaattaaatctcttcctttctaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctcaactgtcactaaaaatatggtatagaacttgtgggatggcttactcctaaaaggagagacagacagtgcattgattggcctttacagagtgtcagtgagcggatcacattcacagccatctagtgtcacctcctgcttgccaaagaatgaggtttctttcctgaagaggctgggagaagtttagtgtcctgtggttgcctccagatctagtaatactgcttcccaagtcaactgtgcattcctgagttcacaggcgctacgttcaaagctgctgccaaacaaccgatggttggcaccatccggtgttcaacttggccttgccgatgcagcacccgtccagtggtaaaccgaccgacccttagacacagttcagtcaggatgccctgcgagagggctagaaatttagaagccgttcgcgctctgttcctttgtatcgctcttcagtggcacaacttttggctttatttactgatggccctatgagagagagagactttttcttatttctgcaggagaaagggagctagttggctgggcatagtggctcacgcctgtaatcccactttggaagactgaggcaggagaattgcttgagaccagcctggacaacagagtgagaccacatctctctccctctcttttggagatgggctctttgctttcttcctcaggctgcagtgcagtggtatgaacacgactcactgcatcctaagcccacccttctgggctcaagcaagcttcctgcctcagcctaacaagtaggtgggactgcagacgcacaccacttcacctggctaattttatttttgtagagatggaggcctcactatgttgcctaggctggtctcaaacgattctcctgtctcagccttccaaagtgctcatctcttttttttttttttttttcttaaaaggaactagtatattagattgtaatagaactactttctatcccccggagatgataaaaagcccctcattttcttaatcttctacttcagtgcttcaatttagtgacaaagctataaatgaagcaaatcagtattgttctttcaaccgtgggtcatttttgtgcaaggtgaagtggccatagaagtaaaaggatcaaggacagtctcgagatgaagaaaggcagcaagcactttgctaagaaacgggaaatccatgagggacataaaaagctgttctgcagcactgctggtgtgagagctggctgccagatggactccttcatctcagtggcagggaggagctgccctgcctgctgacactcagatccattcaaggactggctccaggcctttgtgaagcagacagatcaggcctccagaaaaaacatcgacaacttcctaataaagtagtctgcaccatcatgaatcccctggatgggttttttcttttagaagaaatttttttactcagtatcatttatcattatcaaatgaccattagtatgagttcaaatacttgaaaagaatgcctcaggatagaattccctttcagtaatgtccttctattgtgccacccttttaagatgagaactcttacctatgtaactgagtaagacagggagaaatattaatccgtgagtggctcccagtaagaccatggccaaatacatcctgaagtagaatatctggaaaatttgagatttggcaaaagccaacaccacaatccctccaaattttgtaagtgtgattccactgaacacctaaaagaagagatactgtgttagaaaccacttttaccaacctgtaattgaacaaaaacacttccttacaaggatttctcccaggttcaagtgattctcctgccccagcctcctgagtagctgggattaaacaggtgcacgccaccatgcctggctaatttttgtgtttttagtagagatggggtttcaccatgttggccatggtctcgaacccctggccgcaagtggtccgccagccttggcctcccaaagtgc

SEQ ID NO: 12718 - DNA, 16871 bp, Human
agccaagcactgagcaaaaatgtcccccaaaggggtgtcagcattcaacagtctcacatctcctagggaatcagtcattcaggagggtcttactgaaagctctcatgtttccccaaaagtagtgaaggatcccaaggtcaccctctcttccaagcaatgctgccccactttgaacatcaggcagaaacttccctgttccttaaggtacggagaaatggtgggtaaggtgttggggaggaggccagtcctgtgtttctggtactgtcatgtatccggtctccaacctcaaaagatgtgctgattctctctcccccaagcctccctgggtcatgcccacctcctggagtccccagctttgcctttgcctgccaacttgcctcttggttcagctctatttgggagcagagagtccccataggcccctaagggtgaagccctgtcaggctgggacagaaatgtagagctggggccagttcccaggggagaactggggaggactggggtgaaggtagagagaggagaagttaaactttaacatgacaaaaatattaaagtatttttcaaagtactcttaaaaatgtaaatctttatctatatactgatatgcaaaatattccatgacaccttgtggagtgaaaaaaaagtacacattataaagcagcatgtgtagtgtttatataaattatatatttgtgcatgtgtgcaaaagacagagacagagagtatataaggagtgaggtctcagagggtgttcactgaaatgttaatcctgtttggctttagggggtggaatttggggtgatttatacagtctcgtttttacttttctgtgctgcttaaatttcctatataagtatgtttcatctttatacacaggaaaactcccaatgatgctattttcaattggggggggggaaacggatagttttcatcataaaaggagtctaatacattagttaacataaaaggaaaatggagaaagaaaagcctccatcgtcctatctccgaggcagcccttcagagcatgtggtgggtttccttcctgtcagccggctctgaatctgttcaaagcagcttttccatccaggtataataatagattggaaagtgctgcacacgtacaccctctcatgtaaggcttgcagcccccctgaaaagtagatctgtttatttcccccagtctatggatgaggcacgtgaggttgactttcaggcaaggaaaatgacttgcctgggtcacatatacctggcaggcagagccagacctgggactctcagcactggcagcccaatgctacttccagtgcccatgactgccatgcagggtaggggagcttttgtgggccctgccaggcccagctcagggccctgcaaacccctggctgctgctgatgcagtgcgctttaaggaacatttcctgttgtccatcaggttccaggtctgcccccagggctagagctacaagatgcagccaactcagcacatgtggacctctggtggggagaaagagggcaacccgaaaggtcacttagcacagagtctgggcacacagtaggtatcaataaagatcgattgaatgttcatggtcaaagttgcttctagtgtgcccgtgctccgagcctctgagtgccaggagaatgcccagcgagtcccacttgggccatctcggaaggcttcctgtaggagagggcctttgagctgagacttcaaagctgggctgaatttccccgagggtccagaagagagccacgggctggtgtgtcaggcagcggagctgacactcccagaaagcaagatcttcgaactacagggtgcgcgcaggctctcgcttctctccaccatggggggccctgcagtactcgccaagagcgtagaatttgcctagtattagccacgagagggcggggtggggcgaggcggagcagggccgaggtggcggagtgggggggagccggagagcttcataaagccacagcaaagcgctgcgactctagtgacagcggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggtgagtgcggcgcgccggcccttggggcctctgtgcccgcgccggaacaagaacgtctcgtctgtttttctggctcgacaatgcttctgactccgtgtccctcactgctttggcttcagcgtagggagacaggggaatggggttgttaggaggacagggaaagctccggaggggcgtctgtgcccaggctgttgcaccaacagccagaggactcacaagggagacgggtgagtgcgggacagtgagaagtcaccttgatttaggggaagggtgactgtggcttcacctagaattggtgtgcgcccctgccccactctctactgtagaggagtcgcagcgggcagtgaaagcctgtgctctgggcggacaggacgcctgggcctcctgtgtgggaaactggaggggaagggagccccttatctccgggccccctgcgcccacctcccccggctcctttgctgctggtgtgctcaggtcagctttagtggtggtagtggtggtggtagcggtggtggtggtgtgtgtgtacggggggagattgggatttggtgacatggagaagcagtcgccaagtttcctttccggtcttactttgagatcatatgtctggtgtgtgtgtgtgtgtgtgtgtgtgtgtgtgtgtgtgtgtgtgtgtgtgtatgtgtgtgtgggtgtgtgtgtatgggggctagtgcagtaaagcttgtagggggcacagatcccttccaggcacaaatgcccacgggctgggcagatgaagctcacccaggggtccagcctggtagccagccccacactgcaccctttgaggctggtccagtgaaaaccttccccacactcctgtccagaaattcaccggttcagcctggagaagtggggaaggggtgtcccatggcttcatggctcagggttcctgagccccgtgcgtgatggggagagtttggggctgagggtgctgcttccggatagagcctcctgcgcaaggaaagaaacagaaacctgtgacttgtgtggtatttgtttagtaagcaacccccggagtggactgtgtctgatgtgggctgtgcgcacccacccttcccagtgcggcccatgtgagcaggggaccagcgaggaccagtgtggaagggctgttgtcattggtggacctgggatgctgggtcccaggtccgagaggtgtggataccaaacgtggggcttggggtggaggggagagggagaaggccatgttggaccccagaggttggtattcgatctgggcattgctggaacattcttccctccagatgatttttgtggggtagcctgggactggggaacctgttgccagccacaactggcttcaagttactgagctgttccactttccctgggatgaacccaggaaagttggcgtgttctttgatggctcagccttcatctcttaagccttctgataatttctctctgctccccccaaccctagtcaccctttgggtgtacccagacacagcccaagcttctggtcccaatgtgtctgaattggaagggacccagaagatcctgtccctctcactgcacagacagggaaacaggcccagagatagcaagagactcttccaaggtcacacaacacactcattgcaggcagagctggcactacagcccagatagtatttgcttgggtttctttctctggccccctacggccaccagtaaaaacagccacccacgctctctgaaggccctgatgcattcagagtgctttcacttccattatttcactgtgcgttaggtaggccaagcagtctccccattttacagttgaggtcactgagttgcagggtcagctaggggcttgcactccatcacacagcagaccagaagtggggcctcttaaccttccactctgttgtgtggtcaggaggacttcccaccctgggcccttgctggggtctccccacagcctctgccaggcctctgcctcctcctgccagtcttgagggatggggtggatggagcatcagccagcactctagggagttggccagtgctagggggctgcctctctgcctgtagagccagcttcagggaggctgtagagcacttcagggaggcacttgaggggatgattctcgaagtgtgtatcaccatctctactcccatggcctcctttccttggtgttcctgctgagtaattctcacttgacaagtttttttgtcccccttttagatacatacacttacatttttttattatgaaaaattccactacatacaaacatggacagaagaatgtaacagacttccatccccagcttccacagttgtcaatatgggtccaatcttgtttctgcatcctcacttcgcttcttctgtctgcaactatattagtaatatagtaattactaagtacattctagatattattttatctctgcacctctaaaaatgactttttaaaatgaatgcattaccattagcaaacctgaaaagaatttcctaaatatcaccaagcttctctgattgcttcataaatgtgtgtgtgtgtgtgttttccaatcctcacactttttgctccattctgaggggctccatacgcggggtccctgttgaaggaggcagtggctcttcactgtttcttttggtgctttttcttggatcaggcttcatagaccccacgctgccatggaggggacagaggacacacaaccccaattcagtcccactagccccaggttacctccataccttctcagcttgggctcctgagatctgggaaatcagtggccatttcctctcaaaacaggcttttgggcttatagcacagcttcctttccgtcttcctgcttttgtgggctggcctatccctccgtgggttccagtgacccaccagtcacaccacatcacccatgaccttcttcctttttgaaaggttctcccacctcaggcccacctacagcctacagccccacggctttttgccttgagctgactcacgccgtcccggattcttcctctcccacccaccctggatctatccctcggtattgaccagcgccagtggcatgctcttcccaacgggcagaaatggggcagggcacagggggtgattcctgggtctggagattgatcaaggcagctcagatggggctgagagaggggaactgagaacaaaacggtggattatcccagtaggagactttggtgtctacgtttgtgtctggagatttggggcagcctgataatgccccacacaggcttgtgcgagggtttctgtgtggcagtgtgtgtgtgttgcgaatgtgttggcgagtatataatagttgatggtagacattctcagtagaggaagagagaggcctgtgtctctgtgggtgtgtgggtgtgtattaattgctggcaatccccactttctgggtgtgattggttgattattataattaagataactttgggtagctgtgttgtgttaagctcaatctgcatttggatttgtgcatgtgaagacagaggttggtaaaacaacaatttcagtcccacactatccttgctatcctcacagtcattacaatttttttttgtctccactttcccaactccaagaactttaatttttttatttgtaatatttttcatgggccaggaagtggacttgaacctcccacatagataactttagtcgataactttctacatctttttttttttttgagatggagtctcactctgtcccccaggctggagtgcagtggctcaatcttggctcactgcaacctgcacctcccaggttcaagtgattctcctgcctcagcctcccaagtagctgggattacaggcagaagccaccaagcccagctaatttatgtatttttagtagagacggggtttcgccatgttggccaggctggtcccaaacacctgacttcaagtgatcccccgcctcggcctctcaaagtgctgggattacaggtgtgagccaccgcacctggcccaacttttcagatcttaaaaaattttttttaatttattttttatggagacagaatattactgtgttgcccaggcggtctcaaatccctgatctcaagcaatctcccgcctcagcctcccaaagtgctgggattacaggcatgagccattgtgcccagctaaaaacattttttttaggcttaagcatgcttaactggtttcatttgtcttggggcaagtgaaaacaactttaattaaaaattttttttaaatgagacatggtcttgctctgtcacccacgctggagtgcagtggtgcgattatggctcactgcagcctcaacctgctgggctcaagcaatcctcccatcccagcctcctgagaaactgggactataggcgcacatcaccatgtccggctaattgtttctattttttgtagagatggggtctcactatgttgcccaggctgcagctttgctttttgtctggctgtttgccagtggctgtctgagtctattaagtggatctgaggttggtaagacgaggagttcccttgatgcccaagcacattttgtactttggtaggtacgacacattgccagaataccctcccaaaaggtgctaccaatttacgcccacaccaatagtctatgagaggacccattttctcacagcctcatcagcagtagatattatcacattttttttttttttgagacaaagtctcgttctgttgcccaggctgaagtgcagtggcatgatctctgctcaccgcaacctccgcctcccaggttcaagcgattctcccacctcagcctcccaagtagctgggattaccggcatgcaccaccacgcctggctaatttttgtatttttaatagagatggggtttcaccatgttacccaggctggtctcaaactcctgacctcaggtgatccacctgcctcggcctcccaaagtgctgggattacaggcgtgagccaccacgccgggccaatattatcaatttttaaacattgaccaatatgactgagaagaactatctatctccttgctattttaatttgcacttaattacagtgaagcagagcctgtgccaggagctccgaatctgggagaggtatgacgaccctgtgaaccatcccaaggctacttagttcttagggccagcagaggaatttggggtcttggaccctgtcttatgagggtgggatggtaagtggcctttagggacgctcaatttgacaccagacccatcaccactctcggttccttcccagcaaagtgtcatgtaaatcaggggctattttgggattccagctggtggtgattctagacttttagggagaaaccgagatctcctttctcttctcccttttccccagcctcttcctgtgtctccatttccctctactagtgataaaaacaggatgagctgggcatggtggtgagcacctataaccccgctcgggtgactcgggaggccaaggcaggaggattgcctgtgcccaggcatttgagcagagcctgtgcagcatagcagactccatctcttaaaaaaaaatcagtatggcctgggcgcggtggctcacccctgtaatcccagcactttgggaggtcgaggccagtggatcacctgaggtcaggagttcgagaccagcttgattaacatggtgaaaccccgtctctactaaaagtacaaaaattagccaggtgtggtggcgggcgcctgtagtcccagctactcgggaggctgaggcaggagaataatggcgtgaaccttggaggcggagcttgcagtgagccaagatcacaccactgcactacagcctgggcaacagagcgagactccgtctcaaaaaaaaaaaaaaaattagccaggcgcagtgttgggtgcctgtagtcaaggagaatctcttgaacctgggaggcagaggttgcagtgagccgagatcacaccactgcactccagcctgggggacagagcgagactctgtctaaaaaaaaagaaagaaaaaaatgaatatgaagaaatggggaccacagagcacagcatgcactctgcagtcagaagacctcacctctgctctcccaccgaggaccgtcaccaaacctctcggagcgtcagtttcttcaaatataaaattggaaataacattttattttttattttttctttgagatggagtctcacactgttgcccaggctggagtgcagtggcgccatctcgggtcaccgcaaccttcgcctcccaggttcaagcgattctccttgcctcagcctccaaagtagctgggactacaggtgcatgccaccacaccaggctaattttctgtatttttagtagatatggggtttcactatgttggccaggctggtctcgaactcctgagctcaggaaatccaccctcctcggcctcacaaagtgctgggattacgagtgtgagccactgtgctgggccatctttcgaactttttaacagctttcagaggaaagatggacaggagttagactctccatttacatgtgaagaaactgagatttgggctgggtgcagtggcccatgtctataatcccagcactttggaaacctgaggcgggtagaccacttgaggtcaggagttcgagaccagcttggccaacgtgaaactccatctctactaaaaatacaaaaattagccgggtatggtggcacatgcctgtagtcccagctcttgggaggctgaggcaggagaatcacttgaacctggaaggtggaggttagagtgagctgagatcacgccactgcactccagcctgcatgacagagcgaaactccatttcaaaaagaaactgagatttggcttgagaattaacttatccagggtcatagggtagtaatctatttttctcaactcaggaaagtcaggggaagacaggcgtgtgacagcacccttctaggacaccttcccaaggttgttaggtaagttgtcctggggacctctggggattagaagtccctcaaaaacagttcctaggcccctggaaccctccctcctccaggtttcctgactcagataggtccctttttcctcatccttcagggcttctcatgagaggagggggaagtgtgtggaaatgaaaaataattctgatgaggattagcttctgccattctgaaaactctgctcttcctgcttgtgttagaagagaaaggctaagccattggagctggtgatggaattggtgctggtggaggtggtggttgtagtgacggtactactggtggtggttgtgacggtgaaggtggtggctgtagatggtggtgcccgtgctggtgctggtggagatcgtggttatcgtgatggtggagggggcagttgtagtgacggtggttgtgatggtggtgatgggtggttacagtgctactggtggtgatggtgctggttgtagtggtggtggtgacggggctagtgaaggtgttagtggtggagatggtgatggtagaagagtgcttcttttctgaatctgttactctggcacaacagcggaatcatacagcatcccaccccctaacttcctctacttttcctggaaacaaggactttgaacatgagccccgtgttcaatagagccttctttcaggtggatgggaagctccctgttcaactaggatgtgtgcaacttctctaaaggctgagggcagactataccgcaggtggcagacccaggagcatgggagagggagggcctgtgagtgggtgtcatgggtctgggagtgtgttagcactgtgagagccacggcagagagggtggctgaggaactgaggcgtgaggaccttccaggaactgcctgtggagagctggtggtgccccctcctaggaagcagctaaggttagagacaggggtgtgcaggtagatgtcgagcaactgaccctctgaaagaacattttaaaaaactctgatttgtagtgtttgctgatccctgtggtgtaaatactcctgctatggatgatttcaagcgactcatgtgagtcattgaacacagagccgggaagagactcacagtgcactgtgatttagtacctcctccatgcagctgcgatagacggaagtaacctcgacagtgcagacaatagtaaaacgtaaaataactgggcagtgatgattttttagtttttactccttttttttttttttgagatggagacttgctcttgtcatccaggctggagggcagtggcgcgatctcagctcactgtaacctctgcctcctgggttcaagccattctcctgcctcagcctcctgagtagctaggattacaggcgcccacgaccacacccagctatttttgttgttgttgttgtactttttagtagagacggggtttcgccatgttggccaggctggtctcgaactcctgacctcaggtgatccgcccgccttggcctctcaaagtgctgggattacaggcatgagccactgtgccgggcctactttgactgttaatatgtcttgaattgcaagtttatataatttaatttttaattatggctgtgtttaaccactggctggcaaactccctaaacaccttccagctggttcttgtgagtgggaggaagccggctacagcacaccactgatgcctgggcactgttgcaggggggactggctgtcaagctggagctgatgggtgctgggggctttctctcttctctccaggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggtgcgcgcgcccctgggagcggtgggctctgtttcgctgggactgggcgccccctggtgggcccaccaagcccctacccctaattcctagacctttaaccccctcccactccatcccacgccattgcatccctcctgtttctggcttcctgctttgctctagcctgtcctctgctgagtcctctgcccttccctgcctggtcctccccctgtgtccttccttacgtccctctcgggacaggcaaagccctacatcaccagggttctgtcccgggggctgcatgtcaaagaggtgaactgtccacaggaaaccgcctgtacgtccacccggactcccccaacacaggagcgcactggatgcgccaggaagtttcatttgggaaactaaagctcacaaacaacaagggggcgtccaacaatgtgacccaggtaggacctgctcttcaaaaggtagcctcgccctgctccccaccctgggtctgagacctccaaggccacaagggtcctgcggggccagtttggttcattttttcttccttcctacaggaaggaaggttcgtttttcttctgtcctaaacgaagggtcatttttcctccttcctaaactctggctgtttctcacccaccttgggaggaagatgagatgggatgaagctgaatcttggacgggggtcatattcaggccacacaggccaacccagcctcagggtttcttcaccaaatcatgggttgccattgctccggcaccatgaaaggcacagagttggccctgtggtcccagggaatagatgccgagtttctctaggttgaacaatcctgttaaaagtgcccttgctggctgggtgtggtggctcacacccataatcccagcactttgggaggccaaggcgggtggatcacaaggtcaggagttcaagaccagcctggccaagatgatgaaaccccgtctctactaaaaatacaaaaattagccaagcatggtggcgggtgcctgtaatcccagctactcaagaggcggaggcaggagaatcgcttgaacccgggaggcagaggttacagtgagctgagatcatgccattgcactccagcctgggtgacagagtgagactccgtctcaaaaaaaaaaaaaaaagaaaaaagaaaaaagaaaaaaaagtgcccttgccctaaagccctgtttgtgctgataccttggtctcaattgacatctggaggtagaagagggggcaagaggctagaattggtgccccaaagagtccggacactggagttggaaagcttgggggaagttacatggtggcagagcaggggaatggacaggatgacctcaaggtgcttgctagcctcacgtggggccagctgttggtgggggtgatgggatcctcgaaatccttcctccccacccctacaaccgtcttgctctgtctacagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgaggtgagggctgcctgagccccggtggggaggagggcagagtggggcccactgtcttccttgggagggatttggaaagttcccgagccccagactcaggactcaggtgactctatttcccttctctctagattactcagctgaaaattgataataacccctttgccaaaggattccgggagaactttgagtcgtaagtgccactgggttcaactcagctttggtccctcctgagacacatcctctccctgcccctgaaaacaggagggtgggggacagatgctacaggtgggcaggccagggaaggagggtcggagaaggaatgtgtgaaacaggtaggctcacaggtgactggttctgcttgtgacccgttttcttgccttctatttttttctagcatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagatgcttcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcagcccgccagggtcagggaaaggactcacctgactttggacagctggcctgggctccccctgctcaaacacagtggggatcagagaaaaggggctggaaaggggggaatggcccacatctcaagaagcaagatattgtttgtggtggttgtgtgtgggtgtgtgttttttctttttctttctttttattttttttgaatgggggaggctatttattgtactgagagtggtgtctggatatattccttttgtcttcatcactttctgaaaataaacataaaactgttgaatgtgcctgcctcagtgccagcatggggggacatggatggggactcagttggggttgtacccaagctggtgtacccaaggtgttctgtcagctttcatttatggggaacctgctaagaccctgaaatgactccagctgagttacagcaaggccacatgtcctaccttcagcactcagggggttggttgatgctacctcttaaggcatcttgggacggacagagaagaatcccttgccctgtgtgcaccctgacattgaaaggaggggtgtgagggcaaggccaagggctggactgggagcgggggtgcagggcgctgtgaggcggtggcacttgatttttctttgcatttctagcagccctccacctttatctctagggttattcaaggattaaagaaataaatataaaatgagccatgtgaaattaccatttttgtaggtcgaaaagccaaatattagcaattttatgtgactcaagctaatacatgtaaagggtttaagaacattgcctgacaaacagtaagcactcactgtgtaagctactgttaccaacagtttctagctgtttctgtctgtctttttatacacactgaattgtgtttgtaaaataatacatacttttttttttttttttgagacagagttttgctcttgttgcccaggctggaatgcaatggtgcgatctcagctcactgaaaccttcgcctcccaggttcaagtgattctcctgcctcaccctcctgagtagctgggattacagatgtgcaccaccatgcctggctaatttttgtatttttagtagagacggtgtttcgccatattggccaggctggtctcgaactcctgacgtcaggtgatctacccaccttggcttcccaaagtgctgggattacaggcgtgcgtcaccacactcagcctatacatgcttcttttaaataattcaagcaaggaagaaaagtataaagacaacaataaattatctcaaatcttacccatcaagaattatcattaacattaggtgggttagacagaaatagttttataaattggaaccatactgaaaaggctttttcttaatgaaaatggttaaattttagcttatagaatttagtcacacacacacacacacacacacacacacacatcaagacaagcaaaacctctcaaactctcaagtgaaatgaagggagttgctaaacttaagataaatttttcttcactacaagaaatattttcttggttttttttttttttgagacagagtctcgctctgttgcccaggctggagtgcagtggcacgatctcagctcactgcaacctccacctcctgggttcaagcagttctcctgcctcagcctcccgagtagctgagactacaggcgtgtgccaccacgcccggctttttttgtgtttttggtagagacggggttttcaccatattagccaggatggtctcgatctcttgacctcgtgatctgtctgcctcggcctcccaaagtgctaggattataggcgtgagccaccgtgcccaggcaagaaatagtttctaaaagaacactctcaggctaagacaggtgcttataggaaacattaagaagttagagttactatgttgccccaccacagtccagggtgcaccccattctaatggggaaacatcatcatgggctttgggtagttctcccagttctgtttaaggtctggaaaacctgttttttttttttttttttttttggtcacagttcacatcccatccttttttgctctctactcagaggcaccttctagttagaaggaaaaaatacggtggcatacttggctccctttcctttgaatttggaatctcataattttgtaaatgacaggagatctgccacattgtgctctgtgagttcagattatttgtccccctactcctaccccgtggctgtcactttctaaagttaatgggttgggtctatttcctttcttggaggaactgtggttgataattataat

SEQ ID NO: 12719 - DNA, 20560 bp, Human
  misc_feature (1)...(20560): n = A,T,C or G
ggaagagtcatcatgatttgatacatggagatagagaaaaccacagtgtcagggctcccaaaaaaaaaaatcacttccattttgggaggtaatttcagcttctttgtatttgatttggggcagtatataagtcttgggaaaaaaagaagtgactaaagcttttattttagatgaggaggacttaatgaatttgtaaaatatgctcccttttgtggggagaagtacagcagtttgcacgttgggagaacagctggctccaatacagcttggtggtgggcttcgactgaactggtcatcgcctaagtattttgtgtatttctgattacctatctctccaggagcccacgtgagcaagacaggtcttcaagctggttcaatgctcccattctgtaggcaactacaaactgtggctcactgcatgacttaacaacaactgattgagaattgtaaagtgcagcctcgagttcatgtgtagaaactgccatctgcacaaacaaaacattgagaggactaagattttaaggatactaatgcagacgtccttcttgcttcatttatttaaaaatatccatttcacgttcctaacagcatctagtagatgtttcttgcttcttccccctaacgccggactaaagagaaaaaaaaaataggctgttttctggtctggttttgttttcctagtcaagtacttaaattacgggtgtttcgtaagtatcttttgatggatttcattgttttgtttatttcgcgttagacaatacagacaccttcatatttccttctgtagcaaatctttttcaaagtcttcatttgacgtggctgatggagctggtctgcagatcttgcagacgtgttaatttttgcacggactttagcttcaacacacaaaacttacggcctctttgaggaaccaatttttcaggctaagagaacaaatgaaagtgttcgctcatctttcgaaaactatttatgtacttggtatccggaatgtgacattggttttacacgtcggtaggtttttgtcctaaatttctgggaagttacttcctcatctaacgttttattttcctgacttattcgtctttgatatgctacagaaaacccctctcgcccagtggctgttttctctctgtctcttaagataatttaggaacagaagccttgacttttgacggtcatttagttttattctcctcccgtgactcccctctgtacactcacaggggaggccgccggcatctgggctgaaagaacccttggcgggcgaggagagcagggtgtcatgttggcgacaggctcctgctggcggccagcgagcccgccaggttaacgggggcgccggggtcagcgccctcgaagttgggggcctcgggcggggccgccggggagccacgacggccgctcgaccagagcatcccgcagtcccgttccctccagaggggaagaatggccgaatctggcacgatcccacggagatctcgctcttcccagcgcagtctccgctactgagcgcgggaccaacgcaggcgatgccgggcggccgacagggaaagcccagacctggggcagagaaggaatgaggggccgccagccggggggatttcctcccgctcttccctctccaacgggagcggaaaatgtgatttgctgtgcattccaggcgcggttccctggggtgacctctcccagccggcccgggcggggggagcagacaaagaggcgaggcgggcggagaggggaccccgcggggaagcaggaggggtgcggggggcgggggcagtaccgggaaagggggcggatagcgggtctggcggcggcgcggcgcctggccaatggagaggcgcggccccgggcgccgcgctctgccgccggcatttaaacgggagacggcgcgatgcctggcactcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacaggtgagcgcggacgcacccggcagggatgtgagtgggcggagggaagagggccgcaaaccaacccaggacccgctcagttccacgcgcggcagccctccgtgcgcgcaggctcgggtgcgttgttcgcgggggtgaattgtgaagaaccatcgcggggtccttcctgctgaggccgcggacaccgtgacctcgctgctctgggtctgcagggaaacgtaggaaaaaaagttgtcaggagcgggcaggatgacccccacatcccgtttccacctcccggaggcccccgaacacgctcctggtgctggtggcagcagcgcctggcagacgcgcccgcttagcgagggcgcgaagtccaggccgccagagcgcaggagcatccggacctgctagtcggccgctgactgcgcggcgagttgccttgagagggtcccatgtgcttggggcgccgcgctgggtctgggggcgtcttggggcgcccattggagtccgcgggttggagcatccggagaatccatgatgtgtgcatttgccgatccccgaggtgagatggagactggcaagggcagagccgctgtgttcagccacagcggaaaaccgaacggtgggtaatccgacagctgcggtgcggggcgcggccctggccgcggggtccagcgaacccgcagtgctcacaaggcagacaccacacgcgctcgcggaccggccacgcactcgcgggcgctcgcttctctactccagcctcttccccgccccgcgcacgcccgggctgaatggtagacgttctggcgccgggcagcggccaccggctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccacagcttgcggagcaaggccatagcaggggagtgggaggtatattggggctgtcacctccttgctggccggagttatttgtagactacagactccggaagaacagacgcgccaccgctctcgcttggcattgccttcggatcgcagctcctccttgggggtgccccagcttggcgtttatttgcctgcgccaggctctggcgacggtcaccgggccaggcggggagggacggacggcaggtgaccagcctctgctgtgaagaaattcctgcgcgcccggagctgtccctaatgcattcccgggtcgaatccgtctactgccttcccctcctcgaccgactccgaatctcggctcttatagacagaaatacagcctcagcgttaggggttaaaatccccctcttaaacggtccgagggcagagaggtgaccaccgataggtaattggatctcctgctggaaagagcaaatctgagcggtgtgcgcgtctgtttatgttccccttcgagatggtgccaggacacgaactgattaaaacaatctattgtgttaagtgggtcactagggttttaagctgtcccagggaccccagagtagtggcttccttctggctgtacacacaagttaaataaatagcgtagaagaggttaagataaccccattctagggtgaggagtcctctttcatccctagggcttccccctccccttttctctttttttggaaggagggggagcatgagagtcttgagggggggatgtacttttcaaagcaaggagggaaagatcttaagaaaactatatattctcactgccccccaagccaagtctataacagtaggtgatttgattactatctctggataaatggcactgtcaaattgttaatattaactatttcagggatttttagcagggtagtggcagtatgtgtgcgtgtgtgtgtgtgtgtctgtgtgtgtgtgtttaacctccaggtcattgtaggaattagagtcttttgtaaactttgtaatttcacaggtttcctattttcttaaaagttcatttttagtgaaatgttttggtaacccacgctctgtaggaaatccaggttggctaatgcggtctttatgtgagtagttacacagggaaggataaaaaccttttatgtcctacatctctgaatgagggctgcctaccctgtctttgaaactaagccgaagatgccttcagtctgaatggtcaagtattaaaagtgataaaatgcaaagaaatttcatgccgcagacacctcccccaagaactgcttgttgacagcaaagctgtggaacatgttccacaacagagagtaaaggacagccaggaaatataaaccttttatgtaaaggaaaggcaggtgggggacagtggttaggggaggtgactgcagcctctaaccaaaaggcaaccatcaggcaagtgctaccagcccgtgtcttcgatctgcaaggaattttctttagttttaacatatgctcttagaaattcaaagtacaacaggaattcctgggacaagagaaatctttttattcacatgtgaacatgaagatacaaaatagataattattttatttatagcactcttcaaattgtattgcattagaaaacatatccattgacccactgttaaggacagcactgggtgtcaataggacagtggttaaggacctgtgtttggggctagatagaattgggtttaaactgctggctgggctgggcacagtggctcacaccggtaatcccagcactttgggaggccaaggaggacggatcacctgaggtcgggagttcgacaccagcctgaccaacatggaaaaatcccgtctctactaaaaacacaaaattagccaggcatggtggtgcatgcctgcaatcccagctacttgggaggctgaggcaggagaattgcttgaaaccgggaggcggaggttgtggtgagcccagatagcgccattgcattccagcctgggcaacacgagtgaaaactccgtcaaaaaaacaaaacaaaacaaacaaacaaaaaaatgctggctttcccacttatgagctgtgtgaccttggacaaatttccaacttttctgagtgtagattccctgattggtaaaaggaagatgatattatctacctcatattttgttatgaaaaataaatgataaaattgggtcagaaatcagcataatgcctggcacagtaagggcttcaaaataaaaggtagctcttattattagtaatggtgttaggaaaagtagcaatgttatacagaaccaggatatatcacagggcagttctgaaattaaatcctgaatcctggccgggtgaggtggctcacgcttgtaatcctaagcactttcggagactgaggcaggcggatcacgaggtcaggagtttgagaccagcctggccaacacactgaaatcccgtctctactaaaaatacaaaaattagctgggtgtggtggcaggcgcctataatctcagctacttgggaggctgaggcaggagaatcacttgagcccaggaggcggaggttgcagtgagctgatatcgtgccagtgcactccagcctgggtgacatctcttaaaaaaaaaaatcctgaataccacactacgcagtgactaacacatctttcactacagaacagaacctgtaacttggccgtctctcagcagtgctgctcagtgaacatttaataatttattactttctaactcgtttcttgttgacctcaagaattgtacatagtcattaactttcctaagaaaatctttgacaaacatagagctcctgagatatttcacaaccaggtggtctcctccctgtcctatgcaatgttgggccccagcctgatttagccgacctggtcttcagacttgagaggctgtttagggttcttacaacacaaaggggatgagactttatcctctacctgtgtgccaacaagggattcttcttatctccttggtgcaacttgtctgaaaaagaaagtcaacacaattatcttcttaaaagttaaagatcaaattaaaaataagctatagttttcccaaagatttagacctgagaaaaaggaatagatctttctaaaacctggcctgcacttagagcatttgtagtcacttccactatttcttatgctgagagaataatttgatgtcatgcctattgaatgtctttctaaagcttgattcatcaggaggaactgaccagaagtccatgcacagacatttggctttcactgtaattcctactcaaaactccctttcactgattatgagcaggttgcttagctaaaatgagaaatacagcaagaagagggatggaaagagctggcttaaactttcccaaagacatcatgaacactgggaacaggtcatacatataccatttttatttctcagtcctcagtattagaatattgtgttcctagaggctttgtgaaaattggaatacattgccatgacctgcacaggatagaggtggttaatatggcttaccttgcttgtagatgtttactcttgatccctaagggaaactggaaggaaagcatgctgtagagaggacctgctttgagagtatgtgtcctctgggacaagtggaatgaaagagaggatagaggcaaagagaaaaaaaggtggagatggggtgagacttgctggtggacagttgcaaagaaaactcatgatgagaataacatcacatttcttgaagaagctgaactgcattgatgggaagttgaggcagagtttgaaaagaagatatactgtctgcaaaaaagaatcaacggagatgtcaggtatcttgatgcaccctgagtctatgagatgcagcttaatttaatttaatgatatgagtaggccatttcataagtggtggaaattaccataaagtgtttgcagctaatgacggcgcatgaatgatgtcataggaacctaagtctggatgagctatggattgaatttttactatgggacacccttctacatgttgctgtggaaaagaattgtcctcaagaaatgtacatcttctgcatttcctctacatctctgatatttacaaagtgcacattatttggtgatactacaactgggatttcaagtgcacatcactactatttccttcactgaagaatcaagagcagtctgggggtggggagagcttgagtgattgacaaggatgtggcagagccctggttccactatgaattatagttcttaccctgcttactgtcactcatgtagagcagctagtgtgcctcagagcactgctgttctctgagaagctgaggtctcgattgacattcttgaagttggtgtttacttctctctgaataaacaaaggttggcaactcagacatcttacaataagtactaaagatttttgaagaataggtttttaaaaaatgaaaaaacatttcactttccatagctaataaatcttattttgaggaaaatgtacttttctttaaaaaaaaaaaaaagcctgtctgtcactctagaccctttggcttagaaggtaggcacactcacatagaaacagaaagtctgtccaaattaaaactgaaaaccacagttgactaattttgaatttatagctctgctgttggcttctgcgatagtattaatttcaatggcttcaattagaaaatgaaacccatagcattccatatgagaacaggtaaaaagtcagggacatttggagttttccaagaaaaagaaagacaagtcttaggaagctctctaggatggaaggaatttgccacactgagagttagacatccaaaggatagcaattggctcttctgctcatgggcactggtgaaggcattttaaaatgcgaagaatggtacctctgtaaatcaatgaggttcataataatcatgcatttaccaaatttttataagcacctgccttgtgccaggcactgagggtaaggtgatgaataagccctcatcaactgtcagactagatatttactcaataacagatgtgaaaatgccaagaaggaaaagttgagtataaagaaagccttaagttggttcagagaaataaaattgcatttttcggatagatgtttatggaatcggccttatgaggtaaacttgtcctatgcagtgaacatacattcccagttagtctcagattggcctctgtgatgacaaactcagagggtcctggtctaggaggggtgaatttgtctggaggccattttcaggaggtatggaggaagactggggcataggcctggggccatcccatgtactcctcctctgaaatggggagcaactgaattgtgttttattttagatcttcgtccaacttgaataccagaaattcgtgaaaccttctcaaattcacactatattttgagaccaggagaaggctccttgagaaattgccacactgtcttatcctagtctctggaaaaattcagtcctgtattataactgggcgtttctcataagtgctttttttttttctttttctttttataatactttaagttctgggatacatgtgcagaatgtgcaggtttgttacataggtatacacgtgccatggtggtttgctgcacccatcaacccatcatctacattaggtatttctcctaatgctaccccttccctagccccccacccctcgacaggccccagtgtttgatgttcccctccctgtgtccatgtgttctcattgttcaactcccacttatgagtgagagcatgcggtgtttggttttctgttcctgtgttagtttgctgagaatgatggtttttggcttcatccacgtccctgcaaaggacatgaactcatcctttttatggctgcatagtattccatggtgtatatgtgccacatttgctttatccagtctatcattgatgagcacttgggttggctccaagtctttgctattatgactagtactgcgataaacatgtgtatatgtgtctttatattagaatgatttataatcctttaggtctatacccagtaataggattcctgggtcaaatggtatttctggttctagatccttgaggaattgccacactgtcttccacaacggttgaactaatttacactcccaccaacagtgtaaaagcattcctatttctccacatcctctccaacatctgttgtttcctgactctttaatgacggccattctaactggcgtgaaatggtatctcattgtggttttgatttgcatttctctaatgaccaccgatgatgagctttttctcatatgtttgctggccccataaatgtcttcttttgagaaatgtctgttcatatcctttgcccactttttgatggggttgtttgcttttttcttgtaaatttgtttgagttcctggtagattctggatattagccctttgtcagatggatagactgcaaaaattttctcccattctgtaggttgcctgttcactctgatggtagtttcttttgccatgcagaagctgtttagtttaattagatccaatttgtcagttttggcttttgttgccattgcttttggtgttttagtcatgaagtctttgcccatgcctatgtcctgaattgtattgccctggttttcttctaggatttttatggttttaggtcttacatttaagtctttaatccatcttgaattaatttttgtataaggtgtaaggaaagggtccagtttcagttttctgcgtatggctagccagttttcccaacgttatttattaaatagggaatcctttccccattgcttgtttttgtcaggtttgtcaaagatcagacggttgtagatgtgtggtgttatttctgaggcctctgttctgttccattggtctgtatatctgctttgataccagtaccgtgctgttttggttactgtagccttgtagtacagtttgaagtcaggtagcgtgatgctttgttctttttgcttaggattgtcttggctatatgggctcttttttggttctatatgaaatttaaagtagttttttcatagacatctatagaactctccaccccaaatcaacagaatatacattcttctcagtatcgcatcgcacttattctaaaatgaccacataattagaagtaaaacactcctcagcaaatgcaaaaaacagaaatcctaacagtctgtcagaccccagtgcaatcaaattagaactcaggattaagaaacttactgaaaaccacacaactgcatggaaactgaacaacctgctcctgaatgactactgggtaaataacaaaattaaggcagaaataaataggttctttgaaagaaatgagaacaaagacacaatataccagaatctctgggacacagctaaagcagtgtttagagggaaattgatagcactaaatgcccacaggagaaagcgggacagatctaaaatcgacaccctaatatcacaattaaaagaactagagaaacaagagcaaacaaattcaaaagctagcagaagacaagaaataactaagatcagagcagaactgaaggagatagagacacaaaaaacccttcaaaaaatcaatgaacccaggagctgttttttttttttttttgaaaagattaatgaaatagactgctagccaaactaataaaggagaaaagagagaagaatcaaatagacaatagacacaataaaaagtgataaaggggatatcaccactgatcccacagaaatacaaactaccatcagagaatactataaacacctctacgcaaataaactagaaaattgggaagaaatggatacattcctgaacgcatacaccctcccaagactaaaccaggaagaagttgaatccctgaatagaccaatagcaagttctgaaattgaggcagtaattagtagcctaccaaccaaaaaaagcccaggaccagacagattcacagccgaagtctaccagaggtacaaagaggagctagtaccattccttctgaaactattccaaacaatagaaaaagaaggactcctccctaactcattttatgaggccagcatcatcctgataccaaaacctggcagagacacaacataaaaaaggaaattcaggccaatatccctgatgaacattgatgtgaaaatcctcaataaaatactggcagcacatcaaaaagcttacctgccatgatcaagttggcttcatccctgggatgcaaggctggttcaacatacgcaaatcaataaacgtaatcaatcacatacacagaaccaatgacaaaaaccacatgattatctcaatagatgcagaaaaggccttcgataaaattcaacaccccttcaatgctaagaactctcaataaactaggtattgatgaaacatatctcaaaataataagagttatttatgacaaacccacagccagtatcatactgaatgggcaaaagctggaagcattccctttgaaaaccgccacaaggatgacttctctcaccactcctattcaacatactattggaagttctggccagggcaagcaggcaagacaaataaataaagggtattcaaataggaagagaggaagtcaaattgtctctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataatagacaaacagccaaatcatgagtgaactcccattcacaagtgctacaaagaataaaatacctaggaatccaacttacaagggatgtgaaggacctcttcaaggagaactacagaccactgctcaaggtaataagagaggacacaaacaaatggaaaaacattccatgctcatggataggaagaatcaatattatgaaaatggccatactgcccaaaacaatttatagattcaatgccatccccatcaagctaccactgacttccttcacagaattagaaaaaaactactttaaatttcatatggaactgaaaaaagagccggtatagccaagacgatcctaagcaaaaagaaaaaagctggaagcatcatgctacctgacttcaaactatactacaaggctacagtaacaaaaacagcatggtatagtataagtgcttttttttaaaagacaaagtaaagtaatttttttgttgttggggtaaaacaaaagctctgcataaagagcagggatgttgtaacatacactgaccaaaggtgggaaacctacagttggagcagaagctgaatgtcacattatcagctccgaacttataatggtctaaaagtactaggttaatgttggaaagatggtgccatttaaagatatcttaaattcaatatttaattattttaatttgacattatcctagagttgaatggtgtttacttaccatgtgctgttcattagaaaatctagatcctacactgcctttgcgcaaggtagttgctctaataataccaacctgtccagttttggtgggagaaataatgttactgttaagttgcacttagtggttattatgtgtaatactggtattccaaagagagaaggaaaatgtttgctacacagctgtgttcttaggttcagaaaaccacaggagtgggacaggagaaccttcaggattcaggtccgattgttgtgatggccgcaggagggagactgtgaatttgaaactgcatccattgaaaagaaaatccctccacactttaataattctctccgtgccccatggcagcaagtgcttataggccttgctactcaaagcttaataaaaaaggcagacctgctgaatcataatctgcatcttaacaatatnnnnnnnnnnnnnnnnnnnntttttttttctttctttctttcttcttttttttgagacagagtctcgctcagtcacccaggctggagtgcagtggcgcgatctcggctcactgcaagctctgactcccgggttcacgccattctcctgccttagactcccgagtagctggcactacaggcgcccgccactacgcccggctaatttttttgtatttttagtagagatggggtttcaccgtgttagccaggatggtctcgatctcctgacctcgtgatccgccgcccatctgggcctcccaaagtgctgggattacaggcgtgagccactgcgcccggccaattgtctgcactttcaagtctaagaagcactgtcccaggaggaaaatctttttagtctgtctgaggcttctctcttgcactctcctttttaaaaatatgctgctccttctccacctttccctcttcttccgccttttctgtctgcctttactacctcccctgaacattcaacttgtagaagagttcccctttctctgaattgcattcttcacttcattcattcttttctctctctgtctatggtttcctattttttgtcggttttccctcacctcacctccttgttattttttgccattgttcacatatcactgccctttcagacccatatctagcttctgacccatccactaatccattgccactaatttattcagcatgcccatgccatttattaatgtaaatatttgcacatacttgttctatcatgcccatttttctaccttttaaattgtatatacacagacacatgtgaatgacatatttcactatttaaaaggtagaaaaatgtatatcgtggtacaaagtgatacattgagtatctgtgcccagtttcaagatgagaataagtgagaggtgaagcctcatgagtcacgtcacctacacgctactgtctttcattccatctgcagtactgccacacatttggttagttctccaattgctgtcacattgacatcgagttggatctgaacagcgtacctggggagacgaagtattggtatctttgcttaaatggagtgatttactgagagacaaagtgacatctttaagatcagatagcaagttactgcaccaggagcgcgacctttcctgttttgttgttttccctctgtcaaatgccttctggtctccatgaatctctccttccacatatgataaaaatgcaaagtctcataagcattcacagctcaggaagcctcaggctagttggggagaaaagactgggaggtttccggaggaatgaagtcctctgagcagagaggttaattcatcttgctgtaaaacaaaatagaaaataagttcccctcaataagtgaacgtaatacaaagacaaatgtggttggtgccagaggccaggaagaagttcttgtgagaataggtgcagagaagagctaggccctggctgagtttaaaccttgacttagtcactgtgggactctgggtgagttactccatggattgatggctgggtcatggagataatagtacctaattcatacaggtactgtgagaagtaaatggaatatttcacgttaagtgtttaacggtgcgtttaaatgctaggtgctattattattaatttttaaattaactttgccatgttttgtgtcttcccctctctgtgcttcctttctttagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtgtgtgtgagcgtgcgtttgtgtttggtagtgttcctagggcagaggtggagcagggatgcacttatcatgggaagggaggtagaaaagagaattggatagcctgtgatctttggtggaatttattccttttgcctaggcctttcagaccctgcttgatttccgtaggacacttcaggttgtggcaagggagagctggtctgcaatcggaagtaccagcctcttccctagagcacaactagaaagaagaactatagagtgttataagggaggccctgagatggaaggaccatcacacagaaatgataataacttcatttcagggtgttccaggggaaaagcaggagaaagatttggggctcagtagaaggaaaagcttcctagtgataagagtgattggcaataccatgaggtacctttaaaagatagtgaactcctgtccttggaaatattaaaccacaggctagatatcatttaatagggatgtgaagtagagtaagtcactgcccttggtgtgcaattgtgaacttgtcaatttctgaggtccctttctacttagatatataatacaagatttctattaggtatgggtgctctgatgataatgaaaatcccagcagctatgtatgggatggttacaccagacactgtgctaaggattttctttgaattgtttctcactcaatcttcacggtagctcagtgaggtaggtaccattatcactgctagaaagcagtgaacttatatggtcttactgtggcactgggtccttaaacattatgcaaaactgtgagcaacttttatcggtttgttcttttaagaacataacacagcactctaaaaatagatctaactagattgttcacatctagcgattaaggccaccctgagattatagctgcatcatcaggaacccaagatctgaagcattcagtcaaagcctcttggccacctctctttttgtcatggccttcttggacttggagggggagaatggaagcaagtaccaaggagaaagtgttctcagaaaagccacacccattagaaaaatacaaggcctgaaaggtgtgagtgggacttgacacggaagagcatttcaagcttaagaaaaaaaaaaaaaagaagaatgtgggaggatgtcagcaacaatgcttgagattccctggtcccccaaagagtctctcctccataaaactaatgagaatgtgacaaaaatagattcaacttcttatagctctggaaattaactgaagatgtatagcaatttgcagagcatttattcaagaaaaagactaaatctctgtgagcactgtgatattgtaacttgcactactctcatctccccctctccagctccacaatagctttgaaaccaacagcctgcaattaccatgaaaatcagcagtctggcagccactgaaggtgacagaatggagttggagttctttcaaagtcccattcctagacaattgtcactatttgacctgtttggcaggccctggaagctccacttgcaaggctatatttgacctgactggaagcttcccagggtaaaaaactttgtcaaaacaactagaggcaattgattctctttgtggctgcctggggtaatgtataacagttggggaaagcaattggctaaataaaaagcctaaaaggagaagctggaaaaagagattttcatagggactttgaaaagctccaaagtgttattggcaatctagactgccaaatgcataaataggactccatccatgcccaggactgtgcagatgctcaggaaaaacccaagaaagccttaagctctcacttcaagctgatcttgaggctctgcacaagccataagtaaagggaatgcagagttgtcaattgcatggcggagtgttgagtgtgcctcagcattcacacagagctccttggcagagactggttgaattattgattccaagtgtttgaggaaatccgtgtacaactattagatgactactaaccaagcaga

SEQ ID NO: 12720 - DNA, 11770 bp, Human
gaggtgtcactacgttgcccaggctggtcttgaacttctggcctcaacggaccctcccgcatcggcctcccacggtgctggctgaagggtgagcccaggctggccacagcgcgttttcatcattgtccgcagcttgcagtcggctggttcagagcttagccgggcacatgggcccctctgaggctcctgttcagggctcagccgtgtctacggggccctccgagctcttcctggaccctcctcggctccttcagttcagggctcagctgggcacgtgggcgcctccttggctcctccggctcaggcctctcctcgagctctgggccctgagtattctgggctccttccttggtttcctttggcctttggccgggaaagttgtgggtgtccgtggcagcctgggccacttcacagccccgcagccaacctgcggctccttcagagcaaagctgtgtggacacaaagggaacgccactcggagctggcctctccctttacctgtgagttcccgcccaagccggctgccttctgtcccctccccagagcccttgggtaactggtttgctacaagagtgtctggaatttttcagttgttctctgcggaagggagtttttaaaaggcccttaatcccttcttgacatttgtaagttgacgcttacacctggcagccttgctgaattctgtgtgcgtgaaggtccgattccaccgcgagtcacgatagaaaacccactctgtggagagaccagagatgaccgccgcgcacacctccgttcagcacacaaacctttgcaggtgttcatagcggaggcagattccgtactggggataagagctcacgacatgctgggaggggtttcaggggcagggagggggcttctgtggccccaggtcaggaggagcagctcttccatcagcagcaggcagccagcccagatgcgtggggaagacagctcccacttcgccaggccagagagcgcccgggggcagctctgttccagtcgaccctgcgagaaaggggtgtgcgtgtgcctggagctgggccccgtcctgcctccctgacctgtgtgctcccacagccctgagacggacggctcacagccttgcgaggcccacactgcactgggggtcaggcttgtgctcccgggagtcctgtctgggctgcgtggccaccatccagagcctgctgacctgcgactgggggggccagtgctccctgggtttcagcacctgagaatcagagtgggatcccgtgaaacctgggcccaggctcccacccacgccccacacccacccagggcagccatgaaacctgggcccgggctcctactcacaccccacccccacccagggcagccgtgaaacctgggccctgggctcccacccacgccccacacccacccagggcagccatgaaacctgggcccgggctcctacacatgccccacacccacccagggcagccgtgaaacctgggcccgggctcccaccctcgcccaccgagggcagctttgccttcctgggcatccctcctcccccaggcctggcccgctgcctgtccaaggctcctgtgcggggtctccacccacacattcctggggcgtgaggcgccaccactccctgctgccccgggcaaagccgtcatttgttccctttgacggcccgggaggctgccaggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctgtaagtaacaacctttgagctctttctgttgtggtgtggatggaatctgcaccttccatctggagaactggggccgccccaggccgggcttccagcaccagagcgatggtcaggcttcagctggacgcagatttcaccccgcagggcacacgcagacccatttgtttggaagcggcagtcctaaggcagtgcaggtgcctccacggccccagcccagctctcctgcaggtgtaaaggatgcagattccagggccccccgtggcctgcagaggcccctcagagcaggaagggccgggctctcggggagcccccatcccaggtgctgaggtccttgggtcacatggagctggggtggggagtgcccaggtcccctgtgatccgatggccacgtttccctcctggcttcacgcaccccaagggctgggggtcccactcactgcccattttctggctgtggggggggtctgttttcttccaccttctcaaggtgttcagagcctcaggggcctccccacttcctctggggcctgggggagtagagtctgtcacccggaggctgtgtgcctccccgtgacattccccagtggccgggccgaccaggcaggctctgcctgtggatggggctgctgagcatgagcgtgtgacccccatttctgagctgtgggtggacccaccgggcctgggccaaggttttcaggaggcagctctattctactccgccatggtggcctccctgaaaggggtgagtgtagaagccagttccctcttctgcgagccccacccctaccccaggaggacaattcttgttcagggagggtctccccacccacttccccaccccacagtggcccacaggccccaccctagagagtacaaggggctccccaggctgctcactggcccagccccgccccacctggactgcacctgaaaatgggctcagagaggccaagtggcccaaaaagacgctgctgggtgggaaggggcggtggcctctgtgcccgcagtgcccctcctgcctcaagggtgttgtctgcctggcagagcctggggtgttcacaaagcccaggcacctgcagctgagggcaggggagagggaagggagccacatccaggcgacggggctgctcgtcctcctgtgcgagagtggggagactcaggccagcccaagtgggcggcggccccggttgcttgatctaagctctgctcacactgccctgcccttctgggagaggggtgggcgccaactgactcctgggctgtctgggctggggaccgggatctcagacccagcccctcccctggacaggaggagccagtccaggggacagagggctcagtggctggagggcagggccagggtgcggacacaagctgcaggtaccacagaagtttgctctgggagcccctcctgggcccatgtggccccaggctggcccaggacagaggcgtggggtgggagcagggggtcccatcctgagtcactgccctccacagacacagaccatggccttgccaacggctcgacccctgttggggtcctgtgggacccccgccctcggcagcctcctgttcctgctcttcagcctcggtgcgtacttgatggggctgctggtgaggtggggacggcccaggggccttgggggccaggcccccagcaaggctttgcctgcccctgccttctccctggagtgcctgtggtggccacgtctcagcagcagtctctgcccccagaggtgactggagctggagatccagccagggagtgatggggctcaggacacagtggggatgtctgtgggatgggtggtctgaccggccaagcagccgggtctcagggaaagatgtggaaggccgggctccctggtggagtcccgacccctgtgcctgggggactgtgatgtcacggggtacatgggcctgagccactggcttctctttggggtgtgcacagggctggctgtgggggcggccaggctctgcctccttcctcccctgggtcagggcacagcccagaggcccgccccctcccccaagctgtcccctctgcccctttaggatgggtgcagccctcgaggaccctggctggagagacagggcaggtaaggtcccctctggggaaacaggggagggtcttcaggtcccaggtgggggtgccatgctgtgttctctctgtcacgtatccacggtgcttgccagtttccacggtccttgcttgcaaaggggcacctggacctgcatgtgactggcctgggagcagccaggtccagggagcggcagagctgaaattgcagctgggtctgggaagtagatggatgagaagcagccaagcccatgggtctgagacacagccaggcctgggaagtagctgaactcggggagtacctggcccaggggtagcgggacctgggaactcctgctccagagagctggtctgagccatgttcagcaggccctgtgtccccaggaggctgcgcccctggacggagtcctggccaacccacctaacatttccaggtgggtctggggtcctcacagtcctcaagggtgaggctcgaggggccctcgggactgagggtgggcagggcaccccatcccccagcatcccctcccccttcctcctctgctccacctcagatctgactgggctcaggactgcgggagggactgacacccctcaggtgatggcaactcccggcccttgagggcgtcacctggtcttggggggaggtctgcagggagcaccagggtcctttggggagaggtggggctgtggggcttggggagcactgggtggacattgcaggggaggggcgatcgtgggtgcccagcccgacccttcctgcagcctctcccctcgccaactccttggcttcccgtgtgcggaggtgtccggcctgagcacggagcgtgtccgggagctggctgtggccttggcacagaagaatgtcaagctctcaacagagcaggtcagtctcagttgggctgaggcaggtgggcacagctggggctgaggaattcacaggcagctctgcagtgcccaccttgccaccacggtcccctctgtccctgctgccatctctccccggccagttcttcccagagttcctctggccacccaagctgaccactggggtgcctgtccacgtcaggggctggctccccaggagcaagtctgatatgacgctgtgtgctgggccccctcctggagcgccgtgggcagccctccaggctctgccccaagggtgaatctttttcgggggagtgggtgagatctggggaaggggagcggagccaggcacgggagcccccatcccccagggcagcgctgcaggcggccagagatccacttccacagattctcgtggccagggcaggggtgtgttgtggtgggcagactggccaggcgaccctggcccaccatgtgagtggcggctcgaaacgctctgtgctggactccctgcccctgcagctgcgctgtctggctcaccggctctctgagccccccgaggacctggacgccctcccattggacctgctgctattcctcaagtaggccctgccccctgaacccacccccccggcttttgccgccagccctcagcccccaaccccctgccccttgcctcggatcccaggccacagcagagatgtggaggccggccgggctgcctctcagggtggggacgggtgtgatcagtgcggcctgtccccagcaccctctcttcacagcccagatgcgttctcggggccccaggcctgcacccgtttcttctcccgcatcacgaaggccaatgtggacctgctcccgaggggggctcccgagcgacagcggctgctgcctgcggctctggcctgctgggtaggggctggggccagcgcggggcggagagggctcggcagttccaaaagcgctgaggccagcctctctgcagggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacgggtaagtgaaggtgtctggaacctcgaaggctcacctggcggcgtggtatcagcagcgtgaggacacttgcggccatgcctcaaggcccagggtcagtcacccccgccaccacccctgccaatgcccccagcgtcccctccacagccagggggtacggcctggcctcttccctctctggggctgcacgtggggggtccctgagctgtgtcccgtgtctgcacagccccccgtcgacatggtctgtctccacgatggacgctctgcggggcctgctgcccgtgctgggccagcccatcatccgcagcatcccgcaggtgagaccccgatccccagcccgtggggatgcccggccacccgaggctcagcccaggtcctgctcgtcctcagggcatcgtggccgcgtggcggcaacgctcctctcgggacccatcctggcggcagcctgaacggaccatcctccggccgcggttccggcgggaagtggagagtgagtgccgtgccctgcgcagtctggcaccaggctgggcagcacccctgggggtgggcatcactttagggtctcacctgcccctccctggctctgcagcacatcccattataatcacagagagtggacagaatccctgtttgccagtgggtaaactgaggcacagggagggtcacaaatggcccgaggtctcatctcacaggaggtgtgggaggaagaaggggtcaaacgaactccggccctgacccctgacccctgtgccctgcagagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgaggtagttcatgactcaagttcccaccggcctgctgtgtccaagccatccccagcccctctgggagtgacatgggccctcctggtctcttggcctgcagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtgaccgtccggctcgggggtcatgtggcatgagattgggaagggctgaggggcagagtgggggacaaagcctgaggttgggcgggcctggggtcaggggcacggcctgaggttatgctggtggtggagggatacatctctccttgccacaaggctcctcggcggcccctcccacaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctggtgagtccccagaactctgcccggcaaggtgggtccgtgtgctggcgctcactgtccacccaccgtgtccccagggcggtcaggccccaggacctggacacgtgtgacccaaggcagctggacgtcctctatcccaaggcccgccttgctttccagaacatgaacgggtccgaatacttcgtgaagatccagtccttcctgggtgagccagggagtccctggccagggtgggcaacacaacgggggaagcacagactccactcgggggtgccaggcctttgcctcgccgggccgtctgctgccagggtaactgggtggtcacccgccctctgccccccggggtgtgtatggccttaggggctgtgggttctgaccccagctcggggcgccagccacctccagggtctcccacgcctgggggtcaggcggctaggcaaacccaggccctggaatccctaaggaaaaagggaagccctgtaaggcaagtgggcttcctgcagcctgtggtcaagggcctgggggtgtgaggtgaggcctcagctcgggcccctctcccggcgggcaggtggggcccccacggaggatttgaaggcgctcagtcagcagaatgtgagcatggacttggccacgttcatgaagctgcggacggatgcggtgctggtatggcgagcgggaggaggggcgtgtggaggaggggcccgtggaggaggggcgagtgggaggaggggcgcgtggagggggggcgtgtgggggggtgcgtggaggaggggcgcgtggaggaggggcgcgtggaggggggagcgtggggggcgtggaggaggggcgcgtggaggaggggcgcgtggaggggggagcgtggggggcgtggaggaggggcgcgtggaggggggagtgtgggggggcgtggaggaggaggggcgcatgggggggtgtggaggggggcgcgtggaggaggggcgcgtggaggggggagcgtggggggcgtggaggaggggcgcgtggaggggggcgcgtggggggggcgcatgggggggcgtggaggggggtgcgtggaggaggggcgcgtggaggaggaggggcgcatgggggggtgtggaggggggcgcgtggagggggcacgtggaggggtcgcgtggaggaggggcgcgtggagggggccgtgtgggggggcgtggaggggggcgcgtggaggaggaggggcgcatgggggggtgtggaggggggcgcgtggagggggcgcgtggaggaggggcacatggaggggggggcaagtggagaagccctggtggaggggcgcatggaggaggggccaacggggggtgggagggcgtgtaaggcgggtctgcagtggggcgaggccttaggaagggcagcatcttcccgtgtggtggggcctagggaagggcagccattgagctgaggtcagctggccggagacctccgaagtctggagaggctgcggtgggcatctgtgggtggggcagtttggacacaggagagcctggcagccctctggcggcgctgagggaaggagaccctccttgatggctgcccggggtctctggcagccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaaggtgggcggggcggccaggccagggctgggggcagagctgggggcgtggaggtgggcgctctgagtcacccctctctctgtagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtcttgtggcctccgaggactttctgtgaccccaccagcgtggcccctctccctctggtcttgcgcccccaggccaggtgggggcccttggaggtcttcctgaccctgctgccactgtgctgagggccaggccagcactcagggtggccccaggagccggtggtgggagtcctgtgcccctgtccccacaggcttggccccggctaggacattcccgggcccccctgctcaggccctgagcacagacacaggcaggaccacgaccgtggactttattcatgtccagcagtgaagtctgtggccccggccccggccccggccccggccccagccccaaccccaaccccaaccccggccccggccccggccccggccccagccccagccccagccccagccccagccctccgcagggcccgggcagcgtcttccgtggcccgcctgggcctgtggttgtgcgggaggcaccttcttagggcctggtcctcagtccagctcccagggcctggaggcggggatgggtgggacggtctaggaggtggggcttgggtaggttggcctggcctagagctggcccgtcagcccaagtgggcgtccagctgaatctaacacctctgtttttcctgcacctgacccctgtgaacccagccaccctgaggcaacgctgtccacagaaaccaggatgcaagtcccccagtgcagcaggcacaggaggctgcaaggcagggccatcgccaggggcaggtaccccaggggggcccacaggctgcctgtagatggaacagggaggccaccatcagtcccaccagacgctacccccatatccaccccctagagccagacaggcctgggcagtccctccctctggctggggagggtggggacagccagcgaggacacccacctgcggctgctctcctgggacccaacaaaggtctcaaagtttcccctgctcccactttctgctggtcagtgggttttaggagaggcagctgtatctctaactcagtggtcaatgaagggtgaagcagggttggccagcctcatcccaggaggcaatggacaaagctggtggacaggcctgtgggagtggccacgaggcggggacgggtctgagagggccctgggcagagggggccaagccggaggggtgcgggggccatacctgaggtggaggcctgggcatcgttcgtgggcaggcccgaggtgtggaccagatggagcacttggtgggtggtgctggggggccccctggtgccgtgggctgggccagtggggctggtggggctggcgtccaggccgagctggcccagggtggagctgttgaggctgcgcagccaggccctgacggtggggtggctgcgggccttctgaaggtctcccacgttgtggcccagcagcgcagtcacgttgccaacatccaggctctgcggagaggggtggggcagaggggccgtggggccaacttctgggccaggggaagacccacagggtagggccagacccaggatggggcagatggcgggagtgaggcccagaaacggcctggaggagggaagtgggggtatgctggctgtgacctgtgacctaggggctcccctgcctgggacagccctgcacccccacccccacccccacccccacccccacggggtagcccagccccacctgcagctcgagggggttcaggctggtgaaggtgtcgatgtccatggagatgttggcgtgggccaggtgccgcagctcctccaccggggcgccgcctggggggacgggtgaggggggctgggctccaccaggggagccgcctggggggacggggtgagggggggctgggctccaccatgggagccgcctggggggatggggtgaggggggctgggctccaccagggaagctgcctggggggacggggtgaggggggtggggcttctgggggaggggtgcccacccatggacagggctcaccgaggtaggggcgcatgaggcggtagtaggcagc

SEQ ID NO: 12721 - DNA, 87352 bp, Human; identical to SEQ ID NO: 12053

SEQ ID NO: 12722 - DNA, 27630 bp, Human
gtttgcagtttgcaccctgaatcttgggcttacaccagctccacacccagagttcctacctagaaggcattttctggtcttatgcatctgcatcccccttctttcttagcttccagcccagcccagacaagactttcctgtctccaaactgaatcattcctcctctggcccttcctcgaccccgtggtgtagcccttattcctctccctcacaggtggcactcaacctctgccagaatgcttccagggagggagagctactcactccacaagcctcagttccacttttgggcagctctgattgttgaaaagttcactttcctgtaatttcccttttgagatctgcccatggaaaaaccaaagagaagtctgcgtcatttcctttcaaatacatgaaatgtatgccccttctctgttaaagatctctagttctttcaacttctcacatagtgtagccttaagggcctctccatccctcattctcacatccctacaatttgttgttgtctctgcctgtccttcctgatgggccatggagggtgctgtgttgccactcttagccttgctaagagtgacaattctggcaggctgcagaccatgtgtggaccttgatctgagggcttagaggcttcggcctgccagccctgtgggggcacccaccccatctcttctcattgaatggggcagagcaggtgagggcatgatggacagatgggcctcatccccctgcttccgttgcctggggtcctcggtcagcctgtctgctcagacccctgaaactgggggttgaggaaggaccctcctggatcatgtgactctgttcagtccaggtgagcagggtccttggagtgacatctcctagagcccagcctatagccctgaaagttggggagaggacctgttaggagaagcatcccctgccctggggttgtagaggtgatctaggctcctcagaccttgtggggcctcagatgcttacatctccagctcctcctggcatgggcatctggctgcagcccagctctgtggccccatctcccagggaacctttggtctaatctgcctcccgctgaaacccagcctcattcagccccaccgaggctttcagagttcaggtctctcattcagggtttgagaccccaccgggctcagagagacctgcagcctgcagcggtcccagatcacacagccccagggatgggaccaggagccagcccacatcccacctgcagcagttcctgtgcctttaaagcctcccctccccccgccccacccccaggccactgggggagggaaggaggagctgggtcacagcagggaatcttagcttggttttggtgtgctgctggacgaccagaccgggcgtcgggtgagcccagaagtgagagcagttggctgcgccccagtgctgtgtgacccagaggcgccactcaccctctctgagctggtggacatcataggtggggaagctcaggtcagggcactcccatgagtgtctggaggcctgagtcccattctcagctctgccatatgcttgctgcgctctagaggagttcctcttcctctccgagcctcggtttatgtacccgtgcagtgggagtgagttgcacttcggggtgaagggggcaagacttgtgtgggcgcatcctgcagagggatcccacagaaggggagagccctgggttctttatccgactgggtctgggctgggggggcctctgtttcttggctgatgagtttatgtgagtttgagtgaggtatgcgggtgggtgaaggagggctggggggagtcacctgacttgtgcgaagaagctcttgagagagccgtggcttcttggaattaagaggaaagagtgaagcatgaacaaacaggccctggaggatctggcagccctgagtgggggtggggggtcagctctggagtagagccagagctgtgatggggttgggggaccctgtgtccttgggccatgcttgcctcgctcctgggttctgtttgtggctgtggattggggtagggcagggccggttgtgcgaggggtcattgcccaactccagggggcacctgccacctctcagctatatatatagggatatatatagttctttcgacaggtttccagcaggttgtggttattaaatcttactgaaggggtgttttttctgattctcaactctgtgccgcaagggtggaaactgtgagagacagattccaactccacttctgggtagtaagcatccagtccaggggtgtagacggtcttggggaagcagccagagatctgtacattctcatatccagggatagcgacttcaggctgggggctggcagggtaaggggtgggtgggtcccgggctcacccacaggtctgcagacttcctggggccagctgacctcggtaaatcccttttgtctaagcttcagtttcctgcctgtgaatggggttggggctgtgctctggtttcacccttgtggctctggggttgtggtgacaaagccatcaagctgggttgaaggattaaccaggaaaccttagactggctgccttgtctacctcttcctcctactcctctctctgctgcatcctgggaagctgctctgctcagcctagatgaggctcagttgtgtgtgtgtgcacgtgcttgcacgtgtgttggaagtgggtggtattgacaccagagtcagtgtctccgggtgagtgaggcttgcacatttctcgggacagggaactcactaccttatgtgcccaggacaagagctgtggggtctggagaagacttctaggccagcccctgcagtctttcctcaggtgacatggcttccccagacccacttccccctaggtgccctctctgcattcagggggtagagggctgactgggacagaatgtgacacactcagcatgtgaggaaaagcctccttcattctgtaggccctacctctattaacatgtcctttgataaagtgcctcccctcctgtctcccctctctggaatcctcagctgctgccaggcttcagctgtgccccattgaaggcagctctgcctccctactttccccagcccagggttttccttttggggtcagctgcagggatctgggccatcctttacccactcagactttcttcctgcccacctgctgctgtgaatcctgtatgtcatatacatatatatataaaatatattatataattattatatttatgtaatttacataatataatatataaatgtattatatatagtattatatataaaattatactttaagttctagggtacatgtgcacaacgtacaggtttgttacatatgtatacatgtgccatgttggtgtgctgcacccattaacttgtcatttacattaggtgtatctcttaatgctatccctcccccctcccctcaccccacgacaggccccagtgtgtgatgttccccttcctgtgtccaagtgttctcattgttcaattccaacctatgagtgagaacatgcatgtcttatatgctctcaggcagagaggaaactgctgagcagggggcaggggacagagccctgtggctctccactttagacccctcccggctgactgccatggaatgcagccacttagcagggccaaatcccctgatgttcctgttggctgtctagccttcagggacaggtcatggggccttggttcctgccctgtcatcttcctagtcaccctgatcttcagggggaggaatagcctgaaaaagggcttggtcatagcacctccaccctagggctattgaggatctcacagttgtgtgtctggtgggttctgtccagagcccatttgagagcagtggatgacaggacaggcctatgtgacccaggcaggcagcaatattgggtcagccttcatgtccccttctgtcagcttggggcagcttggaaggatgattgtggggtaggtgttatgggcacggaatagacctcaggtggaggctgcaggggctctccggcactgtagaccaggatcaggggagggagccatgactcagggagactctggcccatatccttggcagatgagggccacaggggaatgggcagcactgtccaaagtcccctgggctgggtccgcagctgttcctggctcagacttcttggtgggctggtcagaaacatgcagtaacttggggcagttaccaggtggccaagtctgcactgctgggctctgtgagcttgggccagctcaggccctctctgggccctgcctttctgggctgttcaggtggttccttgggcctggggtgctaatgtttctggatgggcagcagaaccagtctgcactcagggccccaggccatgttcctggaacacacctttagcattgacagcagcgtgtggtgaggccccttagtctgggttctggtctagtgccaggggcaccactactccaccgcctccagagccatctctgggacactggctgtgagttcagatgttctgaacagggacagggagagccagagggacccagcctggggctctctggaggggctcgtgggcagacagtgccctttggagggaactgagtctgaaaggaaggaaaccctttccccggctcatagcacctgccatccagggccctgccagggctgcgtgaactttagtcatgcgatgacaggccgagtcaccgtgccaagtcactgtgcgcctccttgctgctgtgacgtcagcttccccatcctcccagccaggctggatctctgtgagaggcctgcctgtcctgcaccctgtgcggatgcctcccactgtccaccagggctgctgggcaccccctggctggtctcttggactaggtaagctcatgggtcctccggccgctcctgctctttccctgcctctgctcctcctcggaggtggccacccccagatcccagtcccaattcggaggccccctgaggagtgctgcagggggccacaggcgtggctctgagccactctggagagtggggggggcccagccagttctgtggctgggactttcccaggcagacaagtctgtctcttcctccccagcgggtgcagcccagaactgtcttctgaggaagaggtgctctcctgggcccccactgtccccaggcctcaggtaagcccatcagggtcacaaggaagggggtctgggtttgaggccaaccatggcagctgacctactttctagcctcagtttcccctagtgtgtgcagctctcacactgtttgggtgagaaccaggcctctgggcttggacattctttcagtgagttttgagggtggagggatgggaaatggaagcccaggacctcagcagggtgtcttcctccgagccgtggacatctgcctgtgggaggctgggcccaccctcccttgctgacctgctctgggaggaagggacagggcccagcactgcctactcccctccctgttcttcccagcagtctgagcctggctgggtgccccctgctcctccaggtgcctacttgggcctttgggtagagagattaacagacaggggaggctgggtcatggttggaccaccccaggatcctgactgggggctcagctcatgaccctgagcctgggagagatgaggccatgccctccagggcactcagcatgacccggcccagtggacgggactggatagcttccttggtgcagggggctgtcatgctaggacagggtcactgaccaggccaggcccctgccccatgacttgtggtggaaatgtccttttgtttttgttttttgcttttttttttgagacggagtttccctcttgttgcccaggctggagtgcagtggtgcaatcttgcctcactgcaacctccacctcccgggttcaagcaattctcctgcctcagctcctgagtagctgggattacaggcacctgccaccatgcctggctaattttttgtatttttagtggagatgggggtttcaccatgttggccaggctggtctccaactcttcacctcaggtgatccacctgcctctgcctcccaaagtgctgggattataggcgtgagccactgcacccggccatgtgatgggaatgttctgtgtccataatagatgctgcatattgctggcccagctcctgaggctctttggacctccaggaatcggtgtctctatcaggaacccttaaccctgacccggactcccagctgggacccagggtgttggagtggcaagagcgctgtcaggcctggtgaagggtgtgagctgtccaacggggcagggaggaggcagggcctgttctgcagttggacagacagagccctctagctgctttctggaagactgaagggcaggtgatgttggagggagggagtgcaggcaggggctgtgagggagttcaggtcagaaacaggtggcgcctggattcaggctgtggtggtcacggtggggatgaggggctgctttggattgtgctggggatgtggggtggtgcgctgctgcatgactactgccaggtctctctgctcttggtgtctgcatccagggctgggagggggtcaaatgtatcacactatcggccccaggcccaccaagcctggggaggtggccacccttccacgatggcatttggatgttccctgtgtgtggggagggcacagggactccattcatagaccacctctgggacagtgtgtctgcctctgaggtcagacgctctgcactgggacagggtggagtggagggaaacccagcttggggctcattggaggggcttgctggcagacaccgccctttgtgggaaactgactgtgggagaggggaaccccaacctctgtcaccacatccctcttccctgttgtcacacctgtcacttgctgccatagccatgagacttcccaagggtcactgctgccactcactgcacagcctggaagggagtccacaggggacatagagtgagcaagagacctgtgccactcaggcctcctgggggtgtccccagtgcagccatgatgataatcacagctaccattcaccaagccctgcccacagtctaacctactctattcacaacactcccagcagcaaggcaagtgaggtgctgccgtcatccaggctggacagttcagtgatttgcctgaggccccacagcaggtgagtggcaagtccagcatcagagcagggcaggctggcggtgccccttgagccccctttgccatgcttaccacatgcacatcctgggcttctgcaggaatgccctgtcccctacctgccctgctccgtgcaaaaccctctttgagctgtgcctgggagacatgctgagagaattcatggaaacaaatgtgttactgacagcctctttgcctccagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtctctgaagaagattctgtggctacaggcttcagcagagtgtgagggagaccccagttatttcctcagctgtttccaccaaatcctcctgtctttcgtggccaacaccccaggcaaggcttggggcccccgtctgctgctggacggtaagtcctggccccgtggcagtgaatctgtggggcgctctgattgtgggcactatggaagctaaaccccatgctccaggtggggtggagggtcttcagaggactcctggacagtgccaggctctaggctggggtgggggacacaggagaaaccaggccaggcccatccctgctggagcttctccctaagcagtggaggctcagccactgtgaggaggtaggccaggccctgcagaaagaggggtgtggaaatctgggggctcccaggaagggccgctgctggagatggggttcttaccaggatgggctctgaagacaagcagggaggatttgggagggtagagatgaggcccagagcttctggcagagggcatggcctgcgcaaaggtctgggggccggacagcctgcacgtattctgggaagcgggaaggagacacaggccttgtgtttctgaggcccgactttagactgtgccctgttggggaggggccagggaatgtctgaggctgggcctgaccctgctccttaccccgtgggtgcagcagagccatgaagaagaagttagtggtgctgggcctgctggccgtggtcctggtgctggtcattgtcggcctctgtctctggctgccctcggcctccaaggaacctgacaaccatgtgtacaccagggctgccgtggccgcggatgccaagcagtgctcggagattgggaggtgagcggggcagggcatgggacatgggccctgaaaactgggcaagtggacctgagcaataccttcacccctctgagactcagtttccccacatgcaagcttcgcttggactccctcagtagcctttgggaaggggatggtgactccgagagcagggtgtgggtctctagagccaaacagggccccttttctcagttctaagagtctctgtttctttggataaactccactgttttgttgtttggttgttatttttacttatttcttcctatctatctatctatctatctatctatctatctatctatctatctatctattttagagatggagttttgctctgttgccaggctggagtgcagtgatgcaatctcagttaactgcaacctccgcctcccaagttcaagcgattctcatgcctaagcctcccaagtagctgggattacaggtgtgtgccaccacgcccaacaaatttgtgtgtgtgtgtgtgtgtgtgtgtgtgtgtttgtttccgagacagagtattgctctgttacccaggctggagggcagtggtgcaatcttggcttactgcagcctccccctcccaggtttaagtgattctcctgcctcagcctccacagtagctgagactacaggcatgtgccaccatgcctagctaatttttgtatctttagtagagacagggttttgctatgttggccaggctggtcttgaactcctgaccttgtgatcctcccacctctgcctctcaaagtgctgggattacaggtgtgagccactgtgcctggcctaattatggtgtttttagtagagatggggtttcaccatgttggtcaggctggtctcgaactcctgacctcaggtaatccacccacctgggcctcccaaagtgttgggattacaggtgtgagccaccatgcccggcttattcttttctttttattttttggttaggagacaatttctttctttcttttttttattttattttattattattatactttaagttttagggtacatgtgcacaatgtgcaggtttgttacatatgtacacatgtgccatgttggtgtgctgcacccaccaactcgtcatttagcattaggtatatctcccaatgccatccctcccccctccccccaaggaacgctgttgcccaaacagggacatgaagggcttattctttttttaaggtggagtcttactctgtcacccaggctggagtataggggagcgatcatagcccactgcagcctcaaactcttgggtttaagtgatcctcccgcctcagcttcctaaagtgctgggattacaggtgtgagccatggtgcctggcttctactgttttattctattttgggctcttatctcatgttatatataaagatcagttcccttctaaagacttaaacagaaaaaatattatgtttttcatattttgagacagggtcttgttctgtcacccaggctggagtgcagtggcatgatcatagctcactgcagccttgaactcttgggcttaagcgatcctctcacctcagccccctgagtagctaggactacaggcgtgcatcacacctgactaattaaaaaagactgttttgtagagatggtctcactctattgcccaggctggtcttgaactcctggcctcaagtgatcctccaccttggcctcccaaagtgctgagattacaggtgtaagccaccatctctagcagggaaaaaaaaatgttattaataaagtatagcaatttccctttttgtcccaattataaaagtcatgtacatttgtttgcttgataaagaggaaactgtctgggcaaggtggtccacacctgtaatcccagcactttggggggttgaggcgggcagaccacccgaggtcaggagttcgagactagcctggccaacatggtgcactctgtccctactaaaaatataaaaagttagcggggcatggtggtgtgcgcctgtaatcccagctactcaggggctgaggcaggagaatcgcttgaacccaggaggcagaggttgcagtgagctaagatcatgccactgcactccagcctgggcaactgagtgaaactctgtctcagaaaaaaaaaaaaagaaagaaaagaaaaagaagaaactgtaatcccagcactttgggaggttgaggcgataggattgctttagaccatgagttcgagaccagcctgggcaacatagaaagaccctatctctacaaaaaagacaaaaaattgcccagtgtggtggttcttacctgtagtcccagctactcaggagactgaagtgggaggattgcttgagcccaggaggtcaaagctgcattgagccaagactgtgccactgtacttcatcctgggtgacaaagtgagaccctgtctcataaaacaaaggctgggcacagtggctcatgcctgtaataccagcactttgggaggccaaggtgggtggattacttgagcacaggagttcttgaccagcctgggcaacatgatgaaaccccatctctacaaaatacacaaacaaacaaaattggctgggcatggtggcatgtggccacagtcccagctacttgggaggctgagatgggagggtcaattgagcccaggagactgaggctgcagtgatctgagatcacaccactgcactccagcctgagcaacaaagagagactttgtctcaaaaaaaaaaaaaaaaaaagaggccaaggcaggcagatcatgaggtcaagagatagagatcatcctggccaacatggtgaaaccccgtctctactaaaaatacaaaaattagctgggcgtggtggcatgcacctgtagtcccagctactcaggaggctgaggcaggagaatggcttgaacccgagaggcagaggttgcagtgagctgagatcgtgccactacactccagcctggcaatagagcaagactccatctcaaaacaaaaaagaaagaaactaaaaacaaaaaccccaaaactcgaatggacttctcttccatcctcctttgggcaggtaggcagcagggtatgtatgcggtgccagggtggaagcctgcaggttctcatgcctttatgtgccacatggcagggacacactgcgggatggtggctctgcggtggatgcagccattgcagccctgttgtgtgtggggctcatgaatgcccacagcatgggcatcggggttggcctcttcctcaccatctacaacagcaccactcatgaatgcctcggaagcggagagggagaggggcagggggtgtgggttgggccgaggcacagctgggtggcccccaggctcacgtggcataaagggttttggtgggtgggcctgcctacctgcttcttctaggaaaagctgaggtcatcaatgcccgcgaggtggcccccaggctggcctttgccagcatgttcaacagctcggagcagtcccagaagggtaagccatgctgcagacttggggcatgggtgcagagctggctgagccaccgggaaggggccttgcccacaggagcctgctcccgtcagggttcaggggcagttctatcaccccccatcccttcctggccccatagcaccctcccacaatgagtggtcaggaccatcatcaccacggtaaagggccgggagcttctgttatttctgctaaggcctccggggccactctgtgcagcacatggaaagaataattattatgctagcagacctcatggatcagggctcactggggcccatgctctgctctgtgcttttcacccacgagcctctcacaaccctccctgctcctttgggctaggggatgctgtgtggattcccattttacagggtggggatgctgaggctcagacaggtcatgcaaatcagctgaggtcacacagctgggaggtggtgaagctaaaattgaacccaggctgtctatatcctgccttttcaacaggcatcccattcactcatttgttcatttgtggggatggcgctctagaatgtgaggtggagtctctcttttctaatctggtcttaagtggggaggaggcccccaaattccccaggtacctgaagggaagccactgtccatccaggaagccactgtctgtccccaaaggaggcacaatagattgtgagataaaagttggaggatgggagggtctcaacaactcaacacctctaatcctagcactttaggaggccaagtcaggaggagtgcatgagcccaggagacctgcctggacaacatagcaagactccatctctacaaaaaaatggaaaaaaaaattagctaggtatggcggtgtgtgcttatggtcccagctacttgggaggctaaggtgggaggatcacttgagcccaggaggttgaggctgcagtgagccatgattataccactacactctagcttgggcaacaaagtgagaccctgtcaaaaaaaaaaaaaaaaaggttgggcctttttttcacaggctcacgcctgtaatcccagcactttgggaggctgaggcagatggatcacctaggtcaggagttcaagaccagcctggccaacatagtgaaacccattctctactaaaagtacaataagtcaggcgtggtggcacaggcctgtaatatcccagctactcaggaggctaaggcaggagaatcgcttgaacccaggaggtggagattgcagtgagccgagatcatgccactgcactccagcctgggcaacaagaacgaagctccgtctcaaaaaaaaaaaaaaaaaaaaaagttggaggatggaggggcaggacacactcaccatagcaggtcttagacttcaggtgggggtcctgggtggtgccctttggagtcttctgcaacatactcaatctttgattttttttttcttttttttttttgagacagagtctcactctgtcgcccaggttggagtgcagtggtgcgatctcggctcactgcaagctctgcctcctgagttcgcgccattctcctgcctcagcctcctgagtagctgggactacaggcgcccgccaccgcgcccggctaattttttgtattttttagtagagacgggttttcactatgttgcccaggctggtccctcgatctcctgacctcgtgatccccctgcctcagcctcccaaagtgctggaattacaggcgtgagccactgtgcccgaccaatctttcatttgtttttaatactcattgagaaactcagcatctgtagacatgaagttgctgagggtaagagaatgcgggaatcataggcttggcaccttgtggacgcttaaaaccatttatttaactagaatgtattgagcattgtcttaaagaatcagctgttgttcctgaagctggggtgaaaaacaaagacggcagatgaaatctgtgacactccaggtgggaggagaaactaggcaggtgcgggtgtgttacgggctgtagaaaaacagacctggagggcctcaaaatctgggactctatggagggtgacctagtcagggaaggggacatctgagcaaagacccagaggcagagatggggtcaggggagttatctcctggtctgctatccaggtgtgatggcagggacagagccctgtggggagctggggaggctgcagcaagtgatccaaggggaatggcccaggttgtgcgggatctcttaggttatggtgaagcctctgcttcctgtctgagggaagtgggggctcgtggagtgtgtgagtggaaggggatggatctggcctatggaccccttggattgctgtgtaaggggcagggagcatgtggggacctgtccggaggtcactgcagtaattcgtggagagggtgctgggaagtggctgatgctggacagacacacttggaagtggagcctgtggatttgaggatgggttgggtgtgatgcttgtgtagggagtccccagggacccctgatcttttgtctgtacctggaaggatggggtgaccctaatggaggcaggcagggttctcaggaagcaggttgagcagacactcaggagctcggttttgggcacgttgaagtttgagatgctttcttcaagcaggcaggtagatactcaggtctggtgatcagaggagcagtccaggccagcaggtcaatttgggagttgtcagtgcataaatggaggctgaagctcagatgtcaagcagaccaccaggagagagagcaaagacagaggggagagtaggagctaggatggcaggcaggggatactcgggtggagccaggtgctgggatgcaggggcggctctcagggagagtgatgagcccagtaaagctgagaggggcactgggtctggcagtgtgggtgtcaccagagaacttggcaagtgtggtggcatgagagtctgattggcctgaggtcaggagaagattttttttctgatgttgatacatgatattttctatatttatgggtacatgtgagtgcttgttacatgcagagagtgtataatgatcaaggcagggtatttggagtctccgtcaccttgaatatttttctttctgggtgttagcaccatagtcctctcttcattactttgaaatatacaaaatactgttgctaagcatcgtcaccctggtctgctatcaaagattagaacttctcctgtcttggctgggcacggtggctcatgcctgtcatcccagcaccttggaaggctgaggtgggtggatgacctgaggtcaggagtttgaaaccagcctggccaacatggcaaaaccccatctgtactaaaaatacaaaaattagcctggcgtgctggcctgtgcctgtaatcccagcgactcgggaggctgaggcaggagaatcgcttgaacctgggaggcggaggttgtagtgagctgagatcatgccactgcactgcagtctgggagacagagcaagactccatctcaaaaacaaacaaacaaaaaaacaaaacaaaacaaaaaagaacttctgtctaactacaaggtggaaggaatcatgtgctgggtgtcagaccttccgggatgtatgtgcagcttctaggaattgaaaccaccagctcttggaaacttgtgccaggcttcagggtgggagaggcagttctagagccgcagccgccaagccaagccaaatggccccatcatctctcgcaagagcaggagagtacctgggggcagaggccatagttgtacctttctgggcaaagggtcagtgtctgtagtgtccatatgggcagtggggctcaggggggaagcaggcccaggggtctgtttccaatgacctcctcaaaagtcagaactggaaggcaaaaccccttatagactgggtgcacctgtaatcccagcatgttgggaggctgaggtgggaggattgcttgaggccagagtttgagaccagtcttggcaatgtagcaagacccctgtctctacaaaaaataaaaataaaaaattaggctgggagtggtggctcatgcctctaatcccagaactctgagaggctgaggaggatggatcacctgatattaggagttcaagaccagcttgaccaacctggtgaaaccccgtctctgctaaaaatgcaaaaattagcaagccatggttgtacatgcctgtaatcccagctacttgggaggctgaggcaggagaattacttgaactcgggaggtggaggttggagtgagccaagattgtgccattgcactccagcctgggcaacaagagtgaaactccatctcaaaaaaaaaaaaaaaaagccacatgtagtggggtatgtctgtagtcttaggtacttcagaggctgaggtgggaggatcgcttgagcctgggaagccaaggctgcagtgagccatgattgcaccactgcactccagctgggacaacagagtgagaccctgtctcaaaacagacaaacaaacaaaaacccttatagttggatggagaaactgaggctgggagaggggacaggatggaggttaaggctcagtcttgcctatctggggcagtagaaaagaggaagggagccctttcttggggctggctgtgtcttgaaggtggcctgtgcttgacctgggtcagggtgggatctgctcttgttttggcacattctggtggagcccatgagtcttacaggataaggccttgtggtcagtgagatgggagggggtctggcctggcacaggattttagacatgcaggcacctgcacagacagacacctcatcctgggacagcaaaacccagccgcatgctactgcttcccctcctgtgccctcctcagacatccctggtccatgtacactcctacctgctaagcccctcttaaaaaaaaaattaaacatcccctcctaaaaaaaataataaaataaaaatcaggaggctgaggtgggaggattgcttgaatccaggagttcgagatcaggctgggcaagatggcaagaccccaactcaaaaaagaaaaaaaaaatctttcctcctaagcctcattgccccatctgtaaaacgagtcagggactgtgcctgggatgctgcctgcgagagatcccgatgtcccccactcagggtcactaactgtggctctctctccccaggagggctgtcagtggcagtgcctggggagatccgaggctatgagctggcacaccagcggcatgggcggctgccctgggctcgcctcttccagcccagcatccagctggcccgccagggcttccccgtgggcaagggcttggcggcagtcctggaaaacaagcggaccgtcatcgagcagcagcctgtcttgtggcatgtctgtgggtgcggccccctgacacaggcagggcaggcacagcccaaggaccttgcaggccgtagcagcagtggagcggccctctgccttcaggaccctgcgctgataatgggatgaggagatacagacccttcccaccacgtgtggggacacattctgagcgtggggacacattctgagcgtgaggtcccagtggccactgtggctggccatgtgtcctgagtggcaagggacactagaatgttcccggaagggacactaggaggatgagcgctgagtgacagggccacccacctgtgacaggcgctgcccctgctttgtgctggtctcctgtgtgggcaggtgtggggggtggtctagctaagtccaccccacctgctgcctcacatgagccccctctgccccagtgaggtgttctgccgggatagaaaggtgctttgggagggggagagactgaccctgctgcggctggctgacacctacgagatgctggccatcgagggtgcccaggccttctacaacggcagcctcatggcccagattgtgaaggacatccaggcggctggtgagtgggtaaccctcaagggcctgggtgaggaactctgcagtggaaaccctgagctgtagcccagagccatggggtcctcctgtcttgcctgagcctgcaggaagttcctggtggaggagggtcagtgactagccatgtgggtccacagctcctgcttatatcaaaaccaagagaggccacacagtccaggagagcaagtccctgttggggtaaatgcaggtgtaggcaagagccagggctagggaagcactagaatacagcctgaagatccaggaggacttcttggaggaggtggcggctgggctgcagataactttgttaggcagagagaggaagggattcctagcagaggaacagctgggctaaggcccagtagagggggctttgattcaccaagggggttacaagggatgagggtcgccttgagagaggcatggggaaggggatttgtggggcaggggcctggagcttggctgtggctttcttcaggtaatttttgtcactgtttcatggaggagggtgattagcatgtcgacctttactactgaggctggaaattggcgtgccaataccctgtctgtctggagctgactccaggagaattaagagcctccctccctccctctatccattcatcgtgaggagaagaggccaagcagcagggacaccggcaggaattctccagttagaaaaggccctctgagccaggtgtggtggctcacgtctgtaatcccagcactttgggaggccgaggcgggtggatcacctgaggtcaggagttcaagaccagcctggccaacatggtgaaaccctgtctctactaaaaatgcaaaattagtcaggcatggtgggttgtgcctgtaatcccagctacttgggaggctgtggcaggagaatcgctagaacctggggggctgaggttgcagtgagccgagattgcaccactgcactccacagagtgagactccatctcaaaaaaaaaaaagagagaaaaggccctctgaggccaagcttggtgtctcatgcctgtaatcccaacactttgggaggctgaggtagaagttgaggccaggaggtccaagacaagcctgggcaacatagtgagtctacaaaaaaaatattgagaatctacataaatatagtgggggtgggggtggggaacaagaaaacaaaaaattcaaagcatagtgaaaagaaatatagcaaaacccggccgggcatggtggctcacgcctgtaatcccagcactttgagaggccgaggcgtgtggatcacggggtcaggagatcgagaccatcctggctaacacagtgaaacctgtctctactaaaaatacaaaaaaattagccacgtgtggtggcgggtgcctgcagtcccagctacttgggaggctgaggcaggagaatggcgtgaacctgggaggcggagcttgcagtgagccgatatcgcgccactgcactccagcctgggcgatagagcgagactccgtctcaaaaaaaaaaaatagcaaaacacaacaaaaaaaattaaaatttgctgggtgtagttgtgcctttagtctcagctactggggagggtctgctggaggatcacttgagcccgggagttcaaggctgtgattaagccactgcactccagcctgggtgacagagcaagatcctatctctaaaaaaaaaaaaaaaaaaagaaaacactctctggccacagatgagagaaggcagacaggaagccactaagccaagcaggcagagggcaggtggccccagaccagctgtcgggtggtgagcagtgtcagggagacaggagtgccggagctggtgaggttcccaaggaggtgaggttgcctgtggcctcctcccagggcacagtcccacccctccagtagtgcactctgtcctcccttgtaggtacaggcttttcctcaccaccatggtgcagccatgcctgcccccaacaccactggtgcagctccatcctccacgcagtggtgcagccccatcccagtgcccattcgagctgctgtcccgtcgcagggggcattgtgacagctgaggacctgaacaactactgtgctgagctgatcgagcacccgctgaacatcagcctgggagacgcggtgctgtacatgcccagtgcgccgctcagcgggcccgtgctggccctcatcctcaacatcctcaaaggtgagtggtcgcaccacagccgtgtggtaggacccatgacactgcctctctctccccacgccccacccctgctgcatctctgctcgccccccatgccacgtctttccatcactgagctcctgaggtgtgtccctgcgtcacagctcaccatgtcctgaaggaggcagtgcagagcgacagggctgaagcgggcaatgctcaagggttggaggaggaacaggagtcatcaggagggagagaggtgcaggagctcagggctgcagggccggtccagagggtaccccggtccagtgggtgaccctgccacttggtcattgaatggccagagctgatgcgtgacgtgaggtccaggctcgggagccctcaccttacttcactctcaccacagccttctgaagcagctgctgctattggttattaaacgctccttgaggtgggcaaagtggctcaggcaggtgttaaccctctgagcccctcagagcctctggggctcagcaacatgcacctggctctgatcaaccagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtaaggggcaggggctggcccactgtgggtgtggggcctgccgtagaggcatcaggtgggctccccagggtggctacagcctcacatatgctttatgaatccattcctgccacagaatttgattgcgggcctactgtgtgctcggatggactcgtgggtgacccccagtcttggcttctgccccacagaactgacagtgtggggaattagtggccaccctcctacctcaggtcctttgcacatgctgtggttcttgagtgctcagtgctgagatgaggaatgcatgggggcattgcagccctcgggcatggtgagatggatgggtgaaagggagagggccaggtgaacagagacctcggccacccactccctgtcactccaaactaacgcttcccagatgccaccctcagccctgcaccacctgacccactcacccagtagttgccccagctccacgctgggtccctataagaccctgtcatatcccttcccgctgaggatcctcacatccctccttacctacttgggtccttggcattcctgggcggatctgcagacccccccacactgaccagtgacctcccaggaggggcgtcagctgcccgggtggtgtcttctctttccctgtgagcattctgcacctctgactcccgctgcagccagtgacctggtgtcttgtctctctgaggggacagagccactgcagcgtgtccctctgccctcctttttggctaaggccagctccttcatctactcgctggctcggggtgctgttcctacaatgctcctgtctgcctctgatgatttatttctttatcacggattattcccaaaagaaaggcagctgttgttgctctagaaacttctatctgctgcctccttctgtcctttgctcctcttagagcaaacatggctgggctatgtcctctctcccttcagggtatcccctcccctgctctatccccatgccaccagatcgccatgtccagcctcagtttccccatcaggccccactcagcagcatctcacacagctcaccacactctcctcgagttttcattttgcaaattttcgcacctacaaaaatgtaaaaaaaaaccaaaactgcccaagcatcaatgttcccttttcctggagtctgcagtgtggacgtttctgccggatttcctaactctctccgtctccacccacatctattgggattcgtgtttttctgagggattccacagtaggttactgatgtcgcacctcagggtgtgtctcaaaagtgagacttgaacatagcacagcaggatgtcggggtgacacaacctgctgtcccttctctttacctacagtaggctcccttggctgttttgtttttgttgtgtttttgtttgtacacagagtctctgtcatccaggttggagtgcagtggtgtgatcttggctcactgcagcctcaacctccagggctcaagcaatcctcccacttcagccccctgagcagctgggaccagaggcacgtgccaccaaacctggataatttttgtattttttttagagacagggtcttgcccagactggtctcaaactcctgggatcaaactatcttcccacctcagcctcccaaagcgctgggattacaggtgtgtttttttttttgagacagagtctcgctctgttgcccaggctggagtgcagtggcgctatctcggctcactgcaagctccgcctcctgggttcacgccattctcctgcctcagcctcccgagtagctgggactacaggcgcccgccactgcgcccagctaattttttgtatttttagtagagacggggtttcaccgtgattgcgatctcctgacctcgtgatcctcctgcctcggcctcccaaagtgctgggattacaggcatgagccaccgtgcctggcctgttttgttgatttttaaagcccagggcagtagtcttggaaaatgtcccacatcatggatttgcctttctgtttccttgagggcagtttcagacagaacacctttccctcggattggtcaactaatctgtggggtgttgctgaaactttattttattttattttattttattgtattttatttattttatttttgagatggagtctcgctctgtcccccaggctgtcccccaggctggagtgcagtggcgggatctcggctcactgcaagctccgcctcccaggttcacgccattctcctgcctcagccccccaagtagctgggactacaggtgcccaccaccgcgcccagctaattttttgtatttttagtagagatggggtttcactgtgttagccaggatggtctcgatctcctgacgtcgtgatccgccctcccaaagtgctgggattacaggcctcggcctcccaaagtgctgggattacaggcgtgagccaccgcgcccggtgttgaaactctcttgaggcattttcttcggccttcgggtccatcctctctgtctcctctttgacctcctcatctcctcctcgccactgccttggggaccttggccaggctcatggcatccagcagccactcaatgtcaatacctccatgttcatctctcagcccgcccttgcccgtgaacccatgcttatttatttattttttttatacgtgcacccatgctctttgggtctgatgaagtatccaaaatcaagctcctgaccatccccaaaccggccccttctgccggcctcgctagtcggcaccatgcttgattcttctctttctcccacccaggccatcatctcttgcctggttgatacccacagcctcccctttgggctttatccttatccccgtcatagctgccagagggaccctgtgaaaacactccccagcctcctcattcctctgccctaagcctgcatggcacagagcaaaagccagttgttatgggacctaggaggtcctgtgggatgggccccagcctgcatcttcatcctcttctccccaccctactccattcactctctgcctatcgctcaccagcctataccacctgcctcagggcctttgcactgaccatttaggccacattccaggctcttttcacacgttgcctcctctgagaagccctccctgaccactctgcccatacctcatgcctcttgattccccttacctggcttgtggtttcagcactttccctgtgtgtgtttgtttttcttggcatgagggcaggacctaagtgtctgttccctgttgattccccagtgccaggcatgcagtgcaaattctagaaatattttttgcatgaaggaatgagtgattgaatgcagcaagggtctggaggctgaggaccaggcagacagacattcagagttgctggaacgcgacagagacagggagtcagactggtcatgcaaggtcctgggcctgcccttgggtcctggggagccacggaaggttgtgggtgccagagggttttggtcagagtcacagtcaggggccttctgagacctgtgccccctccccaccctccctccccacctcctcaggccagctctggggtctcggcaggtggtccgcaacatgacctctgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcgggtgctgtctgacctggctgggcggtagctttggctccaaggtctgctccccggtcagtgggatcctgttcaataatgaatggacgacttcagctctcccagcatcaccaatgagtttggggtacccccctcacctgccaatttcatccagccaggtatggggtggaggtccggggggtgggggactggggtggagaggggcgggtgtcctgggcaggcagctgacgggcatccctgtcttctcccatcggccgcagggaagcagccgctctcgtccatgtgcccgacgatcatggtgggccaggacggccaggtccggatggtggtgggagctgctgggggcacgcagatcaccacagccactgcactggtatgtgtcaccccttttctccctggccctgcccactctgcacagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggtgggccaggggttggagaaactgagtcatggtgtggggccccagggcatcctgggctggaggcctggatcatcacagagtggacaatggttggtgtcctctctctagtgcctgggccatctggagcccctgtgccatgagggccaagccccctgctccagtgagacccagcaggccccaacctgctcttcctgatgacctggcctgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggcagacaaggctgacaagcaatccagggacaagatactcaccaggacgaggaagaggactttgggggacgggcttcccctgtgagcagcagagcagcataataaatgaggccactgtgccaggctccaggtggcctccctggcctgtctccccactctctgggcctcagtgtattgtgtgtgaaatggagccatctggctggggaggaacagagaggtgggattcggagatcttcacaatgcgggcactggaactagcctcagcatcttcagcatggggagagccaggcacatggctgggggccaggggaaggttcacaccaaaccctgccccttcccaccctgatccctcagactttggggccaggccctcccttactggggctgggcagtgacactacctaggatcagccaccagggggtgtcacgaccctggcgctttcttaggcagagggtggccagctgatgctgggaacccgggcgccttctcagacccgtaggcgtccagctcaccctgccgatgacactggaggtgaagctgagggtccgaggaatggggactgggcaacaggctggaggaaaacatctcggtcagagccatgcccctggggggttcccaagagcaagcccagagtgaaacccaagcttgtgatcctctccagagggaggcctggttctcagggaacagcaaacgggaagatgtccccagatcccagggatcagggcttggaccagccggggacgcagcccagagggagtgggtccagaaggaaacagctagacacagcagccttcaccattggcagcccctccaggcctccctcggggcctgctccctcctctgtgcacagttccaacacctggagcagggttctgggaagggctggtggaggtgggctggtgggaggcggtgatcacagcccagcacctggatatcaccaggggcactggggccaggggccaggtgaggccaggtcggggctatccttcaggagccccgaaaacctggtgattccaaagggcccatagacaaacagggttttatgcctgtggagtcaagtcccactgggtctgagctctggagggctgtgtctctggggctctgcaagggtgagatggaggtgggctcaactggtgtacaagtcactcttcaatccttattttatttatttaatttttttaaaaaaaatttaaaccaatagagatggggtctcactatgttgaccaggctggtcttaactcctgacttcaagcagtccccccatctcagtctcccaaagtgctaggattacaggggtgagccactgcacccggcctcaatccttattttggcctgagaggaaaggccgtggccccatttgcaggggagaagactgaagctggaggggcaggccttgctctgggttgcacagcagcaagagaagtgggagctggccacgaggcttcctggacccgacacgctggtggggtacaccctggttctccaggtcccatggggctcagcccaggactacctcggggggtgagggacttaaatcctctccttcattctcatcgccccttcccccatcatttcctgaggaaggacattcagggacctgaaggggtggcctgcccctccacacctgtgggtgtttctcatcaggtgggacaagagactgagaaaagaaagagacacagagacaaagtatagagaaagaaaagtgggcccaggggacctgcgctcagcatatggaggacccacgctggcaccagtctctgagttccctagtatttattgatcattatctctaccatctcagagagggggatgtggcaggacaatagggtaatagtggggagagggtcagcaggaaaacacgtgaacaaatgtctgtgtcataaacaaggttaagaaaaaggtgctgtgctttgatgtgcatatacataaacatctcaatgcattaaagagcagtattgccgccagcatgtctcacctccagccctaaggcagttttctcctatctcagtagatggaatatacaatcgggttttacaccgagacattcctttgcccagggacgatcaggagagagatgccttcctcttatctcaactgcaaagaggccttcctcttttactaatcctcctcagcaaagaccctttgggg

SEQ ID NO: 12723 - DNA, 46823 bp, Human
  misc_feature (1)...(46823): n = A,T,C or G
ggaggatcccttgagccctgaagtttgaggctgcagtgagctgtgatggtgaccctgcactccagcctgggtgacagagtaagatctcttaaaaatatatatagcgttttaaaaaatgattacgtacctcaagagacaagctaatcatatgatttatccagaaaggaaagaaccctcctatcacatgattctctgttgattaacgaagtgcccaggggcctctgaaatataagtttcccacaggaggaaactggcttagaaagaccagaaagatccggggggtctgctctgtgcggtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccaggtaattttttttctttttgaagaaacagagctttgccatgttgcccaggctggtctcaaactcctgagctcaagcgatcctcctgcctcggcctcccagagtgctgggatcacaggtgtggagaaataggaacgcttttacactgttggtgggaatgtaaattagttcaaccattgtggaagatagtgtggtgatttctcaaggatccagaactagaaataccatttgactcagcgatcccattgctgggtatatacccaaaggattataaatcatgctactataaagacatatgcacatgtatgtttattgcggtactattcacaatagcaaagacctggaatcaacccaaatgtccatcaatgatagactggattaagaaagtgtggcacatatacaccagggaatactatgcagctataaaaaaggatgagttcatgtcctttgcagggacacagatgaagctgaaaaccatcattctcagcaaactaacacagaaacagaaaaccaaacaccacatgttctcactcataggtgggaactgaacaatgagaacacctggacacagggcgggaaacatcacacactggggcctgtcggggggtgggggcctgggggagggattgcattaggagaaatacctaatgtaaatgacgagttgataggtgcagcaagccaacatggcacatgtatgcctatgtatcaaacctgctcgttgtgcacatgtaccctagaacttaaagtctaaaaaatttaattaattaattaattaattaatttaaaaagaaagaaagaaaccgagcttcgccatgttgcccaggctggtctcaaactcctgagctcaagcgatcctcctgcctcgccctcccagagtgctgggatcacaggcgtgagcctctgtacctggcctcagtttcctcatctggaaaacagcaggggaagatactgccagctgggacgcaggctctgccaactctggcatgccaaagctctgggcacagggtgagccctaccgaagtgggagcccagagctatttctgacaaggcccctgcgtgcctgcccagggaagagccaagtggccccaggcgagaccgccccgcccggctgccacaccttcccctgcacagcagccagcctggaacacacagaggccagagggttggtcagagccacatggtggaaactccagcagagggatttttaaagcaggttgcacttcattcttgctgagcgagtacacgtgtgtgtgtgtgtgtgtgtgtgtgtgtgtgtgtgtgtgtgtgtgtgcagcgcccctggttctgtgtttttattgtgctttcctgctggcttccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcggtaagtactttggggccccgctgggggtggtagcgaggaagctccagcgggaccccttggatgcgtctgagaaacgggaggcgccgctggtgtctgtggggccggcgatggagaaagccacatggtcaagcaggcactcacgggcacacggcgagaggggctggtggtgcttgggcacccccacaccccggcaggaactccagggtgctctcggagcctgctaccctgcccggagggatcctcaagctttctactggagccagtttggcatctgctccataagaggggaaactgaggcacgggggaaggaaaggggcaaaaagtgagtgctaggaccccagagccactgctcttaatatagcgcatagaaagacatgggcggggggcggggaaaatagaggccaggacttctccactgcagggtacccccagcttctcccttctttctctctctctctctgtctttctccttctgtctctctttcagtctctctatctccctaatctccgttttctctctacctctgcctctttgtctctctctctggtgaacaacaaggagatccctaggtccccatccctaaagcccctggtgacctgaggagggtcccccaggacatgccttggaaaggggaacttcctgagcgctgggaaccgcagctccacatgcaccccaacaggcggccacagcgttttcctgtgggaggggcgcccggggtgaaatatcaccactgggtttcaggatgggccgccggggctggcggcggttgtggtgtgtgtgcacctgtgtccctgaggaagcatgcgggtccagggcatcttagagcctgggggatccagcgccatcatttttttttttttttttctgaggcggagccttgctctgtcgcccaggctggagtgcagtggcacgatctcagcttgctgcaacctccgcctcctgggttcaagcgattctcctgcctcaatctcccaagtagttgggtaacaggagtctgccaccacgcccagctaatgttttgtatttttagtagagacggggtttcaccatattgggcaggctggtctcgaactcccgacctcagatgatctgcccaccttggcctcccaaagtgctgggattacagtcccgagccaccgtgcctgaccatgccttcatttttatctaaagaaatgaagatggcagtaaatgctcaggcacaccagacagcccccaagtcagaagagcggcagctggagctgagacccccaccaggctcatggccctttcctactcctcagttccttaaaccccacccccaagccaagctagggaggctgaggcaggaggatcgcttgaggccaggagttcaagatcagcctgggcaacagagcaagactctgtctctaaaataactttttaaattatttttaatttttttggccaggcgtgatggctcatgcctgtaatcccagcactttgagaggccaaggcgggcagatcacctgaggttaggagttcaagaccagcctggccaacatggtgaaaccccatctctacttaagaaatacaaaaattagctgggcatggtgggtcatgcctgtagtcccagccactcaagaggctgaggcaggagaaccgcttgaacccaggaggtggagattgcagtgagccaagattgcaccactgcattccagcctgggcaacaaagggagactccatctcaaaaaaaaataaataataaaaataaataaatcattttaaaatttttgagctgggagccgtggctcacacctgtaatcctagcactttgggaggccaaggccggcagatcacctgaggtcaggagttcgagaccagcctggccaatatggtgaaaccccatctcactaaaaatacaaaaaattagccaggcaccatggtgggtgcctgtagtcccagctatttgggaggttgaggcaggagaattgcttgaacccaggaggtagagattgcaattagccgagatcgcaccattgcacttcagcctgggcgacagagcaagaccctgtctcaaaaagaaagaaagaaaatttaaaatatggcggtactcacctgtggtcccagctactcgggagggtgaggcagggggatcgcttgagcctaggaattggaggctgcagtgagctataatcgcatcactgcaccccagcctgggtgacccagagagaccctgtgtcaaacaaaacaaaacaaaacccacccccatgaggacagggtgacagactctctggctttgagcatccgagtgggacgtgacatctgctcactctgtttgaacgatgggcaggatctgagcctgagaggggtcagcatcctcctcccacaaagtgcatcacccttacgcctcctttcccaccctgggatcccctctgaccccctttcctttctctgttgcagcattctgtgtctggctgactctgccgggagctgaaacccaggactccaggggtgagtctgctgggaagcagaaagcacagtccacagccagagcctggggagggtcctggacccccgcccagcccccttcagcccagggaaagagagggctcgtgcacgggaaactcagcgctctgccccatctcccccagtgccccctttttgtgtattcccttacccctcaccttctgaccgtgctccctgctcttgcaggctgtgcccggtggtgccctcaggactcctcgtgtgtcaatgccaccgcctgtcgctgcaatccagggttcagctctttttctgagatcatcaccacccccatggagacttgtgacggtacagaggcttgagggcagcgcaggggacatctgcgattatgaggcatagcccagtgccagtgggggacagaggttgttgtgaggggccacagccttaccttccagactatcatcatggccagagaaaagagaaagagggcaggtgtggtggctcccagcactttgggaggcagaggcgggtggatcatttgaggccaggaattcaagaccagcctgggcaacatggtgagaccctgtctctacaaaaaatacacaaaatagccgcgcatggtggcacacatctggagtcccagctactcagaagactgaggcgggaggattgtttgagcccaggagtttgaggttgcagtgagctatgattgcaccattgcactctagcctgggcaacagagtgagatcctgtctcaggaaaaagaaagaaacaaagaaagaggccaggtgtggtggctcatgcctgtaatcccagcactttgggagggattgtctgggcaacaggagcaagaccccatctcaaaaaaaaaaaaaaaagacagaaagagagaaggagagaaagaaaagagaagaaaagaaaaagagagagagggagggagggaaagaaaaaggaaaggagggagggagggagggaggaaagaaggaaggaaggaagggaggaaaaaggaaaaaatatgaagggggagaagtaagaagtgaataggcatggcttcctggagagagagaagctgcgtgctcaggaatctggagtctgtgcctcagtttaccgttaagactgggaagggggtacattctggccataggtttttttttctcccttatttttcttttttctttttttttttgttttttttttttttttttgagatggagtctcactctgtcgctcaggctgaggagtgcagtggcgcgatctcggctcaccgcaacctccacctcccaggttcaagcgattcttctgcctcagcctcccgagtagctgggattacaggcatgcaccaccatgcccggctagtttttgtatttttagtagagatggggttttgccctgttggcaggctggtctcgaactcctgacctcaagtgatctgccggcctcggcctcccaaagtgctgggattacaggtatgagccactgcacccggctgccatggggtttaaatttctacaaaaagactggggatggggatatggcgcttcctgtccatcccccacctcagcactgtccactgtgtccaaatctaggatgccagccagagaactgagatcaagtgtggtcttcaggaatggcctgctccagctgcagcatagcctgtgcagtgcaacttgagatcctttccaaaagatactaagcagcaggccccatgttggggagtcaggacgggggtctctgccctgacggaactcacatctttgggagatgacctcctgtcctgttgtgttccagacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaaggtaagaaccaccccacatcctccatcaccactgtccatgaggtttggggtcaccagagctgtttctgcagcatccagggagcaggtacccaagtataggttcagttcctggagtctgagatgagacaggtgtgcatgtacctgtttcgccagcccagagaggcagcgtggtgtgaaggccaagggaaaactctgggaccagctacctgggcccaaatcctggctttgccacctgttacctaaatgatattaccaacatcactactgctcttagagccttggtttacccatctataaaatgaggatgataataatggcctactcctatgccttctaggaggaccaaggaaagaataggtgcttctaacagagcccagcacacagcaggtgctacaggcatcttcattctttaaacgttattatgcactgtaatcccagcactttgggaggccgaggcggatggatcacggggtcaggagatcgagactatcctggccaacatggtgaaaccctgtctctactaaaagtacgaaaattagccgggtgcagtggtgggtgcctgtaatcccagctactcaggaggctgaggcaggagaatcacttgaaccagggagtcggaggtttcagtgagcggagatcgtgccactgcactccagcctggtgacagtgcaagactccatctaaaataaataaataaataaataaataaataaataaataagcaatggatgccttttaggagttgttcagacaagctgggctcctgtggggccacactcctggctggcactcagaagaaatctatttcgacacagcctgcctcatcccttgccatggtcttattccacactgcagctccagcccatgagaagccaggcccccatgcatcactctgctttgccttctttccagtgggaactagttgggtgcgggagggagcttcagacatctgcaaggccagatgggaaccagtagcaggtggacagagaagggagattaacacagagtacacagagtgggaagggaaggtgagcaaaggcaggaaatgaagaagctgaggctgagccaagggtcccaggggacattaagggggttcagcagacctgccctgctgtaaagagaaaagtggcagtgctcctgttcccagccctgtccctcctgttctccctgcagtcagtagagcctccctggtgggaggaaagtgaggacagagcagaggtgtacgttctgagagcacgcagctgcatagagcccagcaggggggctggttcacaggggtcccctgtgaacagatgctacattgcatgcacatatcttgaccaaaggacagagccttcctgtgaattagaaaaaggactctccgggccaggcacagtggctcacgcctgtaatcccagcactttgggaggctgaggcgggtggatcacctgaggtcaggagttcaagaccagcctgacaaacatagtgaaaccccatctctactaaaaaatacaaaagttagccaggcatagtggtgagcacctgtaatcccagctactcaggaggctgaggcaggagaatcacctgaacccagaggcagaggttgcagtgagccaggatctcaatattgcactccagcctgggtgacagagcaagactttgtctcaaaaaaaaaaaaaaaaaaaaaagaaaaagaaaagaaaagaaagaaacaaaaagaaaaagagaaacagaaaagcctctcctctccaggtagacacagccccatttggggaatggagaggttttcagcctctgctcaccgccttggctgggcatccatatgtagtcagcaacctacacaactgtacgtggtggtcatgggtccttgtcagtgagagcctctgttttagtctatgttgtgttgctataaaggaatacatgaggctggatcatgtataaagaaaagaagctgatttggctcatggttctgcaggccatgtaagacacatggctccagcatctgcttctggtgagggccttagggagcttccactcttggcagacgggaaaggggaagctggcatcccatggcaagaggaaggaagcaagagagaagggaggagataccaggctttttccaacaagcagttttcatgggaactaacaaggcgagaactcactcatgacccaaggacagcaccgagatgttcatgagggatctgcactcaggacccaaacacctcccacgaggctccatctccaacactggggatcacatttcaacgtgagatttggaggggacaaatatccaaactgtatcaccgcatgcacaggtggtgtttgtaattattgaggaggtgtgttgccatgttagaaacaggccagcactggctgggcgcagtggctcatgcctgtaatcctagcactttgggaggccgaggtgggcggatcacaaggtcaggagatcgagaccatcctggctaacatggtgaaaccccgtctctactacaaatacaaaaaaattagctgggcgtggtggtgggtgcctgtagtcccagctaatcagagactgaggcaggagaatggcatgaacctgggaggcggagcttgcagtaagccgagatggcaccactgcactccagcctggacgacagagcgagactccgtctccaaaaaaaagaaaagaaaaggagagaagagaagagagaaaagaaaagaggccaacactgagagagggggcttagttggtggataggcagagacacagatgagcaggaatgaagtgggagagggctctcatggaccccatccgcacagaacagcctgctagttcggagcaggacctgcctcttgaagcctcagctcagggaagggctccgtggggccctgtctgcatccccctcacccctcagcattcttgttttttttgtctacctggtgtcacaggcctcataggcaggagacctggggccactccctcagctccttgccccacttactccaggcatcacagggccgtcccaaacacctggtcacctgtcgctatccaaacctcaaggttcagaaccctccacagagggtcacttccaaaagctcagaacatccccctgcccatctggcatcttatttgtttgttttgttttgttttattagtaaagatggggggggggtgtctcaccatgttgtccaggctggtctcgaactcctggcctcaagtgatccgcccgtctcagcctcccaaagtgctgggattgcaggcgtgagccaccatgtccgacctggtatcttatttgtacaaaacaaaaagggggctggcactcaggatattcgatgagctcactgcgtggtgcattccagcgcagtatccattctctctgctatcatcagcgactgccaggatgagacagtctccacacagctctgctcacctggaactctctctgatcccccagctcatcatggacccaggcaccctgtccagaaatgaaggaggagggagatttgaaggcagggccactgtccccagtcgaacctgccactggccaacaaccccacctggagaagatgcctcgtggagccctgacctctttttctgccactcagtctctgtccctttcactgagcgagactgccctgacccttcctgatagttttggtccacctgagtgcactggaggatgttgtggctaacggtgggcacagtgacatggactccccatacttggagagttgagtgaatggaagaggcactagtgtggacccaatggcaagagaggttaacatcagggccattgctccaagcctgatcctctcccaggaggtcaacccagatcccatgggagtggaaccattcagaaataggtctgtgtccctggtggaatgccaagagatgagatgacagatacacctccatctttgcccatcagcatctgtgcccctctccagccactaaaccttcacccagggccagtctttctcagctatggattctcactacatcctgccatttccaagacaccttcctgaggatcaaaaaaaggcaccttcacagccctggggcaacccagctgtatgtcggtccccactgtccaccctggcctgggacccactgtccaggcagccctggcctatgcagcaccagactcatgctcccctggggactggttcaggggccagtcttggtccatgtgcctggagctgggctctcagagctagtgtggatgggagagcaccatcctgctagggccaccgggattctgataactcagccagtgagcagctgtcctggggaaatcaaggccaccagaagcagatgctggagccatgcatcttacacagcctgcagaaccatgagccaaataaacttcttttcttgcaacacaaaacggactaaaccagagggttctcactgagaaggacccatgaccaccatgtacagttgcataggctgctgactgcatatggatgcccagccaagagggtgagcagaagctgaaaacctgcctactctccattcctcaaatatgactgtgactacttgaagaggagatgcctttttccaattcacaggaaggctctgtcctttggcccaggactgccactgggaaccaagacaggtcctacctgggcaagcagcatgccccctgcacttggtcccaagaaaatcccaccctgacctttgtcctgaatcctcaggctgggacatccctgccccagctgggagctgcccagggaggcaggggagatggggaggactcagatgcttccagccatatctgaacaacagaaggcctgggccaccatgctcaccatgggacacctctgtgtggattagaaaagggaggagatggccaggcatggtggctcatgcctgcaatcccagcactttgggaggccgaggtgggctgatcacgaggtcaggagatcaagaccatcctggctaacacggtgaaaccccgtctaatactaaaaatacaaaaaattagccgggcatggtggcgggcgcctgtagtcccagctattcgggaggctgaggcaggagaatggcgtgaacccgggaggcggaggttgcagtgagttgagatcaggcaattgcactccagcctgggtgacagagcaagactccgtctcaaaaaaaaaaaaagaaagaaagaaaagaaaagggagcagacagtggtgccttccagatgcttccatgccaggaaacatggcggaccctcagccccgaaagctgctcacagctacgggcattcttcaccctctccttcctcttgcagatgtggacgaatgtcagcagaacccaaggctctgtaaaagctacggcacctgcgtcaacacccttggcagctatacctgccagtgcctgcctggcttcaagttcatacctgaggatccgaaggtctgcacaggtagaggccccaggaagacgctgtgaggctggacgggagctggggatggagctgagtcaggtcctccaaagcagccgaggaggagggagaagatccgcaggttcccacaaggtcaaggacctgctaagcccctgcctaaggattcacctcccaggaaggtctcgccacacggcagggaggcggcagggccttcagggcttggagtgcccttgtgggcccccagacctcaccccttcctcatctgtcacgtgcgagtggaagaaggtgtcacttccagttctaagaaggggaacctccaccatagtgagggagggagcaggagagagattttagtcagaaagtccagctcccatgactcagtttcccttttggtttcacctcctataaactggggaccatggtccctgctgtgcccatctggtaggaagaccatcataagatgctttgaaggtgaagttgaaggtcaccaagtggtggcacgtgcaataatggtcttcagtctgaggcaatgaaaagataggggagtgggtgcagtgagtggagggcaggcccaggctggtcagggacagggtttgaccctctggctttgtcctcagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaaggtcgagagctcagatcccacgttcccagagacccacaaacatctgatcacatgttcaacggcgcccacacaaaccaagcagaatgagcgctggaggcgcccgactgtgtcaggcgttcattcttctgaggctagatgagaaaagagcaagggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggtcaccaagtggtggcacgtgcaataatggtcttcagtctgaggcaatgaaaagataggggagtgggtgcagtgagtggagggcaggcccaggctggtcagggacagggtttgaccctctggctttgtcctcagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaaggtcgagagctcagatcccacgttcccagagacccacaaacatctgatcacatgttcaacggcgcccacacaaaccaagcagaatgagcgctggaggcgcccgactgtgtcaggcgttcattcttctgaggctagatgagaaaagagcaagggtcctgcggaaggagctggggtactgaggggggaggctcagggggaccccaggcaacagctgatgactcactgggaggaaggcgtttcaccatattcataacctgctcatctgcacggggcccacctgctgtgcccaggcctctccacgcttccataacccagcgtccacctctccaaggggggcactaatgccgggaggaacgagctgggggcacagacaggagacaggaccctctccaggctgggacaggacctgacccccttcttcctgtcctcagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaaggtatgacctggccctagaagctccccacccccagcacacacactgacacgctcccgcctaatgagccgcttgtcttgttccctacagatatgactttctccacctggaccccgccccctggagtccacagccaggtgagtggcccccacagggacgaggcggcgggaactccatccacacagcactgcatccgtctccttgttctaaacttcccacccgccgtccaggctctctgacccccacatctcctctctctgcagacgctttcccgattcttcgacaaagtccaggacctgggcagagactacaagccaggcttggccaataacaccatccaggtaaggacaggacccagggcaagggggcgaggcaggaaggtggctgcatcccacagaggcctggggcagtttgggtctgggaggggacaggacccaatgcagtgggtgctggtctgactcccagcatctttcagggctggtggaagctaatggacacccaagtgcacttaatatctttcctcttgctttccctggactttgggtttaggtcagcattgatattgcacagaagtgttggcctctgaggggccataaccagagtcaaggatcacctagggaatcccatccaatgtcattttttttttagacggagtctcactctgtcgccagtccagagtttagtggcccgatctcagctcactgcagtctctgcctcccgggttcaagcgattctcctccctcagccccctgagtagctaggattacaggcacacgccaccacgcccggctaatttttgtatttttagtagagacggggtttcaccatgttggccaggatggtctcgatctcctgaccttgtgacccaccctcatcggcctcccaaagtgctggaattagaggcgtgagccaccgcgcccagccgccaatgccatcttcatcccccagatagacagtctctaggatctgttccctggggctgagcggttggagtcttcatgcgggccctctggcccatggctcactaggtctgtgtccacatccctccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacaggtaggtccctgggtctgccccagactccagctctgcatgttttatgtctccttcctttcccagtcccaccagagccaagtgaccacacctgtatatcagtgttactctcatcgacaaactaaaataagagattaaaaagaaatacataccagtctggacaagatggcaatactcaatctctacaaaaaaaaaatcttttaaattagacagatgtgatggcacaactgtggccccagctagttgggaggctgaggtgagaggatcgcttgagcccaggaggttgagtctgcagtgaactatgattgcatcactgtactccagcctggttcacagggcaagaccccatctcaaaaaagagaagacgaagaggaggaggaggaagaagaagaagaagagaaggaggaggaggtgaagaggaggaggaggataaagaggaagaaaaaggaggaagagggcaggagggggaggacagaaggaggaggacaggaggagaggaggggaggaggaagaggaggaaagaggatgggaggaggaggacaagaggaagaggacgggaggaggaggacaggatggggaggagaggaggaggagagaaggaggaggagaggaggaagaggaggaatggagaaagagaggaggaggagaaaaggaggaggagaggaggaggaggagaggagaaggaggaggaatggaggaggagaggaggcagaggaagataggaggaggagaaggagaagaggaggagaagagaaggaggagaggaggaggagacgagaaagagcggaggagaggaggagaggaggaggagcacaggaggaggaggagaggagtagaggaagaaggaagaatagaaagaaggaaaggaaaggaaaaagaaatgcataaataacatgcattttcattgtaatatgaattatcagcagtaaataattatgatgaagaatttaaaataacaaaatagaaatcacttcaaaagagaacaatttatttaatttggaatactataaattaatatcatttgatctctaagtatgatttctttcttgtttgtttttgtttgttttgttttgttttgttttgtttttttgagacagagtctcactctgtcgcccaggctggagagcagtgacgtgatctcggctcactgcaagctccgcctcctgggttgacagcattctcctgtctcagcctcccgagtagctgggactacaggtgcccgccaccacgcccagctaattttttgtatttttagtagagacggggttgcaccgtgttagccaggatggtctctcgatctcctgaccttgtgcataatccacttgcctcggcttcccaaagtgctgggattacaggcgtgagccaccacgcccggcctgcataataatttttaaagcatgaaaatgcatatagcattaattttattaagataaaattcacataacatcaagttcaccactttaaagtgtctgtttcacgtggggcgtgcctgtaatgccaggcgctcacacctgtaatcctagcactttgggaggctgaaatgggtggatcacttgaggtcaggagttcaaatccagcctggccaacatagtgaaaccccatctctactgaaaatacaaaaattagacaggcgtggtggtgcacacctgtaatcctagctactcaagaggctgaggcaggagaatcacttgagcttgggaggcagaggttgcagtgagccaagtttgcaccactgcactccagactacgtgagacagagtgccactccatctcaaacaaaaaaattaaaattaaaaataaaaataagaaaaaattttaaaagcgtgtgtttcggtagaatctagtatattcagaaagttatacaaccgtcacctctatttctaaaatgcttgcatcagcccaaaagtgaacactgcacatggtaagcaaccactcctcattcctcccttcctccaacccatggcagccgctaatctgctttctgtttccatggattttcctaatcaggatatctcacataaatggaatcatacaatatgtgaccatctagtctagctcctttcacctagcataatggttttgaggttcatgcatgccatagcatttatcaatatttcattctttttcatggctgaatactattctattgtatgaatacatcactttttttttttttatccatccatccattgatggacatttgggttgtttccaccttttggctgttgacaaaaagagtcaaactctgtaaaatatttgaagagatttattgtgagctaaatatgaatgtatgactgaccatggcccgtgacacagccctcaggagcccctgagaacatattcccaagtgaagtggtgttgttttctggggtaatacctgaggttcattgcctcatgccaagaaaattaaggacacagacacacaccaggagtgagtttatgagtggaggtttaataggcaaaagaaagagaaaggagaacaactctctctcttgtgagagaaaggaatgcccaaatgggacttcccacccatgccagagggcaccggattttatagacaggcttgaggaggcagtgtctaatttacatagggcccaaagattggttggaacaggtgtgacgtttacataaggtgcagggaagctggctgccccaccctaatcttattatgcaaatggagtcttcgccagctccttactgtatacgtggttggcaaagagatgggaagatggagccgccattttcaacatgcctagtcccaggtggccttttcctattggcacagctgccagcattcacctgtgcaggcttccagcttgcttgcctatgtctgcagctcgattttacaggctgctctttgttagaaaaaaaaaaaatgatataggggctgattttcattaaaaggaaagacttacccaggacttccttacccacactctctgcctaaataattcctttttaacttctatatcacaaggtagtcgtggtacagcttgttgtgattgttgttgttgttgtcttctgttggagacagagtcttgctctgtcaaccaggctggagtgcagtggtgcgatcctggctcactgtagactccacctcccgggttcaagcgattctcctgcctcagcctcccaagtagctgggactacaggcgcccgccaccacgcccggctaattattttgtgtgttttcagtaaagacagggtttcgccatgttaaccaggatggtcttgatgtcctgacctcgtgatccgcctgcctcggcctcccaaagtgctgggattacaggcgtgagacaccacgcctgcccccgcaacttggttttatacattttagggggacatgagacatcaatcaaatatgtttaagctatacattggttcagtccagaaatgcaggacaatttgaagtggaggtgtggggcgggtgcttccagattataggtagatttaagcttttctgattggcagttggttgaaggagttattatccatagaaaagaatgtctggaatacgataaggggctgtaaaggctgaagttgtatcatccagatgaactcttcaggtatcaggcttcagagagaatagatggtaaatgtttcttattaagcttcaggtctgtgttatgttaaatgctggtcagcttttcctcaactccaaaagggaggagggcatgacacatgtcagaccccccacttcccaccatagcctgaactagtctttccagttaaatttagagtgccctggccaaaaaggaagtccattcagatggttttgaggggggcgggagaggacttcgaattttttttttttgtttagatggctggtgtgaatagtgctcttatgaatattagtggacacattttgggttgaataactgtcttcagttctttggggtatatactaaggagtggaattgctgggtgatatggtaattctatgttcagcttttggaggaaccaccaaactttttccaaagcagctgcatcattctaattccccaccagaaacatacacgggttatcctctccacaccttcagcaaaacttgttacttccgttttcttttgttctgtttttaattgcttttattgatacataaatcttacatatttatgggtacatgtgatactttgttgcttgcctagaatgtgtaacgatcaagtcagggtatctcaggtatccaccactttgagtacttatcatttgtatgtgttgggaacaattgaagtcctcttttgtaactactttgaaatacatcatacagtcttgttaattatagtcactctgctctgctgtcaaacaatagaacttgggccgggcacggtggctcacgcctgtaatcccagcactttgggaggccgaggtgggaggatcacgaggtcaggagatcgacaccatcctggctaacagggtgaaaccccatctctactaaaaatacaaaaaattagccaggcgtggtggcgggtgcctgtagtcccagctactcgggagactgaggcaggagaatggcgtgaacctgggaggcgaagcttgcagtgagccaagatggtgccactgcactccagcctgggtgacagagtgagactccgtctcaaaaaaaaaaaaaaaaaaaaatctgcttaataagcggagaggtggctggcttggtggctcacacccgtaatcctagcactttgggaggtcaaggcaggcagatcacctgacatcaggagtttgagcccagcctggccaatatggtgaaaccctggctattaaaaatacaaaaattagctgggcttagtgacacgtgcctgtaatcccagctacctgggaagctgaggcaggagattcgctggaacccaggaggcagaggctgcagtgagctgagatcgtgccactgcactccagcctgggtgacagagtgagactccgtctaaaaaaaaaaaatatatatatatatatgtataacttatactttttgtctaactgtatgtctctacctgttaactcacctctcttcatcccagtgatacaggagtgaaaaagaaattatttaggcagttagcaagggtcagagagtcctcagtaaggtttcccttttaataaaaaccagcccccaaatcatttcttttctaataacgagcagcctgaaaattcgagctgcagacatagaaaagcaagctggaagcttgcacgggtgaatgccggcagctgtgccaataggaaaaggttacctgggggcccggcatgttcaacgtgggggctccctcttcctttatctttgtcaaccacgtgtacagtacagaagcaggcaacgtggagccagccaggtagagaatccatttgcataataaaagattaggctggggcagccagtttcttcatgctgtatgtaaatggctcacctgttcagaccaatctttaagccttatgtaaatcggacaccgcctacccaagctcatctataaaacttcgtgcatttcaccacgcaaccggaagacccacttgggagcccctgtctctctgcaggagagggagttattctctttttcctttttttttttttgagacggagtcgtgctgtgtcccgcagactgcagtgcaggggcgcgatctcggctcactgcaagctccgcctcccggggtcacgccattctcctgcctcagcctccggagtagctgggactacaggcgcccaccaccatgcccagctaatttttttgtatttttagtagagacggggtttcaccgtgttatccaggttggtctcgatctcctgacctcgtgatcctcccgcctcagcctcccaaagtgctgggattacaggcgtgagccactgcgcccagccagagctattctttttttctttcgcctattaaatctccactcttaaactaacttcttatgtgtccacatcctcaatttccctggtgtgaaacagtgaaacttgggtatttacaccacttcactagtgagatgatacctcattgtggttttgatttgcccttccctgataactaatgatgtttaacatcttttcatgtgtttgctcaccatttgcatgtcatttttggagaaatgtctattcaaatcctttgcctatttttaattgtgctgtttgtcttttggttgtccagttgtaagcattctttaaacattctgatagtagatcatctgagatgaatgatttgcaaaatattttctcccgttctgtagattgtcttttcattttcttgtcttttcactttaatgaatagaagttttaaatcttgaagacatttattttatctaatttttcttttgttgcatgtgcaattggtgtcatatttaagaattcattgacagggggtggtggctcacgcctgtaatcccagcactttggaaggccaatgtgggcggatcacctgaggtcaggagtttgagaccagcctggccaacaaggcgaaaccctgtccttactaaaaataaaaataaaaataattaaccagatgtgttggcacatgactgtaatcctagctactcaggaggctgaggcaggagaattgcttgaacctgggacacggaggttgcagtgagctgagattgtgccactacactccagcctggatgacagagcaagactctgtcccaaaaataaaaataaaaaaagaattcattaccgcatccaagaccaggaagatttacccctgtttcctcctaagtgttctagttttagcttctaagcttaggtcactggcttattttgagttaatttttgtttgttgtgtgagggtagggttaaaacttccttattttcatgttactatccagtaatcccagcactatttgttgaagagattattctttcccccattgtatagtcttggcaccccttgttgagaatcaactgaccataagatggatgggtttattcctggactctcaattctattctgttgtgtccttatgccagtattactgtcagtttgtagtaagttttggaatcaggaagtgtgaattctccaaccttcttgttcttcttcaagattgtttttgggtatttggattccttacaacaccatatgaattttaagatgaacttttcttattctgcaaagtaataataggctaaaatattgatagggattgcattgagtctctagaccactttgggggagtattgttatcttaacaatagaaagtcttccaatccatgaacataggctgtctttccatttagagagggccttttatttctttcaaacacttttgtaggccagaagcagtggctcacgcccaatattgtcagaggccaccaaggtgggagaattgcttgagcccaggagttcaagcccagccttggaaatatactgaaacatgatctccacaaaaaatttaaaaattagctggctgtggtagtgagcacctgtagtgccagctacttgggaggctgaggtggaaggattggttgagcccaggagactgcagtgagctatgatcatgccactgcactctagcctgaccaacaggtgagaatttgtctcaaaaaaaaaaaaatactcaaaaaactttcctataagtcttgagtctccttcgtaaaatgtattcctaacatttttgctgaaaatttttgcatctatgtccataagaaatattggtctataattttattttcttgtgatgtcttcatctggttttgttatcagagcaatattagcctcataaaattacttaaatagtgtttcctcctcttccatatttttaaaaaggtaaaagattcatgttcattctttcttaagctattggtagaactcaccagtgaagtcatctggtctgggctgttagttttgagaggttttgattactgatttaatctgttataggtctgttcagatcttctatttcttcttgagttggtttcagtggtttgtgtgtcactaggaatgtgtccatttcatctaggttacctactttgtagatatacagttgctcacactattctcttccgatattttgtaacttcagactatatatgtatatagtatatatattaagtcatagtatatcaaccactgcaggcacgattcctaacctaaccccccttatgtaattcccacaactcatagaattgtccctggaggtgcagaagcaagtagacaggagtgtcaccttgagacagaatcaggcagtgatgcagctcgactggaatcaggcacagaaatctggtgacccaggtaatggctgagatggggaggtggtcagtgaagcttcatggtgggaaaagatgcccaagaatgtgaaaaataagagatttaaagattaaagggaagtgtgggatgtttggagtggggctgtaagaggagagtccagctgaggaggaacggaccttgttggggaccctgagatattaaccgtggccttgtcctgcaggatgtgatacacatagaactaaagattgaaggaaagtgtgggaggggtgaagccaaaggaaggtagcccatctgagtagaaagttctgtgcagggcagaggaactctggtgtggacccagagattcaacctactccaagattcaaccttggcctcgccctgcaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgtgtgagtgctggtggagttggttggtgggtgaatagtctgagtccgggcatagccttgctgctcagctcagccctggggctcaggggtctctgttatgggtacattatctccccaggaaagtcagtccttcccaagccggctttgggtaagcatttctgagcatccgacccaccagctcacacctgtgttcttttttttattgagacagagtctcgctgtgtcagccaggctggagtgcagtggcacgatctcagctcactgcagtctccgcctcccaggttcgagcgattctcctgcctcagcctccctaatagctgggactacaggtgtgtgctaccacgcccagctaatttttgtttttttgttttttttttttttttagtagagatggggtttcaccatgttggccaggctggtctcaaactcctgacctcaagtgatccacctgcttcagcctcccaaagtgctgggattacaggcgtgagccaccatgcccagcccacacctgtgttctgttcctgcagtcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggtgagacccttaggaggggatgcactctgcatttattgccgtgtaacaaatccccagagacatagcagccttttaaaaaaaatatatgcattatctcacagctctgggtcagcaagctggcatagcaagatggcttttctgctcagggtcttacaagactgaaatcatcatgtcaccccacccccagggctgccatttcatctgagacttgaggtccttctccaagctccctggttgctggcagaattcagtttcttgtgattgtaggactgaagtctcactttcttagctgtcaggaaggcatcacattcagttcctagaggccactcatatcccttctcacatgaccctctggcaaacttctagcattcctatctggaggacaaggaaaaaaatttcctcacgcagaatccctcttaagctttgtattagtcgaggttctctagagggacagaactaatggaatagatagatagatagatagatagatagatagatagatagatagatagatagatagatagataatttctgcctgcttatattctagccacactggcagctgattagatggtgcccacccagattaagagtggatctgcctttcccaacccactgactcaaatatatacatatatagagatatatagagagagatctatatatatagatatatataaaggggagtttattaggtattaactcacatgatcacaaggtcccacgataggccgtctgcaggctgaggagcaaggagagccagtccgagtcccagaactgaagaacttggagtctgatgttcaagggcaggaagcatccagcacgggagaaagatgtaggctgggaggctaggccagtctctcttttcacatttttctgcctgcttatattctagccacgctggcagctgattagacagtgcccacccagattaagagtggatctgcctttcccagtccactgactcaaatgttaatttcctttggcaacaccctgatagacacacccaggatcaatactttgtatccttcaatccaatcaagttgacacccagtattaaccgtcacaagttttgaatctgattctccaggaagagcccagagcttataaagactcatctgattaggtctggcccacccagggtaaactctgccttttttttttttttagacagggtctctgtcacccaggctggagtgcagtggcacagtcatagctcactgcagccttgaccttctgggttcaagggatcctcctgcctcagcctcctgagtagctgggactacaggcatgcaccaccatgcccggctaatttttgtatttttactagagatggggtttcaccaagttggccaggctggtctcgaactccttacctcaagtaatccacccgcctcggcctcccaaagtgctggtattacaggcaggaaccaccacacctcgcccacctgactttcttatctcatcacttagagtagatccaagggacatcatcatcatatcctgcgggagaaagggccaaaccacccttttgttttccatgacaggaacatcttatcaatatcctcccaggcagcaagccataccgcccagcccctcccgcccagacctgtaattaccccagcctgtaagcggcagtgggttctggcacgaagctagctcccccctccacaagtctcgtgctggacataaacctgcattgctgtagagctgccaactctctgtctttctttaactctcactttcccttcaaaacctaacgggcccacacctggaatctctgtgctttgggaggctgaaacgggaggatcacttgagcccaggaattcgagaccagcctgtgcaacacagaaagaccctgtctctacaaaaataaaaaaaaaaattaggacgggtgtggtggctcacgactgtaatcccagcactttgggaggccgaggcgggtggatcatgaggtcaggagttcaagaccagcctggccaacatggtgtgaccctgtctctactaaaagtataaaaattagcctggcatggaggcacatgcctgtaatcccaactacttgggaggctgagacacgagaatcgcttgaaccgaggagacagaggctgcagtgagcagagatcgcaccactgcactccagcctgggcgacagagcaagactgtcaaaaaaaaaaaattagcagggcatggtgccatacatgactataatgcacacccgttgtcacctacatgactacgcctgtattcctagccacccatgaggctcgggtgacaccttcgcaaattaaattaaattggtgacatcttcacaaatttacctggctccctcattcttgaatgtgctatgccaaagtaaaaattttaaatggtggtggggtcattaccccagagcaggaaagcatcactgtgaactcttcttttccgggtcccaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtattgacagcggtgttccagagggctcccttccttgacgcaggacacgctggctcatggaatgatgcggcatttgattccttaatataatagcccggctgggcgtggtggctcatgcctgtaatcccagcactttgggagactgaggtgggcggatcacctcaggtcgggagtttgagaccagcctgaccaacatggagaaaccccgtctctactaaaaatacaaaattagccaggcatggtggcgcatacctgtaatcccagttactcaggaggctgaggcaagagaatctcttgaacccaggaggtggaggttgtggtaagccgagatcgcaccattgcatgccagcctgggcaacaagagtgaaattccgtctcaaaaaaaaaaaaaaatatatatatatatatgtgtgtgtgtgtgtgtgtgtatacgtatatatacatgtatatatatatataggcccttgagtcctggggaatattagaagagaacaccaccaatttcccattgcctgactcaactacacagcaaatattctctataatgccatcaaatatctcagaattctccccaacaacttggtacaggagaagccatgggccacactcaaatctgatcgccgctctgggcgtcttttacttctccgccaggtgctgtgctccatcatcgccggtaccttgcactatctctacctggccaccttcacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccggttagtgcaaattctcacaatccttatcttctccggcataaccatggccattgctagaacctagatagcatttttatgacacctgcttttaattagatcagtagggattttaggctctattggttggattacactgcagctccttattcttagctattgagtttatttcaattacatttcaagctaggcattgtagaagagggttttcggaaattttctgaatgaaataaagggcaagcctttggaaagcacgaataggacaaagacactatgtcataatccctagggcatctttctgctagaagattataataattaaggagggtcaggctcagtggctcgcacctggaatccctgtgctttgggaggctgacacaggaggatcacttgagcccaggatcttgagaccagcctgggcaacacagcaagaccccttctttacaaaatttaaaaaattagcagggcctactggcacacacctgtagtcctagctactcaggaggctgaggtgggaggatcgcttgagcccaggagttcgaagttgcagtgagctatgattgcaccactgcactccagcctgagcaagagagaaagaccttgtctctaaaaaataataataatagttagggataatgcatttaaatctgtctcactgaaatagtaagaatgaaatcaaagtgctcaagacagcattttttaaaaatctaacctactttatctaaatcttttaggatactccaatttttcatttgaaaaagtagacctgatttgaataactaaaataattgatattgtcatagttaagatttatgagatgcttactttgtgccaggtacttttctagctagtttgtttgtttgtttgtttgccaattgcactggttgaaacctccaggacactgttgactagaacagcagacaattttgtcttgctcctgtacttagggagaaagcattgactctgtcctcattaatgtatgatgttagctgaggatttttcatagataccctttttcaggttaaagaaattcttttctattcctcatgtgttcggtattttgatgaagaaagagtgtttgattttgtcaaatgcttttccgaagcatataatttttaattatatggggtaaaaattatatgatcacataattagataatcatataattatataattatattagattattttatatgtaatttttatataaatatatatctatgtaatttatatattaatattatataactataaataattatataacatagctataaataattatgtaactatgaataattacataacatagctataaataattatgtaactatgaataattacataacatagctataaataattatgtaactatgaataattacataacatagctataaataattatgtaactatgaataattacataacatagctataaataattatgtaactataaataattatataacatagctataaataattatataactataaataattacataacatagctataaataattatgtaactataaataattacataacatagctataaataattatataactataaataattacataacataactataaataattatataactataaataattacataacataactataaataattatataactataaataattacataacataactataaataattatataaccataaataattatattacataactataaataattatattacataactaaataattatattacataactaattatattacataactataaataattatattacataactataaataattatataactatataactataaataatatgatcacattaaattgtataatcatatattatcatatcattataattatattatatataattatataagcataattatatgcttccttaattctttattttattaatacacatattaatagaataaaggattaaaattatatgatcacattataattatatggttatataattatatggttatatatgattaattatttacctttgagtcctggggaatattatatggttatatatggctaattatatggttatataattataatgtgatcttataattatatgattacataattatataactataatgtgatcatataactttaatcctttattctattaatatgtgtattacattgatggatgattagatgttaaactagccttacattcctgggataattaccacctggtcagggtatataatccttttaatatgttgcaggacttggtcggctagtatttttttgaggatttttgcattcattttcataagggattttggtctgcagttttcttttcttgtgatgtctatttctgggtttggtgtcagagtaacactggcctcgtagaagatttggaaagtgcttcctctttttccgtttttggttttgtgaactattaacactaatcctccaaaagttaaccatagagctaccatatgacccaggtatatacccaaaacaaatgaaaacgatgtccacaaaaaaacttgtacatgatgcagccataaagaataaggagatcggccgggtgcggtggctcacgcctggaatcccagcactttgggaggccgaggcgagcagatcacaaggtcaagagattgagaccatcctggccaacatggtgaaaccccgtctctactaaaaatacaaaagttagctgggcgtggtggtgggtgcctgtaatcccagctacttgggaggctgaggcacaagaatcgcttgaacctgggaggtggagtttgcagtgagccaagatggctccattgcacttcagcctggccacagagcgagactccatctcaaaaaaataaaataaaataaaataacaagatcatgtcctttgcaggaatatggatggagctggaggccattatcctaagtgaattaatgcaggaacagaaaatcaaataccgcatgttctcacttataagtaggagctaaacattgggtacccatggacacaaacaaggaaacttcagacaccgaagcctgcttgagggtggagagtgggaggagggcgaggataaataaacgacctatagagtactgtgctgatgaccagggtgacaaaataatctgtacaccaaaccgccacaacatgcattttacctacataacaaacctacaaaatgtacctctgaacctaaaataaacgtttagaaaaatgttgtacatgaatgctcatagaagcagtatttagaatagtcaaaaattggaaacaatgcctatcactgatgaatgaataaacaaaacgtaatatatccacaatgaaatgttattcagccataaaaaggaacgttaagagaccattcagtcattatttatttatttagaaacactctgtcacccaggctggagtgcagtggtgccatcttggctcactgcaacctctgctctctgcttcctgggttcaagcaattctcatgcctcagcctcccgagtagctgagattacaggcatgcgccaccacacgcagctcattttttgtgtgtttttagtagagaaaggatttcaccacactgggcaagctggtctcaaactcctgatatcaaatgatccacccgcctcggctcccaaagtgctgggattacaggtgtgaaccactgcacctggcctcattcagccattttaaaatgctgcaatataggtcttgctctgttgcccaggctggagtgcagtagtgcaatcacagctcactgcagtctcgacctcctggactcaagcgatcctcccacctcagtctcccaagtaactgggaatacaggtgtgagccaccacacccggctatttttttattttttgtagaaatggggtcttgctatgttgctcaggctggtctcaagctcttggtctcaagcaatcctcccacctcggcctcccaaagtcctggtgtgagccactgtgcctggcacaaccttccatttttgtttcattgtttgaatgtgtctgattgtgtgtatcttccttgagttgaaattttggggatctaagaccgtgttcattttctccaccactgtatcttcagagccaaccacagaccctatcactaaagaaacacttaatattgttgacgtaggaaggaagtgaggaagtggtgaggagggatggaatagatttacataactgttccatatctccaaaaactgatgcatttttttttaatctctcttttttcagctgctggctccaaccagaaaagggatttatatggggcttccttggacctgtctgcgccatcttctctgtgagtgacatcatctgagcatcctcgctgccccgctgagggtcattagaaaaacaagataataaagatggtgacaagagcaggaatgtcccctgggttgtcatgggttgggttaggtttcctaagaccactcttgaatcttcaaactcaacactgttactcaatatttaagaaaaagacttacgtgtataattcatattagacaggctaggatgaagagataatgggcttcaggcccggtgtggtggctcacgcctgtaatcccagcactttgggaggccgaggcaggcagatcacttgaggtcaggagttcaagaccagcctggccaacatggtgaaaccctgtctctactaaaaatacaaaaattagccaggcgtggtggtgggtgcctgtactcgggaggctgagacaggagaatcgctcgaacccgggaggcagaggtggcagtgagctgagattgcaccgccacactccagcctgggcaacagagcaagaccctgtctggaaaaaaaaaaaaaaagagataacaggtttcaaaatctattcaacaaatcttctgtggttttctgaaggtgaatttagttctctttctggtgactctctggattttgaaaaacagactctcctccctcaatagtgaagtgtccaccctccggaacacaaggtaagatggagaagggggtgataaccacacagacatgtatggttcccaagagccaagccatgtgcctcagcagccactgaggtcccttctcaggttcttttgaagggacccagaaaaaacagacgcagccatccttctatggcagccatcacagattcagtggtatcctgttgagaccccatgcaacatgttttgtccatgtctaatctcagtttgtgaatcccagagcaacaggaagaatcttcattgactggtaaatggtatatatacaaaataggatacgattcgatcacaaaacagaatgaaaccatgtcatttgcagcaacatggatgaaactggaggtcactctcttaagtgaaataagccaggcacaaaaagacaaataccacaggttgtcacttacatagagaggagccgaagaagctgatcttgtggaggcagaaagtagaatgataaaagttagccgggcatggtggcaggcacctgtagtcccagctactcgggaggctgaggcaggagaaccgcttgaacccaggaggcggaggttgcggtgagccgagatcacaccactgcactccagcctgggcaatagagtgagactctgcctcaaaaactaaaaataaaaataaagtagaatgatagattccagagtctggaaagggtatgtgagtgggcaaggtgatgaagagaggttggttaatgggtacaacatacagtcagatagaaggaataagttataatattggatggcagagtagggtgactctagttcacaatatgttgtatatttcaaaatagctagaggggagaatttgaagtgttcccaacacatacaaatggtagacacgcgaagtgacggataccccaaatactctgacttaatcatgacacactctatgcatgttaacaaaatatcacatatgtccccacaaagatgtacaaacattacgaatcaataaactaaaaggttaaaaacttctttggacttttgtcagcagtcctataacaaaagcacaaagaaggccgggcatggtggctcatgcctgtaatcccagcactttgggaagctgaggggcgggggcagatcacaaggtcaggagttcgagaccagcctggccaaagagaccagcctgaccaacgtggtgaaaccccgtctctactaaaaatacaaaaattagctgggcgtggtggcgggtgcctgtaatcccagctactccagaggctgaggcaggagaattgtttgaacctgagaggcagaggttgcagtgagccgagattgcgccactgcactccagcctaggtgacagagcaagactccaactcaaaaaaaaaagtgcaaagaacacgtacattttcttgcctgttcccacagcccagtctgcaccttcataccgtaccctcagttcaggctcctcatcacttctcatgcaatcctccctctgggaaaatcctaatcaacattaaatcctttacgggggccaggcatggtggctcacgcctgtaatcctaacactttgggaggccgaggtaggcggatcacttgaggtcatgagttcaagaccagcctggccaacatggtgaaaccccatctctactaaaaatacaaaaattagccaggcatggtggtgggcgtctataatcccagctactcaggaggctgaggtgggagagtcacttcacctgggaggcggaggttgcagtgagccaagatcacgccactgcactccagcctgagtgacagagcgagattccatctcaaaaaaataaataaataaaaataaaaataattcctctacagggtttgagcagtttgttgttccaggcacccttgtgcaaaattaatgaactttcttctagattcctatcattatcctttccaaattttgtgtctcatgcctggttgtattggtgatttgaagagactgtgtagttcatgaacacagaaatctctttgcatattcaaaaataatccttttttttttttgagacagagtctcgctctgtcactcccaggctggagtgcagtggctctatctcgactcactgcaacctccgcctcctgagttcaagcaattctactgccccagcctcctgagtagctgggattacaggcgcccccccgaccacacctggctaatttttgtatttttttagtagagaccaggtttcaccatgttggtcgggctggtctcgaactcctgacctcaggtgatctgcctgccttggccccccaaagtgctgggattacaggcatgagccaacgtggccaaccccaggtggcatttctactgtgggctatagttgacagtaaatatctaagctgaccacagcccagtctgagaaatcatctacaggggagggcaggggactccatgggcacagatgaaatagccttgattctctttctctgggtgcatcaccagcctcctttcttactcaatccaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtaccactgcccagctcccacccaggactcttcctgtcctcactgctctctgtgagctgacccagtacacactttgcctctgcaggtccgggagcaatatgggaaatggtccaaagggatcaggaaattgaaaactgagtctgagatgcacacactctccagcagtgctaaggctgacacctccaaacccagcacggtaagatcacgcattgctccagagcacttcactaaccgacccacctgaggagcatgtgcctatcacacaaggaaacctgggaatacagcaggcaatgccctagaaaggctcgcatctgagtacgccttgactcattaaccattagcaatgatctcagtttaaatgtttttttttaatcagtcatagcctgtcatcccggcatcactgtcatcccagcatttgggaggcctaggcaagaggatcacctgaggccaggagtgcaagatgaccctgggcaacatagcaagatcccatctctacaaaaaataaaaataaaaattagccagacatggtggcatacacctgtagtcccagctactcctcgggaggctgaggtgggacaatcacttgagcccagtaggttgaggctgtagtgagccatgatcatgccactgcactccagcccaggcaacagagtgagaccctatcccaaaaatttaaaaaaaaaaaaaaatccttggctcttactccttagggaactgtgcttagtttgactctcacacacaaacactcctattggacacctactatgtgccatgcatggttaactaaatgagcaggaattgatctgaagcagtgatgcacattctacctagaagcatttaccctatccctttcctctacatacaagtctatctcacagtcacttggcaccaccacccaataaggcaagcatgggaggaaatgctgtacatatttatgaattaaacagaaataagtgttaactgggatttaggctttcttaacaagtctgcctctaccaactaccacttagtagtgggtagtgggcagtgcctctactcagcaccctctacccactgcaaaactcagaaagaaaagcagtaatggggccagcgatggtggctcatgcctgtaatcccagcactttaggaggctgaggcaggacaactgcttgaggccaagagttcaagactagcctgagcaacccagtgacacctcgtccctataaagcatttaaaaattagctgagggtggttgtgtgcatctgtagtcccagcaactcaggaagctgaggtgagaggatcacttgagcccaggagtttgaggctgcagtgagctatgattgtgccactgcatttcagcctggatgacagcaagacctcttctctagaaaataatacaaataacaaaattaaataaataaagttttaaaaacacactgggcaacctgggaatcagcgggtgatgccctaagagggttcacatttgagcgactccttgactcattaaccattagcaatgatctcagtttaaatgcttttttataaatcagccaggaacagtggttcaagcttgtaatgccagcactctgggaggccaaagcaggaagatcacttgagcccgggacaacttggggatcacttgaagccatattatcctatgcctcaatggcatgggataattcatgacattgatgactaataaccaacatttattaatgtagacatacaaagttctgttgtatttttctcacctcttcttccatcttctccagattgtatgtgtaattctaaccccatttcactgatgagcaaagtaagactacttggatttgtgtcaaatgtacagagtctcggccaggcacagtgactcatgcctgtaatcccagcactttgggaggccgaggcaggtggatcacaaagtcaggagatcgagaccatcctggctaacacggtgaaaccccatctctactaaaaatacaaaaaaaaaaaaaaaatagccaggcgtggtggtgggcgactgtagtcccagctactcgggaggctgtggcaggagaatggtgtgaacccaggaggcagagctggcagtgagccgagatcgcgccaatgcactccagcctgggcaacagaacgagactctgtctcaaaaaaaaaaaaaaaaaaaagaaatgtacagagtctcttcagccagtgagatttaggcctcttgagtcttgcttcacatttaaagagcccattcagggccaggcaccgtggctcatacctataatcttagcacttcaggaggccaaggcaagcaaatcacctgaggccaggagttcgagaccagcctggccaacatggcaaaactccatctttactaaaaatacataaattagccaggcatggtggtgcacacctataatcccagctactcaggaggctgaggcacaagaattgcttgagccggggaggtaaaagttgtggtgagccaagattgccccatgccactgtactccaccctgggcaacacagcaatactctgccaaaaaaaaaaaaaaaaaaaacagcctattcagcctgggcaatgtaacgagaccccatctctataaaaaagttttaaaaattcgctgggcgtggtggcacatgcctgtagtcccagctacttgggaggcgagaggatcgcttgagcccaggagttggagaccaacctgtgcaacatggcaaaatcccatctctacacaaaatataaaaactagctgggcatggtggtgcatgcctataatcccagctgcttgggaggctgaggcaggaggatcacttgagcccaggagttcaaggccacggtgagctacgattatgccactgcactacagcctgggtgacagagcaagaccccttgtgtaaagtaaatacataaataataaattttttaaagtcttgaaaagaagcccaccatgctgccaggcactttttccacatttgcatttctctcattacctttttccttttttatttttcttttttttttttttgagacggagtttcgctcttattacccaggctggagtacaatggtgctatctcagctcaccgcaacctccgcctcctgggttaaagcgattctcctgcctccacctcccaagtagctgggattacaggcatgtgccaccaagcctggctaattttgtatttttactagagacgggatttctccatgttggtcaggttggtctcaaattcccgacctcaggtgatctgcccgcctcagcctcccaaagtactaggattacaagcgtgagccaccacacctggcctcattacctttttcatccaacctgcacaatccctgtttccaacacaggatcttctatttccttttctgttctcactaaatgccctcaccacctatgtcacacacacacacacacacaaatccaagtcatcatgatgacacattgtaaactccatgctctcaatcatacaaccaaacatgaccatccaccttccacattcccatattattgactgtccatcctctttttttttttttaagacagagtctcactcgctctgtcacccaggctggagtgcagtgacaccatctgggctcactgcaaactctgcctccagggttcaagtgattctcgtgcctcagcctcccgagtagctaggattacaggcacccgccaccacgcctggctaatttttgtatttttagtagagacagggtttcaccatgttggccaggctagtcttgaactcctggcctcaagccatctgcccgccttggcctcccaaagtgctgggattacagacgtgagccactgcgcccagtccatccctgtctttgactctcctacagccttcatactttataaagaccttgatgattacattgggttcaccaagacaatccagggcaattttcccatctcaagatccttttcataaccgtatctacaaagtctctttctccatgtcaggtagcatttacaggttctggggattagggatgtgaacctctttggggggtcattattctgtctctcatacccatatagtttgggtttacctattgtagaatcatcaaaacctgcctcatattgtagatatttgcataaatatttatcaccctttcaccccacacagccactagaaatgatatatacacattgaagaaaggaaacatgtacttttgtgtagggaattagagttaggtcatcagatagccaacaaaggcttctgaaatttaaggtgtgtgatcagatatttctaccagctactgacaaaggaccaagaaaatccattgcattacttaatgtcattttatcttctactgtttcctaaaacttgttatctctggtgtttgaaaatgtatgtgccttggccggacacgctggctcacacctgtaatcccaacactttgggaggccaaggcgggcagagcacttgaggtcaggagttcgagaccagcctggccaacatggcaagaccccacctctactaaaaacacaaaaactagccaggcatggtggtggatgcttgtaattccagctacttgggaggctgaggcacaagaatcactcgaacccaggaggcagaggttgcagtaaagccaagatcgagccactgcactccagcctgggtgacagagtgagactatgtctcaaaaaaaaaaaaaaaagaaaagaaaagaaaagaaaatgtgtgtcttgctcttattctgcagtctctgccatggctttctgcagtcttgtttcataaaaacaaaatgtcttgtgatcactactgaataatctcctgaagcacaatatttattaatctcttgagcacatattaattatgcattaaatactaactatataagcaagtgaagctgaccatctcgaaccatagaaattacactgagtttcctatgaacctaggaataaataactcatattggagatggaaaagatatggaaaaaaggaattcaggctgggcgcagtggctcacgcttgtaatcccagcactttgggaggccgaggcaggcagatcactttagctcaggacttcaagaccagcctgggtaacatggcaaaattccgtttctacaaaaagtataaaaattagccaggcatggtggtgcatgcctgtagtcccagctaccgggaggctaagattggagtattgcttgagcccaggaggtcaagtatccagtgagctatgatcccatcactgcactccagcctgggcaacaaagcaagacccctgtctcaggggaaaaaaaaggaattcagtgctttttcctttaaatcttatgtggttaacaatagataacacttctaacatttcattaatttcccacctggcttcttttatgactccacatttaaagcaacattacacaaaccctggagctccgaggtcaagacatacatttggaaacagatagatctttttaaatgttttttaattgatccataatagacgtacatagtttctaggtacatgtgatcatttgctacactcatataagcaaatcagggtaactaagatatctatcaccttaaatacttatcttttctttgtactaataacattcaaattattctcttctagctagtttgaaatgtatggtagattaatgttaactataatcaccctacttcagatacaacttttttttttttttttgagagggagttttactctgtcgcccagactggagtacagtggcaccatcttggctcactgtgacccccacctcccagattcaagcgattctcctgcctcagcctcccgagtagctgggactacaggcgcctgccaccaagcccggctaattgattattattattactactgtattctagtagagacagggtttcaccatgttggccaggctggtctcaaactcctgacctcaagtgatctgcccgcctcggcctcccaaagtgctgggattacaggtgtgagtcaccacacctggcccagatagatactttactgcaacacatttacttcctcttaactttggtaacttggggtttaggaggcatacaaagatggggcttctgagaaagaacaggatggagcaaaatgaaagctgatatggccttttgatgttgccctgacaaatacatatggtaagaaaaccttatgattaaagacttcttggccaggcatggtggctcacacctagaattccagcatttttgggaggttgagatgggaggatcacttgagcccagaagttcaacagcagcttgggctatacagtgagaccccatctctacaaaaaattaaaattaaaaaatgagacaggagtggtggcacatgcctgtagttgcagctactcgggaggctgaggcaggaggatcacttgaacctgggagttggaggttgcagtgagcagagatggtgccactgcactccagactgggtgacagagcaaggccctgtctctaaaaagaaaaaaaaaaaaaagacttcttaaatttcttttttttaataaattttattgtgtatacacacaattgaggtttaacccatgaagttatgggatacatatagataataaaatggttatctatatgtgaagcaaattaatatatctatcatctcacatagttacttatttttgtggcacaagcagctataatctacttatttaactaatttcttatttctttttcaaaatggaaattataggttttctttctatagtcatatatatttctaaatatatatatatttctaaatatatagatattaaatatatatatttctaaatatatagatattaaatatctatatatttctaaatatatagatattaaatatctatatatttctaaatatctatatatttctaaatatctatacttctaaatatctatatttctaaatatctatatatttctaaatatctatatttctaaatatctatatatttctaaatatctatatatttctaaatatctatatatttctaaatatatatatttagaaatatctatgtatttctaaatatctatatatttctaaatatctatatacttctaaatatatctatgtttctaaatatatttagaaatatatatatatatttcaggccagctcagtggctcacacctgtaatcccagcactttgggaggctgaggcaggcagatcacctgaggtcaggagttcaaggccagcctggcctacgtggtgaaaccctgtctctactaaaaatacaaaattagccgggtgtggtggcacatgcctctaatcctggctactctggaggctgagacaggagaattgcttgaacctgggaggcgggggttacagtgagtcgaggctgcgccattgcactccagcccaggcaacaagagtgaaactctgtctcaacaacaaaatacatacatatatatatatttcaggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgcttggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcgtcttcacaccaacatgcagaaaagtttctaatctcagatcagggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctacccaaaaaaaaaattaaaaattagccaagcatggtgatgatataggagttaaggagaaatcatttaggcaaatagcaagggtaggaagtcctcagtaaggttttccatttaatgaaaagcagcccccaaaatcattttcttttctaacaaagaacagcctgtaaaatcgagctgcagacatagacaagcaagctggaagcttccacgggtgaatgccggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatattaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaggtatttgaaactacaggtgtgtaccaccacacctggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtccgtataagctcaatgagtattgatttaggggctttggagaactttgaatgctaccccccaagtaaccattgttggcaacctggtacctctacttttagccatttctccttctctataaatagtgcagaagtaacccacttggtaacaggcatccttgccaagcctccaccactaggtcagtgtaagaattaaagaaagaggaaagaaacacaaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgttttttttgttgtgcttatatgggagggagagtggtgtgttt

SEQ ID NO: 12724 - DNA, 223471 bp, Human; identical to SEQ ID NO: 12387
  misc_feature (1)...(223471): n = A,T,C or G

SEQ ID NO: 12725 - DNA, 223471 bp, Human; identical to SEQ ID NO: 12387
  misc_feature (1)...(223471): n = A,T,C or G

SEQ ID NO: 12726 - DNA, 12411 bp, Human; identical to SEQ ID NO: 12193

SEQ ID NO: 12727 - DNA, 12411 bp, Human; identical to SEQ ID NO: 12193

SEQ ID NO: 12728 - DNA, 12411 bp, Human; identical to SEQ ID NO: 12193

SEQ ID NO: 12729 - DNA, 38772 bp, Human; identical to SEQ ID NO: 12382

SEQ ID NO: 12730 - DNA, 53915 bp, Human; identical to SEQ ID NO: 12221
  misc_feature (1)...(53915): n = A,T,C or G

SEQ ID NO: 12731 - DNA, 264206 bp, Human
ataccagcttcagcagttttaggtgatattaaccctttcaatacaaaacagtcttactgttcgaatacatatttcaaaattgatttaatatttttagttagtcatggctcaagaatgtttcactcagatccttatttttttcctttaataaaaatgcttctcactgtgccgtgcatatttccataaaagtcagcaagttaatttatggcttaaaaaaagaaaataaaaggtctatatttaatatgtgaatacattttacagtggaaattggtggtggacagtattaaatgactccagtgtggaaatatgcaggtggtcattagtagctgactatgagatttactgaagattttgatattaattttcccggcatgcagtactatatataaatctaactctgttctcaaattaatttaaatggatgataacatatgaataactccaggcatatgaggctcattgtcttctctctcctttaggaaatatattgtttgcctcattgtgaaactgtattttgactactttttcacctgactagtttctctattgcaaaagaattattggttttctactcataaagagtgtatgggaaacggtaccaaaatacttctggaataaatgtgctacaaaaaaaaaatcacatatctgcttgactaggtatattaaataaagaccatagagaaaaaggaataaggttctaaaagcacctacttcagttttaatttttttaaatgattggctttttcacttctgataatagtatgtttggaaaatatacccatcttttctctaaaaagatgcaagaatcatttagtgaaaaatattttggaggaaattacttcatcttcggctctcagattcatgattgtacctaagattctaattttaatcattttgtagtttggaaaaggaaagatgcttctccttttagcacaaaattactttaaactgactttcaccagaggaaaaacatgccacttaaagtcacccaactgaagaaaatgaagtccaaacgcccaagaaatgtttactttgtttttaacacctactatactttgaatcctgtcatggtaatgttttatgcattgttgatctttagaagtcaaaaaaaaaaaaaaaagctcaatccagtgaactttatgttgaggcaatttctcttaataatgagagtatatggagatgtaaagtaggtaaaaaagaatgtcacgcttaattcagagttccttatctgctactaaaacccaaactgcatgtattaatcttgcagcatttgaataatgttcccattttgtctgttttgtggtacccccttaaagcacccattgagtttctggcttctctttagctcagaaaaccatagcaacctcagtccgcacttctccaactcaggatagagttcaagttgttctcctcaagccttcttgccgtgaaaatcgtggggaatcctgatcaccaactaggtgtcctaagacttcttgccacagataaagggcgggggagggggcgcacacgcacacacacatcctgcgtcgtttaattgggagagagaagggaaagtaacaacagaaaaggtaaaaggactttgagagttctttaaattgtttctgttagcatctctgagtgtctggggaacgtcggtttggcggccacgcactgccccccacctgccccccactaccccaaggtaagtcctcgtctttatcacattattcctaacgcgttcggatttttcctccttttccagcccgcacgttcacagacgggaggtgggggagggaggaggggggagaggcggggcgggaaggtagccgggtccctgcaccgcgccgctctcatttgcggcgctccgactcgggcgaagttctcgcgcagccggctcgccgcggccggggccggtcccggcgggcggcggcggcgggtgctcggagccgggcggggcggcggcggcggcgcggggacgcgcgctgtctctttaagggagctcggtctggggtggcgctttcctccgcgaaggctcctttgatattaatagtgttggtgtcttgaaactgacgtaatgcgcggagactgaggtcctgacaagcgataacatttctgataaagacccgatcttactgcaatctctagcgtcctcttttttggtgctgctggtttctccagacctcgcgtcctctcgattgctctctcgccttcctatttcttttttttttttttaaacaaaaaacaacaccccctcccctctcccacccggcaccgggcacatccttgctctatttcctttctctttctctctctctctctctctctctcttttttaataagggtgggggagggaaaggggggggatgcaggaaagacctttttctctcccccccgcaataatccaagatcaactctgcaaacaacagaagacggttcatggctttggccgccgcgccaccatctttcgggctgccgagggtgttcttgacgattaatcaacaggtaaggaggggaggcccgagcgggccgcggggccgggggctgcggggggcgcggggggcgcgggcgcccctcggccgggcccggggcgccgcgacgcgagtgcagcgcccgctcgtgtgcgcgcaaaatgtgggcgatcgcgagcggggagccctgggaattaaaagtgactttctttgaaaaaaaaaaaaaaaaaaaaaaaagcagagggagagtgtgcagaaagccaagcgcaggcttctcgggtttcacatgcattttctttcttcctttttgagcgtgtgatttctttctttctttcttctcttctgctccctttttcccccttcctctcctccttttggtgggtctgaggcatctgagctttggaaaccagcgacttcaaactgcagtagcccctggagtcagcagggtcaagttcagccgccggggaggaggaaaaacaaatccccatttgccaaaaaaagaagtttcaggccggtgccccctccccctcgcagccccactccccctcgctgtctctttctggctgattttaattctctcctaccgggcgcagcggaggagctggaggtggttggacccgaggggccgccgccgccgccgccactgcaagttttctgggggctcgtgacaagcggggcgcagactaggcaccagcatgcagagtagtaagttgggcgaactcgggagggtcgggagggtctcagagacgggcctccgtatggtctccaaagtgggaaaacagcacaggactgcctttggctttgaagagtttgcaaatgcaggcttcaaacttttttcccttaaaggcccagctgggctctggagaaggcgggtgtcgcatcccttggtgcacccgcctcagagcggctcaggacagcttggccgagcggtctgtgccctgtccgtaccatgtggcagggccttgcagcccgggcgcttccgtaggggctgaggaaggggcagacttcctctgcgatgcggttgatgcgccatgtgtcgcgcgggtcaggggacactggccggtgattaaatgcctgacagcggtgggacatccaagcggacagacgctttgccttctgtctggttcctgtttgggatctagagaaacgcatctttgaaaggccaaggcaaacatcgctgtccctccaaataactccaggattataggaccccaggaataatttgagggtgaggcggcggtgggagctgtttgaagtgtaaagctgtttttgtggctgggaaagctttttcgttagtacctgtctgagatggtggtgtttccccctttccccagggaagtcagcaactgttttatggccccaggactctaaagcaatttaagttagagggtgagaaggactggtgggtttcagagggaatcttggacttattaaattttaggaccggctttacttccctctatctttttaggcctcatatttgatgctttgaaagttttttgagtaagccattgatcttaatgatgaatctaaattatgatagaatattcattcttatgccattttggaaaatcacggctagagtttaagcgaggtaagtgaagtgagaagctcagcggaggagttaaatctgagacaagttaggcctattcattgaacttttgtagattcattgaacttttgtaaacacaccaggtgaacaggaaaggaaagggtctgggagagataataagtacaaaagaaaaatacagatagggcctgagacaaaattacaaagaaatgataactctgggcctggttgttggctaaaacttgattgttcaaagcaaaaataaaataggaaccttccaacaattcttcaaagtcctccagctctgaagctaaaacctatggatcttgctggcatcatgttactttcctgctggttttagaaaaagttgatcatttagaaaaggctgccagagttaaaaatgcaagggacagcagaggaaagtcatgcgggcagccagttcttgacgtggacaaaatgagaatgaaagtttctgaactcactgttgtgaagttttacatgccgctcatttgcttagaaggctctctcagatattccaccagttaacgtataaaagcaaacaggatctaaaatcgtgtgggcttttttttttttctttccccaagtatgccagggttgtgaataaatacagggtttgtatgggaagatgaagcgtttcctgtaagttctgatgctgacaggacagtctggaaatgataccaacattttgaggattttttttttttacctttaagtgaaagtttattaatgatatgcttaatcttaacaagtcaaacatattcttagagtttctctctccttggatttcataacttccttttaaagctacacctttggataaaaacatctctagattcagttcaatatacagggctagtaacatgctaaagtttgacgattatttctggatgttaataatgtgaaaataaaactcctgaggggcaaatagagccttaatgccaacattataacttgatttctctgaatgtgaggccttctgaagcttcattagtactctgttggcgaagtattatttaccactggcgagctgatgtttatggcttcctgatatgtatgttatatgttaggatatatatgtgtagactgcttttccatacataatacctaagtctaacacttttcaaataagtggtggaaagtagcaagttactaacacaaagtttgtcactcctttgaattctagatgctgtaagggtctgtgctactatttaggttttgtcctttgtctcttaaaggtaacgttaaaggtaaggagaaaaatgtcataatagctgtgaagtctgagctgaatttagaacttagcatttcgatgactaatattttaaatgattttataaaattttctgcatacgtgtttgaaaaccagtttaggatcggaatcagtgtgctaatccgaaataagttacacatactactaccatattttcagtattatttaagtcacctaccactcctgagtttattctgatttacatcatatagatctcttcctataaggaaatattcattcataaggaagacctttaaaacagggaaatgcatgcatctgtagaaaagcagcttttacgattctagtatttcagtgacggttctattatcactactattattagatgtatatgtgtatgtgtgtacagacatacaacccacaatatgtgattaatgatgtgtacatttttattaagaaagcaaccaaagactgtagatttttataaacgcttgtcttaccttctttgttgtaaataaacattactgaaagtttccagaggacttgcagcaaattgtttttgaactagaactttattccaaatttgaaattggaataaatgctgataactgacctttaaacatttttcataacatgaatattttagaataattatattttaacttcagttcttcttttgatagcaacaataatgtaacaacactatgctattacgtgtacaacaacacagactttaagaaagttatgggcaggtgtctataattgatttaaaggaaagattatttttgtaataagtgatgaacttaaaatgactggcttacattaaaacatattcttattaagatttctctggtgtgtaaaatgaagccattcattcaacaggctgacaactttccacttggtatttgcctttccttaatttagtttccgcaggacagctagtgtggtagtctgcatctgtttttagcaggcatagaaaactataaactcagacagttctgtcccaaatattgcagctcacaagttacaatcaatttgataaaaacccgcaagttttatgggctcgtattttgttgttcatccttgctaggtcaagctttcaggtaataggtttctttttctccctcttttgctgatgataactgctaataccattgataactaattctgagtcttgtttactcatttatcatccttatttaccatttgttgaagttttgggaaattaatgacagcatacgtagacttgcgtttactttgatggcttatctgtgaaaatgacatttatcttttgttattatacagaaataagtaaattctttgttaccataatagttatgatttatggaatttttgagtcccccttagatatagcataaagatggtcttctagcctttgccaagtagacatttaatctaattgtttaagagtgcttgtcatgtatagaaaagactaacatactttgcaattatttacattaaaaattatgtagaggtttgttttagtgtaattttaaaaataatttgtctcccaaaagctgtaaccagtggattaaagtaaataagctaaaataccaaatcttgttttataccattgttctatagcaaacagtgctgcagaggatgtaactactttttaaaatttatcctccgatgtaagtagggccaaagtcatttgtttgtataaaatattctattaattatatatgacctttataaataatatcttcgattttattattatgatcactttttgagctatcacagtgctcagttgttctcctattcctgagaactgaatttggcctttagtttggttttctgatggacacaataatgtagaacttgactttggttagaaagagatctttgagcttcaggaatctctgaaggtgcagtaggatctacaggtgaaaaccatttgaattgttaagcattagttaggtgaagaaactctactggtccctgcagcatatagcagctattatcgtagcggtctactttttgctatcccagttttttttttttttttttttttccttttccaagagcacaaatccaaatagcaaaaatgaaggtgaaattatctatgtacttcaaatttggagcatcatttgaaatcattttctgattctaagctataactgaaatacaaatataacattaagacaccccaaagaagacattaaggatacacttgtcgttcttaagtgtgtttcactaaaaataataacaaaaaacttttaatttttaaaatgtttctagcttttaaaaacctgcagtaaatactttacaagtggctagacaccttccctggtggtttagtttatacaagcaggaaactttctctcctactctttctctctctctttcttgttttctttaaaccaactgacgtaatgccaaactttgctttaaaagaacagacagaagtaattggtagcttttaacttttaataatgttctggattggttttagtggccaaaatgccatttaaaaaaaaaaaaaagttcaagtaagaacgggcttgtggcctgaggaagaaaggctctgttgatgcagttatttttattcttgtttttcaatctgttattaaaaatctttcctgctgagcactgctggatttctccaattgctctttgtgatggctggtgcatttcaggttaccgtaacttaaacagtttttgggttttggggaaagtgggtatttgcgttgcattatttctttcttatttggaaaaaaaatccatttgtttttgtttcaatggagattaattaattaaggttatcaatggccacaggtcaaagaatatgtttatataacgaatgcgacacctgttagcaagagcctaaaatgtggaagtttaaatgtgacattaatcatttttatgtgcagaggaaggaaaatagatgaaactttacgaaaatgcatttttagattgaaaacattaattttaagggtcagtgcgtttctacaggcagctctttttttcttacaattttagatgataattttttaaccctatttatcaaacagtatttatagtttccttttttttttttttttataaatagtcatttctttctctctgactttgcacaggcaaacagaactttctccagttaagagacatcttggtgatgttgattgacatcagggcaacttcagaagctggcaagtaggaaaatctttttagggggcaaaaagatttgtgctagtgttctcttccttgggaaaagacactccacccagaaattattgggtttagtggaaggccctccgccccattcggtggctcagaactaagtactgtttcgacttttcttttgtgaattgttcctgaggtttaaatcttacggttacttgtcgtggactttgcttttaacccaaattcttcctgatagattttttttttccttctttacctagagcacatttaaggaataatatatatagtgaaaattaagtgtcacacaaggaagagtacagtctttaaggcatttatgactataaaaagcattccgcaaatttggggcattgaagtgttctctgcttataaatttgacagttttgatttacttgatatgtttctcagtttttcttgcgagagttacagactctagttcaaatcgtaggcattccttttttgcttatggcttctttagttaaagatttgtttggaaaaactttaggaacttaatgtatatgttgttcacatcagcatagtgcaagtttcttggagtaagtctagattcattttatttattacaaagttttcaaacatacatttcatgttatggctgcatctgttaataaatttttatttaatgaattttgtttgttgcttcaaaaatgaggaaaagcaataaagtttagcaagaaggaaataaggcaaagggaggtgtttagagttgcagtcccttaatatcgcagattgtttactggtaagtggtggggaggggttggtgggaggttttgtggaagatgataccaaaaaaaaaaaaaaaaatccatcaattgcgcatatgctcccctccccttaaggtttacttaaacaatatgtttcgattttgccgcaaaccattctgcactacttctgctccaagaatccaccactatcttggttcctgagagattaaggatgatgttttctgttgtataatgaacagcagtattatttgaacaaaggtaacactttttgatttgtgtaattttttagtagcttgtcataggatacctataatatgagaggagttctagcaatgtaattgcctgcaaatgtttgaagtactcacgatagctttgctatgtttgaattattgccaatatatgtgcatgctattataggtgtgttttatatgtggaatgtatgtagaccgataatacttagacacatcttgatggtggaatttagaatgctaactattaactctgtgcttgaaatgtgaatcttttaaggagttaacatgacctacattatgaagtctaaaagtttgaaatgagtatggagtttaaacataatgaatcaattgttatcataatacttatatctgctctgaatttactaaggaatttttttaaatgaaaaaaattataaatcaaaatgccacctttcagtgtattgtaagaaatgcttctgagatcattttttaagtctcatttctgttaagaggagcagttaagggacaggactgtttgtgagtatatcactttatgggctaccactttatagtttacaattctatcatctcaaaacgttatgtagaaataatatggaacatgtaaagactctgtactatgacccaatgcatttttccctagggtgatggattctgtgcgtcacccaaatgtgatgctatttgccaggcttgtaatactggttttgagggttgatctatgtcctatttcatcaagcaacacaatacaacaactttggtatctagggtaattgacacagtcaaaatagtctctggaaaacattccatatacttttaagttaagtcagaagttaatgtacatattaaatttatttaacatgaataaacaaatgatttattgttagctatttgtctaatatactagatagtgttagaaggaaatatacaagtatttacagtttatgttccatttctttttttcttttttgaggggagcatggttctcttgtttgcgttcataatagctttatctgttaattactttgtattcatgatagtgagtagtatagtatcataaatcatagtaaacatgtttatattatctgctatatatgtcccaagcttggaaaaagcattaatattactagttgttaaattgagtattatagtaaccaggaatgaatccagtaccgtataagacaatagataagacatcaactgctatttaaacactaaaaataccttagctgtagaaaaagaaagatcaaaaggatttcagagctgtttttacttgtagaatttggacagaatgtataaagcttacaaatcaataaacattaataatataacatgtgcttcctgattagattctacaatacaatgtgaattgctatttcaatttctctacatatcatatggaagatcagatatgtttataaatagtgtaaaaatatatggcagaaattagtttgtggaatctaatttctctattacatgatacacttcatgtacaaagggatcaagcattactaatctagtgttagcttttgctctctgagctatgcagaagtggaatatatgaatttgtggcttcatattaaataagtgcgtacatgtacatgcaggatagctatagtctcacttgcttagaatgtttttacattacaggcactacatggaattttagcatattgcatattttttgaaatgactttagtctttgtaatgcccattttaattacttaatgcatcccaacacctatttgagggttaatttaattgtaattttggttctgaaatgagagcatgatagacaaaacaaattaaaaaccaaattctacttgtgcctactttgtgatgtcattatctgcacatcatctttagctttgcaagatgtggaaataaaatacatcagcccattttctctcaatactcttaagtagctctgaacatataaaagttcctaaaagaaagttttgcatttgtttttgctttgctttttgatgccaagttaagacaggtcatatatatattaattttaatcaaggcccatattactaaatttttcaatacatattcatctctttgttgtatgattcataattctttatcgattattttttgatatacctttgagatcttttaaaatgatatgttttacctgtgtttggctgctgaatttttatattagtaattatatttaaattataaattaaaaaatacggaatatgttaagctgtctttaaattaatattggaagtatacctttttagaagattattgcaaaatttgctcctcagttctgcaaacttagggaagttttagaaaataatttacaagtagtcagtaagtagttacacattcaaggattgaaaaatatgaaatactattttctgtagcttataaaccaacactaagagatgtttctcctttgtatttataatgcatttgaattacattatttggatgtatgatgtggtaaattactgtaagaaactcactgtcatctaaacctcaattataataaactattttactctatcccatcactgtttattctatttttaaagtcccgtttttaagaaaacttgtgcttttgaaggaatgccctcattatttataacatattttgctttttctttttactttgataagctttaagaaagctgccagtaagatgattttaggtcattggtaaaaataataatgtacacattttatgtgtaaatatgtgtacacaatcttgcaccttcactgtgtctaacattcagctttttagtgttatacatatttttattcaacattacacatatttgtgtacatttagtgttacacatatttgtatttagtgttacatgtatttgtgtacatttatgtacatcatgtactttttactcccagaataattcagtatatcactgttagcacataattatggacatacatattcttctcacttcctgaacgattcagtgtgtccttggcaatactaacactttaaaaatgagagtaataatgattagagctggagaactgggggtagatagtagtattagcaggtttccctccttttaatttttcccattttcagttccttctttaaaagagagatgtatatatatctgaacagaagggggactaggatactgtataatccatgataacataaggaacggttgctgcatatggctttatttatatatctctgacataaaaaactttgacccctttgcctgttgtacttgggaattttagataaaccccactggggtcacactcatcagttccggctttgcgtgactcaaggcattctctagcttctggtgcgctactgtgctgttttccttcaggagtggaaggtcctgtaagttcatttggcatttggaagcacaactagatttcttcctttttgaaaatcctctgactgggttacagaagagtaagcagagatcatgggcagcatgatgtcgttgattttaggatgctaaagaaaattatgctgagaccaagcatgcttcctctggcttattctgccctgctttatcatcatttttttctttttttcaacttcctacccctcttccccctacactgtttggggtctaatattttagtttctggaggagtaaggatttgccttctcagtggaaaaatgtgtaagctgcaggatttttacctacctttctttataacttttccattctggggacagtgtctaagaagaggaaaaagcttacatactttattttattttattttattgtttgctattgagtaggagtttgctattccatttctatgtggaaatgcgttgcatggaattaaataaagttgtataattttgaaacaattataagcaccaactgtgacatagttctggcttttaaaaaaagtcaattttagttatgcagtacttccaccaaactctctattccaagtttataaatgtgaatttgaccattcgaccatggatgatgcttgaaagtcatgttttctggatttagggcagaagaatacttgaaagattctcaccatcagtatgttttagattcccaagaggtacaatgccaagtgtcatgttatcaactctttgaggtctacagtaaggagtttacttgtttctggtagcttataaattcaataacatcagtcacaggcttcttaacgtatttatgagttgagctagtgtagttcaataaatgattgtacttccatcaagtcgagggagtaacgcaaactagaatagtagccatctattaaggatagttctgaggtttggaatttgtaactgatttttaggagctacgacatgaatatcatatcaggtagaaatactcagagtgatcaccttttatgaaagttagttctatctttcatgtctaggaaaatataacagtgaatgtttgctttttgtatgttttgtctccaagcagaggaaactgacagttttatgttttaagtgccgaaagttgtttttggctaggcagttccagagttaatcactgggatgttaacttgaatttttgtctttaaaatgttttagatttttaaaacgaaatatgcttccattatttccaaactgacaccttgtgttctggattagtttttagagaaatgttttccaaattctcttggattacttgaagtccattgattttgaaatatttagtttagtttttttcttttaaagcttatcagaaagtagaggaagtactttatcttttcggggttttcttattccagaaaccttgttattgcctgtaaaatgcaaatgaattttgcacttattttgttttattttctcttgtgttttcagaaatgttttgatgcatcagaaattgagagatcagtgatttcagttctcctgtcacacctttttatgataaaatattttggtcatttctaaggagtagttagagggaaatcctttcataaatcattttcacttcaaaaaaacagtgatgttggaaaatcatatagtattctttgtgattagttgaaaattatgaatggtgtaaaataatatgacatttaattgtttctcatttagacatgatgcattttatatctcaaaatttgatgggaggaaaaagaaaaaaaagaactcacaacttttaccaggtttgaaactagcttaagatagttctgtggaattctccaaaagtgataagaaaatttaaaatactgcccagacacagggttaaaaattaaatctgtatgtagagtggagactttaatctgacatattttaatgtaaagacattttagaataaagaaagctttctctggttttgtcggctgtttttgtttttcgactgctttgcatgagacgatcggcattcttaaattataattatgtgtaaaaacaaataagctgctactgtaaaaagtaacagctctgcacatatatcttgaatactactagaaaacattttcattagaggaataaatgcattaggccctaaataaatttaagataccaaattgcaaacttagtatctctaatacattacccatgctagtccctgcaaagtggaattgattctgagagagctcattatttccgttgctagtagagtgtatttaacaatattttggtgtctccaccggtagaaatgtggacatttcaaccagctatccccttgtttggttcctgtgatgtcaggcaaacattttgccaaaatgtttggtccgatgtaatcacatcggtgttgtgtaattaagataatgtgctgattttgaatcttgttaacgtgttattttgaaagtgtaattttaaaaatttgcccatttggaatacaatagaagaggcaggatgatgtttttagatttaattcaaagcctctatgtacagataaattatgaaaagttcagtagctcttttcatcttttcctaatatgggagaaggtgggggtttattttcataaacaccattgtaaaaataattgatgaaatgttttttgacaaaagatcatgtacatatatattaactttctgagctaacagaatgtacattttatttcattaggttacattaataaaaccatgtacaaaaacatacaaatggaagaatagatgaaatcacctccctggaatcagatgtagggtaaatggtgtagtctctgagatgactctcttagttctgtgatttcaccataagagctggcccccatctattctgctttggacacattgtgccaaagtgtacaatgttcagcttcccacaaaaggagaaaatacgggtttaggcttaagattcttctaacattctgttatggagaaatagaccttggccaaggaaacacttcttttctcaatgatggaactttcttcagctggtcagtctaaaatctgccattcaagtttggttttacttctttgtttttctttacttcaggtatatcaaagtgaacattgggtcatgttttattctgagtgacagaacggacttgagctactatccattctagcatgatcttattttacaaacaagaaaactgaagataaaagtgacttccccctacttggttaaaggactgaactagaacttgggtccgttcaccatcctcattcatatgtgaaacactaggtgattttgatgtttgctgaggaaatctgcccactgtttaagattcattagtctttatttttccttttgcacatggatatgagaatagaattaaaatgtcatttattaggatgcagtgagaaattgatgatcataatgaatcagttgatatattcacattatttctttatcagtactttagatatgggcatcaaatgtttagaagctatcacagaaagttaaagaattactgtgaaaaatctaggcttaatgcttttttcagacaccttagcaatagtaatgttggattcatttagataaaatctaattggtactgaaaaactgcttatgaaaatggtcactaataagaagctagtttgtattacttttccctttagcttaaagcagctttaacatttatctatatagagagtagtatttttaaaaatagtccatttgaattaaggatatttttatcttccatgaaatggatgtttctttattcataacagtcatagttcccttggcaggttgaaaaactgtagatggcatctgtgagattaggcttgaaatgtgcaattagttattaaaatctggctggaaaaaccataagtggtgttttacataaactcctcagcatttataaaaaactaatgaaagaaaaataaaagaacctcatttattttaaatactttccttatgaatcctgtcttttgaatgataaatttcaacttcaaatgtagtgaaaataatttaaaatatacatttaatgcctctatttttcttttaaaatttctcaactttccatttttagccatgacttcacagtacaatatggatgcaatttatgtttattgattatagttaagctaattttaatcatactttgttggagtggaaatacaggaataattctctgtcttcttagacttctgaggtattttacttaaatcccttgtttcttatctttcaaacctaatagttatattgtatagtccaaagggtgaatgcccacataagtgaaattcacacattacaaccccaatgctattgtcattttcacctctggattttaaagaattgtggtaaataccatgcagaaagatgttgaacctaagacagcccccaagctctttcagagcatagctccagaagtgtctttgaaatgctggaggaggtggaggaggaggtgtgtcaggccctggaaaccgctgggctggtccagggtctgtatttgaaccccgttcagttcatcttgagtcgcagggtgaagaagacattgtacttccatttgcatggattttccgctctgtcttttagccagaaggcagccttgtcttttttgttttgttttgttttcttttttggttgttttgtttctttaatgtttctttcaggtgaaaagccttttataaatatcttgtaaatagttattcctttaaatgaaacagtttgctggtggaaaataatcttactcattccgtcagatataatcaattaaatcagaaaactatagaatgatctttaacattaaaaagcaattttaagatgggttaaggaactattttgactagtatgctgatcatcccacgtaaaatctctttcttggtgtggtgagcatactatatgaagaaaggctgaaaacttccattattattacataatcatctgtttttttcctccttgtcctgtggctactatctctatatagcaaaatttatttttcacccagactgtgaattataacttaccattcattgtataccttatagaaccataggaaaccctatcagtgcttatgagccttagtttttcttaatgattttgttaatgttatttattttttacataattctccccctgtatgtaaaatatctcgttttcttctttgactttgagagattggaacctttccatgtactcttggcattgcagatcaaaataaggcaaaatagctcttattctgggctttgtttatcagaaaacaccgttttttgttggtttttataacaggtgatatccagataaggtttaaataagatgagttgctgtattttaatgtttatttccacctcttaagggatttgccctcctgataaatcagtatacacttaactgtattttaattcccctgaatcacaactatgctaatgtagtcacctattttggaaaactccttttcagacattctttaaactattttatacttgacctcatgaggcatatttgtgaacacagactatcgtggatattttatagaagctaattaaatagcattatcttctggctatttggattataatccagttgtagattgattacggaccattcttggaatctaggaaaagtccaaatgcaattctgtagcttatacatggctaatgaagctgagagatagattaggttttaagcaagggatggattttaggtaacaacaaatattgaatatggctcctttgaaagtttagaacaagacaaggtaaaacaaaacaaatggctactttttatttatttccagatggatttcaacttgcaggtgacatggcataaagtcaaaacgttgcttgttgagatttattaattagaatgtttttaagtcagatacggagtttgttctgtttcagataaaagagaaacctactcagacataaaaataacctcagagtggagaaaatattgaatccccaaatctgggtttcatttcatgtgaatctccatttctcaactaagcgatatctgccaaggcgcctctgtttgttgacattgctgtattgaagtcgccagtagcctcatggaagccaagccccagtggtctttccatctgactgcatctctcacgtgaattggatgctgtcagccattctcttgggtatctcttctggcttggcttctaggcactgcatctctgccacacttgttctagtctatcattgaatgttctcttaatctatgcacttttcttggagggttttatgcttttaggtttttatccaaatgaaataacttctgagccttcacctctagacctaacttggttctgagttcccatatcagtggccttcagcctccgtaagtacttgcttttaaacttgtttatcatccttaatttggcattcaggacccttcagtttgcccccaatttaccagttccaaatgtactacatcatgtgtctatccttactatagtgctttctagtcctagaacattctcacaccgacttttgttcatattcttccctccttatgaaatgccttctacgcaaccttaactacagggattctatctgttcctcggcatgttcacttctgtattcttcttcctgaaacgctctacctccgctcatttaggttaaaacatccccgccttgtgctcctgtttatgtgtggctttagcatagctcataccagaagctaccgggcatcatgaacctgaggagagtgagagcatacgtaattcatttttgttccctttacaaatgacttggatgcagtagttctcaaaagtgttgcattaaataggaacataggggaagaacactttggctggcaacatagactttcaggtactgagaaaattgtgaaattggtttgtcaggtttcagaggaaaataaagattatctggtattgcataagttctagatgtttcttgatgtttgccctaatatatcgttcctaaggtaggataccactggttgcaacggagtatgttgtattttgcagtgtgcttgcaaatcctgccttttatcgattaatgtcatttagcgaagtgggacagtgtcagtgaaactaaggcaaaggggaagcctgaattcatttgaaaagtataaaaaaaggagaacacaggcagccttgtactttactgatattatatgtgagacactatgaactaatcagagatgcaagatgatacatggtgtgtccttaattgaggataacagtgttaggctctaaggtcatgagtcagaaatgtgcctttttaacgtccatgttttgaatgttctcaggcccaaaggttgtgttgtgatgtttgaggacaatggcttatgtcttggcttcaggatgaaagttacttgtaagtgggcccaatgcttgcatgctgagggggcaagggtgatttagagtcaggagatctaacatgaatattgatgagtagggttaggagctgagcacaaccataggtaatgttgctttgagatgcccaggtttatggcagcaagaggatattggattcctctttgctcaaatatttttaatattcacgtttccctcagtgatagccaatcaagtgataactgaataatagctgctgagacgtttttcatgttggaacaacaatgcctctgagatttctttgaatgtttgatttttactaatcacttttaatttcatcttaaaagcctgggaacaattttgaagtttaagaacttttttttttaacttaaaagaattattttatctgacaattgggaagtccctttgatttaacatttaactctgttaagcacctaaatattactttaaacagctctggaaaattaagccctgctattattgtacattcccaatctctatggacatgggaccatgaaggagaaatcaaggagatctatttaatgaatttctttgcttctaggacagttcattacttgtaggacttgcacttatctatgccttctttaaaaacaaaacattccaaagcttcctagaaaccttagctaattgcattataccaacatgcttttctgatgtcaccttatgtctgtaagcaactttacaaatcctttgaaagagatagttggatttttaaaagtaatatctgcttggattttgcaaattaagccacagtagaaacagtttcactgtagagtacatgctagttaataagtaggggtttttaaaatcctctgtacttttccacaactgaaagggtgcatacttttggttgaaagtgagtaggcgaaatttagacctgctgttctggtagccctagtggccatttcataatccctgatatgattgtccagctctcctgtttgctaaatgcagaaatagaggaaggaaatggatgttttggctccattaaaatgttccttatcagactgtatgtaggagtggatgctgttgaagatgcctctattgccagctgtacagcatgtgtgctgggctagtttcctggctgctaaagctgcgtggtgccctttaatgatgggaaggaggacattaaatgtgttgggcttagtgttttcacttgtgaacatcagggagcagagggcatgcaaactttgcccaaaggctggacacggtttgcatagaaatgagctgcgtgtagtaataactgacttggtagatgcgcagctaagcactgattactaagtaaaagtgagtgcaacctcaggccataggtgagctaggttgaccagggaaaggctgcgttccaagaggttcgtcttccattggggccgccttaaaatgctgatcctgattcacactggttgagcagtgtgctgtatgttgtcttcacttgagatagaaactgctgtcatctttattttatagaatggagagaactgggtctcaggaaagtataataaattgcctaggctacaacaggtagcaagtagcagagtcaggatttcagtccaggcagcctggccctaagagctgaggctccctctactttgtttcttatctggtgggtgaacaagatttgagttgctgtatcttccaaggtagtattataatggtatttcaaagactagctgactttttaatgttaacagtgttccaatttgctttctccttaggccctaattcattgtcagagataaggccatcacctttatatatgagacatttaaacaaatgtttttagtaataattcaggaaacatacaaccggtattctttctgtagcgatatctgcagtctcttgttataaaaagaactctattagtttaagtaactgtctcttcttggccccattacagtaaaaagtctgtgatcagcaccctcttggaaggggaagttgttgaatgacagggatgtggtactgtcctgataatcctatggctttgtatttcttagtttatttatactcctgggtaactacccctgctccacatggagtattgacagctttgaatctgaggtagcttatgtgtgctacaaagacaaaaaagaaaaaaaaaaagaaagcgtggtttgggttagacttaaaaaagtactttcatcagttattatccagcgtgtctgttagatttttaagtaatttatattttatgaaagagctttaaagacgcagtgtgctttagtggatagtgtagcgagagaaataaaataataataataagggacattttctttaaaaaaatttttccttttgtttttaagaagaaaaaagaatcagaactgcagatcaggaacagaaatagcattccattttcttttcacggattctggagcagctacggtgagagtgagttggctgagtctgggaaggaggctgctgtctgcggccctgcctaggcggcagcggcgacacgacaggagctgcgtgtgtgtcgctggcgttcgctctcgcaggagccccgggcctgcggccgccaccacgcgtgctcggcgcccgggctgtgggcgtgttatcgcaggaagtcctgcggaagcagttgtgtgcgcccgttccctccggttacctctctcatcctcggctgctgcgcggtgcctgcagcctccctctcctcctccctctcccagcgctgcctgccctgccagctgcgtggaggccgcctcctgcccgcttcttcccactccctctgccctgtcgcgtcgcatcccctggccagcctgcccttctccccacttcccaacttggcttcctctctccataaactctctttcctcttgtcttctcttttgcttcctctttgctgccacccctccttgatttgacgctctgatttcctcttgccagatcccaaattgggttcatcagcagctactcatccttaaatcttattcacctgtgatcattgggcaaactgtaagaggcatgagattaatgcaaaaaagggagttccttactatgggaggaaatctctggctatcaaaaagtcatgcttttttttttgtcacatattaaaattaagcactaatgtaaatacaaaaaaatttaaaatgatggcataggttattaatgagtccaggaataaggcaaagaaggacaatctgaaaaaataatctcaaatgaatataacaaaattgcccattttttatggagataactaaaattgtgataaagtactagattttattaatgaaaatattattagtctttaagttagtcatgtactttgtcatatagcgttttcaaggagctgcttaaagtgtttctgatattttgaagtatatttacttacacaaacattcttgagtagatggaagtgtgtgtctcatgcattctcaatcagaaactataaataaagtcacttaatcaaaatttaccttatgtaatagtttcaaaagcacatgaagccttttggagtgactaaggctatatatgtatataaggctactgtatttttagcattctgggaactgaggcctttatgtttttcttaaattatgaactttaagacagtagctatacgtggatccctatcaagtttttgccttctttacatcatcaagcttatttttaaattaattcttgttacggacatgctttttacaccctctgtattaatttccttttctagaagtccatattagtaaggccatatcatgaaaattagtatttttagtagggctgttctgaaatttttccacaagagatattttgcaatgactgagctatattgattcatataatttgtatccaactgcttcattttgccttgagatttccagtgtacctaatattaggtaaagaaaatagttgatatatgactggatgtgaggtggccattttaacttgtaggtgacaggatttatctcttgatttcttcgttaattttaaaataaataaacaaaaaacaacataaggaagtttagatccttctttttaatttgtaacacttcaacttctagtattgctttctgtaggggagaatttttcagttgataacatgagttgatttcataagttatagtatttaaaactagagatgttttgtcacaaaaaagttgtccctttaatatatgatttagcacggcaactctttttaaagtaatatgtttaagagaaaaccatgaccttatgataaaaataatactaaaccaattattaataactacagtttgccgtcaaacgtcttagctaaataattaccttattagaacaaaggtattgaaagcacagcaccagaaacactggctttaatattcaagtaataaagactttaggtccaccatatatttttctcatggctggaggagcaagtcctagagtatggggggcatacttattacttcagttgtcataaatgtggatcacagtattttctaaactttttgttttattttgcatttttctataatttgagcactttgacctcttttcaagtttatttgttctccagatatgtacaatacaagttaaaagaaagttcagtcatcacagtgccttttgggacatgtgattgtctggaatagacttctgtccagctatggttagaagtcccataggttgtagctatgttttcctttttgtgaagtggctctgttggaataaaaccagtcttaaagtaattctataatttctctagaatgcagtcttctcacccataggctgtgagtagtagtacctgggcacaggttttggggggaagaatcagtttagataaaacatgtaaaacaggtttggtgaatgtcaaacgattgaatatttatttctataaataatgataatgattgttctgtttctaatctttgtaatttctgtgtgtcattaactatgggagtgcttagactattcaaaatagtatttctaaggccttattttatttttaattttaacaattatatttaggatatttacggacaggaacaaactgagcattctagccgtcagctattgtagaaagagtggcattatattatcccaaaaggctagctcagtgtcatcctttggtagaatacatgccttaaattcaaaagctctgttatgtttgaatttcagttctataagctttggtattcaatagtgccgagttcaaggtctaaattggaaaaacttgcaagaagtatttttgcattgttttttcacattgtacatctttgccttgttctttgggcctttaatgacatgtgccatcattttttaaaaatatttgtattagtacctaattttaatacatgatttaaaaaatatgactttttgatacccagggatttcctcttgtagtaacttttttgcattaatttcatgaaattttttcctcttcctcaaaatgagcacacaattcctcttcaaagttaatgactgtcttatttttcagtaggttgttttaattttgaatacctcagaacctttcttgaggggtagtattttagagataatgttttgtggttctcactggatattttagaagttttattttgattatgtggaatatatcctacatgatcataagcacttcgttaataaaaatggtttgttattactgagatcacccagtttttcggcaggagaataataaatagaagttgtgtgattccatagccactgtagggtgtactctagagcagagtgattctgggttataaccacatatcctaaatttcaagctaatagtgtgtatgtgtgtgcgtgtgtatatatatgtaattacctcgttttattgcactttccatttattacactccacagatgttaccttttttataaataaagatttgtggcaaccctgtgtcaagcaaatctatcagcaccatttttttcaaaaatatgtgtttaccttatgtctctttgtcacatttggaaaattcctgctatatttcagaccttttcattgttattatattatatctgagttggtggtctgtgatctttgatgtcactattgttattgttttggggagccatgaatggtacccacgtaagatggcaaacttaattgataaatgtgtttgttttgagtgctccactgtctggctgttcccttgtctctctggtgctcgttggtcctccctattccctgagacataatgattttgaaattcaacctattaataaccctacaatgacctctaagtgttaaagtgaaaagaagggtttcatgtctctcactttaaattgaaagctagaaatgattatgcttagtgaggaaggcatgctgaaaaagagagaagccaaaaactaggcctcttgtgccacatggccaggttgtgaatgcaaaggaaaagtgcttgaaggaaattaaaagtgccactctgttgaacacacacatgataagaaagcaaaaacagccttattgctgatatggagaaagttttagtggttgggtagaagatcaagccagccacgacattccctcagggcacagcctaatccagagcaaggccctctgtttgattcggtgaaagctgagagagagataaagaagttgcagaagaaacgtttgaagctagcagaggttggttcatgggttttaaagagatatgtcacatccataacataaaagtacaaggtgaagcagcaagtgatgatgaagaagctgcagcacattatccagaagatctagttaagatcagtgatgaaagtggctacactaaacaacagattttcagtggagacaaaggagcacattcaaaggacaggctgactagttaggggctaatgcagctggtgacttgaagtagaatccattgctcatttagcattccaaagattctgggacccttaataattatgctaaatctactctgtggagctgtgctctataaaaggaacagcaaagcctgaaggatagcacatttgtttacagtatggtttactgaatagttgaagtgcactgttgagacctactacttggaaaaagattcctttaaaagtattactgctcactgacaatgcacgcagtcaccccagaagctctgatggagatgtacaaagagatgaatgttatgttcatgcctgctaacacaacatcctttcagcagtccttggatcaaggagaaatttcaaaattcaagtcattatttaagacatacatttcataaagctatacctgccatagtgattcctctggtggatctggacaaagtgagttgaaaaccttctggaaaggatacatcatttgagataccattaagaacattcatgattcatgggaggatgtcaaaacatcaacattagcagaagtttggaagaagttgattccagctctcatggatgacttggaaggcttcaagactttagtggaggaagtaagtgcagatgtggtagaaatagcaagagaactagaattagaagtggagcctgaagatatgactgaattgctgcaatctcctgataaaactggaatggatgaggtgttgctttttcttaaagataagcaaagaaagtggtttcttgagatggaagctattcctggtggaaatgctgtgaacattgtcaaaatgacaaaagatttagaatattccatcaacttagttgataaagcagcattaaagttggagatgattgactccaattttgaaagaagttctagcgtgggtaaaatgctatcaagtggcattgcatgctacaaacaaatcattcatgaaagaagagtcagttgatgtgggaagcttcattgttgccttattttaagaaattgccatagacacccccagcttcagcaaagacctccactgagcagctatcaacaatgaggcaagaccagcaaaaagattaccaattgctcaagactcaggtgactgttagtattttttagtaataaagaatgtttttaactaagtgtattttttaaacataatactattgcccacttaatagaccattgtgtaatgtaaatgtagcttttatatgcactgggaaaccaaaatattcttgtgacttgctttattgcaatattcactttattttagtagtctcaaactgaatctgtagtatctccgaggtgtagtatctccgaggtgttatatatatataacgttaaatatatatatttatatatatatatattttttttcacgaagtaagcatgcttttattatcagataaaaacattaaccaaatatgtctttttggggaataataaaaatgattaaacttactaatgtttttgctggggttagattatcaaagcatttttttaaacactgacacagtcattcatattttctaggagaaattaccatgcacctttggagtcattttttgatagaaaaggtgtccctaattgagagtaccaattttaaatttttgttggcaggtgctgctattgaattgtatttggattataaaattcacaagtttcataattggaggcttatggagtgtattgatgagatgattagaattactcttttggttatgtaagtttttaaataatggaagaagttctagaaatcatacaaaaatttccaaaataagactttcagaggctgtgaatgatactgattttctgtcatctttgtcatttaaacacagttctgtattatttttttgctcagcaataaaggagtcagtaggtccatctgtgtgtttctgtttgtattcatatcgtatatatgactattatgtatgtagtgtcttgaatgtgtatgtgtgtatatatatatatacatatatgttttcttttcttttttttttctttttttgagatagggtcttgctgtgttgcccaggctggtgtcctgtggtgcgatcatagctctctgtagccttgaactcttgggcgcaagggctcttccagcctcagcctcctaaatagctgggactacaggcacaagccatcatgcctttgctaattttctaattttttgtaaagacggagtcttgctgtattttccaggctggtcctgaactcctggcctcaaggaattcttcccatctcagtctcccaaagtgctgggattacacatatattttagactttggaaattaggaaaactgaaaatggagttttgttttgttttgttttgttttgttttcgagacggagactcattctgtcactcaggctggagtgcaatggtgcaatcttggctcattgcaacctccgcctcccaggttcaagtgattctcctgccttagcctcccgagtagctgagactacaggcatgcgccaccatgctcagctaattttttgtactttagtagagatggggtttcaccatgttggccagggtgatctcgaactcctgacctcaggtgatccacctgccctggcctcccaaatgaaaatggagttttcatttccatatatcacagttgtttttcaatataggtcttcagtgactggaagccattgctataggctggtaatttgataacccatttttgaaatgtatttattgagctcattgtaattcagtatgcctctggtgaaaggcgtgggatggtataggttgaaagaataatctgtggttgttccctacagagacgctgctgcccctttttgggcagtcatctttaacctggcacccactagtgtatttgctaaaatggaatattccaaaatttaaatgatgtcacatttgaaagcaatgccaagaaacaatgcggcagtttctaaattttgtgaagctaaaatccctggttacaagaaagagtacatgtcacagatgagtagttagtaatgacttcagtttagcaggaaaagagcaattcccatatgctgattctagtctcataacaaagaatgttatagaaagattgcacagtatttaacaagctgtgagttaatgtgacagtgtcggtgtatctagttccagaaggataatcactttaccatatttcttcaaaaatattttaagttatattccaaaacagaaaaccagatacatatgaatccagactgttccctgcaacacctccccacccccaagttaggtagtaaaatcaggtttaagcaattgaattgcttccgacctgctggctgccaaatacctgaataaatgtagaagttccattgtcagactctgaacctcagaggcttacctgttatataagggagagtgggtataaatgagagtgttacatcttgaactgtaattatccaaaacttagttttcagcgcttcagtttacctctaaccaagagcctctcctaatttgaacatagactacgcccttcaacacttacggatacgttaggagttgagaaaattaggtaaagttgtattgctttcagtcctttggaacacatactggatacaggcattggtactgtaggtgtgttagttaccagcaattcatttccagggtttttcccaaagacctgctgttttatgcgtgttcatattagtactatgatttgcttattcctgtgaacacgaacaacactgacagataacagttttgaacagtagacctgtgtcttttaaaagcttaaaactccatgcacatcattttgtcgttgcaaagacttctaaaggcaggcatggggaggcattgtggagtagggagaggatattatgtccttcagtgatttaaggaaatgcatgttttccatcatgaaagaaaagataatcattatcaaattcagaggagattgttttatcattcccataatgaacctgtgtctcttttaccaattaacatatagatggatattaggagaaaccaggttcaggtagaaagaggtacataaaattaataatccatcacgaggaatttctgcaaagtgccttttatagagaattttttttcttggaaatttttgaaattatcaagtataaagttgatgcttaaattatgttttaatctttcttaagactttctctggatgcagattatggaattaaggtgttttgatactgtgaaagtatgtgttgctaatactgtaacatactgtacatttactatactgtcaataatatatgtaactactactgagtattgactactttaagaagttaaggtctctcagtttgtcacaagagacattagtcttatatcaagggtttacctcatgaagtgacataggcaggcgactgacattccactaccagtattagactttttatttatttatttaatttttgagatagggtctcactctgttccccaagctggagtgcagtggcacgatctcagctcactgcgacctctgcctcccaagctcaagcaatcctcctgcctcagcctctggagtacctggaactacaggcatgtgccaccacgcctggttaattttttttttttttgtagagattgggtttcaccatgtcacccaggctggtttccaactcctggactcaagtggtccaccgacttggccttccaaagtgctgggattacaggcgtgaaccaccacgcctggccattatttgatttatactgtatttttagtgtacaagctgtttaagagaaacattgatcttaaagcataagagtcaatgattttgaaaaatgaaaacaagggaaatctggtcaaatttgcttttatccttccacccaaaattgtttggctgcctgcattttgtaatcatatagtgattgactgttggacatcgtggctcacacctgtaatcccagcactctggaaggccaaggtggcaggatggcttgagccttggagttcgagaccagcctgtgcaacacagggagacctcatctctacaaaaatatataaaattcaattaacccagaatggtagtacatgcctgttgtcccagatacttgggaggctgaagcaggagaattgcttgagtctggaaggtcaaggctgcaatgagccatgatcatgccactgcactctagctgggacaacagagcaagaccctgtttcagaaataaataaataaataaaatcatatagtgattgaattgatctgtgcagaaagtacctctttctcccaatggatgctggcatcttcattcagtatatatagagtggccactttgtgtgctacctgttagcagtttatagtctaatgggggaaggataggaggaatataagaaattatagcacattgcatttacaatctatttcagtatacattatcttattcatttaatttgtactctcttttctgtttattccctttaaaaaaaactttgtaaaataggccaattatacatattactgtgggaattaagaaagtaaagatgtgagtaagctcaaaaaaaagggtaaaaaccccgccaaaaccactgttggttttggttaatgtgcttgcataatcctttgaatctgtgtctttcctgagtgtatgtgtaaaactctgtgtgtaagtgtgtatatttctgtctgtatcctgtccaactttggcaaaggggtagttttgcccaaatttgcttttggagctaaaaggagatctctgcccacaccttttctgtgaggtctgttacctcacacttgagaacaatgtcaatttttggggccttaaaggcagtgttggcttctgcccaaaggtaccttcatgaccttaacacaaattcacaaatcaacctattttattcattgcactcatgtcttcgggctctccactgcagagtcttaaaggaattgttttggaatggacacaaagattactaacctctgtggaaaagtaccctgactttacagcgttcctacttcaaaaacaaactctgtctggatggcaagtcattgggagacttgagtgattaccggggagttttggtgtaaaatggaattttagattaacctttagcacctaaatctgaggtctgtcaagtctccgtttttatagatctgacttgaattaaagaggtgtgttgtgttgaagccttcctggcccttattttaactactgatttacatggggtgtatagtggggatcatcactgagttttgaccaagttctgggaaagctccctgtgggactgggaaaatctggctcattttggaaaacctaaatttatgtttttaaataatttggaaaacctggtaaaatgctacaggtataagaacttaagaattataatggatcaggataaacggggctagaataaaacactaagtacagtcaggcagtcaatggaaacaaacagatgggtgtcaagagctaagttagtgagttgatcagctctatttttgtcttttcaataagtttcatgaagcttgttcagcaaacatgagtaacttcaataagttcatgcagcaaatatttattaagcagcacctactcatttatgggatactgtactaaggtgtgataatatcaatatgaatgacaacaaaagaacactgtccaggcaagaatacaaataatgtaacagataaataaaatattgatagtcataactccaatatagctatataaagatgatcatagcacataaattctggaaaaatccagtatcattaatgtctccattaatgtataccagtcaccccatctttttatctgaacctgtgcgatatttctggggttttaaaaattccacttccttttacgatcagagttgaagatttgttttgaaacccatcacttttcttcattttctacctttcccttcttccgtctacatgtcacaccacatctagtttagttttcctaatctcttctttttagaaacttcaagtggcttcctgctttctccaagtggtccagcctcatcaactgggattcaagattctgtcttattaaccttggcaaccacgtcttccatgtgagccatttggtttaaacctagcttcttctctgtttcttgacatatgttaatattgttagcaaccgtttgtttctcttactcctgtttgctggaatccccttttctgtcccctgtagctgtgcaattcttacttctctctcaggataatcttcactctcatctctgttaactgtttcctctgccattgaccacgttggttattttattatgaacgaaagaaataatagaaatattaataaaagatagcaaacatttagtacttactgattacttttttgtgtgtgttttttttttgctttttttgttttgttttgttttttagatagagtctcactctgttgcccaggctggagtgtggtggtgctgtctcggctcactgtaacccccacctcccaggttcaagcgattctcctgcctcaggctcccaagtagctgagattacaggcacccgccaccacacccagctaatttttgtatttttggtagagagggtttcaccatgttggccaggctggtcttgaactcctggcctcaggctatcctcctgcctcaggctcccaaagtgttggggttaaaggcgtgagccaccacgcccagccaagtacttaactgattactttcaagggaatttactgtttacactgctcattttggtgctaaatcatgtctcctcctgtattattactgaaatgtttaatgtgagccttgtttctttaacaaaggtagattattgcttcttagagagcaataattttctcttcgaatttaaatatatgcccaataaatacataatatatgaataaattaattgattggatattttagaagtctgaaatgcccttgcccataagaagaatgtatgtatgacatttggggttgcattggtactttattttccagcctgatggacaagagtgattttaaaaccatcaatgcctctgcatctgtggcgcagtaaacaggaaccctattggaaattaaatgtgtcatcttgtgcttcatagccagactattaagcttttaggaagagatcaatttaaaataaattatatgtatgtacatatacattaatatgtaatatatagaatataatgattatatttacagggttatatttaattcctgatgataaaaaaaggacgattggcattatcttatcagaaaatgaaaaaatgcatcaaaatcagacaatattttaaagaaaaaatttatgtcatttcagtaatgcttttttacttgacataattatgtaggaaaactatccataatccagtagtaaacattatgtatgaaaacttgatgtgaacttttgtcaatacatatgatacattattatctaatgttttcaggaaaacaaattttctacaacatttatgtgttaatcttttatttcctggaattgaaaaatttaaccaaacaccacagaaattgctaataccactgaacttgtctcagttcccttaagaagccacattctctcttcatctgggcctttcccaggtctcctgccatttcttctgttggaatcactcaatcctctcttttcacctggccagtttttgctatccttgtttgtgttcttcctttttacccccagaaccccttgttgttataccaaactgggattagtcactgctcttccttgtttatttatttcttttctctaggtagactataagctcactcagggtaagtttcttctctgccttgttcacagttgtatcctcagcaccttactcaacactttactcaatgcctgacacatagttggccctcagaaactatgttgaatgaataaatgttacgtgagttttgacttaggagcatcagttatcatatcacttggtcagtttgcaatatttgcccaaaaataggatttagtgcaaaatgagtgctgatgccagcagatatctttgaccttggtttctggggaaaaaaaaattctcatatcagcttgtttggataattgcttgcagagtttccatgaaagggaagtggtagatgcacaaatggataaagtgtaggactttttgacaggactaactgcattctaacttattgcatcaaagactatagcagtcatctctcaagcagtattctggtcatcagaaaatattcttgaacagtgctatcttttaactggttagcactctccaaagtatttcatgtggttttttcactgttcataccctggactacatggattacctgccagggttcatctattattttagcttacctggactacattggtgagacttcatgaaggagaattccacttttatttcagtaaaccagggcaggatattttgggacctacaacaacctgtcttttctttcttctttttatcttttttttttttttaacctaagaagatggtaaacacttagtaggctgcaattttctttcttaatgactgtcataatgtctcacatttaatataacttgttctattttgatgttaaaacagggcattcttaatgttacaacaggattaaaagtactgtttggtactctcatgatatgttaactcttttacgaagtcatttaaataacagtattgtattttctgaatagcaccctggtttgcaggctcaataaacaagttatctttagcaggtatgaagatggtgataataccaccagataccagtactgtttaggtgaaatctgtagtaatttgcttttgaaataatcaggtaaaactgttactatgaaatgctgttttgcaaaaagttcaaaagactaatggatgtgattaactttaagttatcctatagagtgctactttttcttgggtattatgttgcttctttaacaaacatccttttctttccatgtgtaggcttatttcctgtagagagcagtaaaacatgtaaagcattattcatgctttgacttctagaacatgtaaagcattcatagattggggatcagtcaactaattcttactttgcttaaacccaaagttctcaagcttgtttaggtgactgtagtcttggactttgtgattctgtctgagaaactccgtggaatagtgttaaattatcatatcatacaaagatggggcaaattatgtgcaataaaatgtgattgtatcatatctgtgtgtacctacaaaacaaagactaaatgccacatgaaatagttttaaggaataagattttcaagttttcttagcacatttgtgggctgcctttttttttgttgttgttgtttgttttggttagttgctagtacacattagaagccatttgatactagaagccaaagtcttaagaaaatattaaccaggcataaagttgaaaactgatggcattgtacctattaacttatgttttttatgcaaaataagaaaccactcatcattattctgtttgtgagatgggatacctcggtctactgatattacatagatttacagcaaccaccttagatgaaggtagaatctagcacacacttcatgtaaacacagcatttattcagccttataaaaatattcagaattttagatacatgaatcctctgaaaaaaccacagtattgttttatttgctcatctgttccctccggtcttcttgggtaagcaggttaccttaaccccctttcagttccagtttcctcatttgtgaaataggactactaaataactatcaggcttttggtgaaaaccaactggggaaattacgtgagccagtaagcaaatggctggtcataataagtactcaagaaatattagttctcttccacctttatgtagcttgtctttgtcatataatcaaggtagtgcatcctcatggaacatttaatatctacagatgtgtgtctgtgcttgtccttccaccaccaccaccaccagcagaatcacatacagagttcttatcctctcttctgtttgcctgtctctgattatcttcacccctgttagggtgtctgttgctttcttctcttgtttttgcccttcatctctcttttcaaacccctcaccctttgaaatcccttttgttcagaacgctttcttttcaatttctcttctcttccttcttttaccacctgtttgcctgctggggcacatcctggccctttctcccgtacaattcagcctgaggcgtcaatgacccattccactccattggattgcttgatttgctcatcaaaatatcgcagctcaaaggtttctcttcattatattactccatgctctctgcagagcaactgctgtttcactgaaaaatcgcacacacactcttaaactttagctgaaaagtgcacagatcttaagtctgtagctcaatgaattattacaaaacaaatacacctgtgtaactatcactcatgtcaggaaatacaatattgccagtactctagaagccctttgtgctcctcctggtctctttcttcgtcctccaggaatcagtcactctcctgactgctaaacactttagatagttctacttgtttttgaactttacacgtgtccatatacattgaaagcatgcattcgtttgtgtctgccatgacacactcagcatcatgtttgtaaaattcattcatgttgtatgtagtttgttcatttgtattgtaccatagtattctgttgtatgaacaggtattgtattttataatcatatgccacaactttaaaaaatctattctactgctgatacagatttagcttgtttccagtttgagaaattcaggaagtaatactgtgagaattggtgtgtgtgtgtgtgcacgtgtgtttgtgtgtgtacgcgcattttaaaattaaacttctggttttgtgtccttctgaatgttttaagtttcttggcgtctaatccagatgtttgaggcttttctgtattctttttatgttccaggctattctcttaaaagataaactatttattttttatgtattatgctacttgtatagtatattttgagttttggaatgttggagaatacagaatgaaaaatttgtaaataaaacatatgtatatataagtgcatatatttatggtaaacattatatatttaataaacctattacataccatatgatgttcatgtataaaacatacataatcatccaaatatacaaacatgcaaattcattttactgattatggtactcttattatagaattatcactatatagagaatgtgccactttttaatgaactttcctctgtgtaatcagtctacagatatttttgatgtgtaaagttacacagacatttatggaatctaaatcaaaccaacatggctgtgatttaccattttaaaaaataaattcagtagttcttatgtctcacgacttgtacatttcttgatctgtgcccatggacctagagctatgatatctgattcttttttcagccgaaataaggagaaaattaatgccttgattccttggatgtcgtgatttggtttgttattatgttgttgagacaactttagcatttttctagctgttagtttcctgagcctatttaatatcaagagattcagactttccttgaagacaaaagcaatatatagaaatttctaagtgtgtcaacatccatccatccatccatccatccatccatccatccatccatccatgcatctaataagaacgagtgccttctgtgtcataggcctgtcactgtgaggaagggcatgttagtatcacttggctttttaaaaacttgcatgtcccttgtgccaatatgctattatactttattcctctgcaatagtcaccatcatagtctgctagtgctgatgatggaaatgagcctcagatgtgttgcacctggaaaaaacttgagatcactgatgagatgtagctatttatatatattgaattattttatatcaatattttgattagtatcacatatatgaatggatagctgttaatattttgaattaacaacaatgataatataaatcataatatattttctggtttgaagagtttcacagtctagaggggtagcctaaaacataaacacataattctgtgtgaagtggcaggtaccttgagagaagatatgcacaaggtgccacatgacagtggagaagactaagttttgcttgtgaaaattgtagagggctttgtagaagtgaatccattttagaggcatgtagtttggtaatgttggtgatgtgttaggcattatgaggcagattcgaaagttaggataatctggtactctgtgagaatattgggaagattgtatattcattcacttgacgtaactatagaggcagacaaatatgtttgatagcagcctttgtaacatggcgtcttgtagattgtgttctcttgtaagtttcttaaaatgttatcactttttgcattggttaactgttgttaaagtgattatgagaaatgcattgggaaaccaagtggtctttagattccttcagacccaacttgttcatgtgctaggtctgcacctagacaagcgatttaacttctccatgtcttagctgcattatctgtaaagtgtgaatgataatagtacttaaaggattgttcatccaaattaaaatcaaatgagataatgcactcttggcacagttcctggctcatataataagaacatgaaatattttttattagctagaaattcaggttagaatatgtatcaacactgaagatcataggccttaaaaaaacctacctctgacttttggtttctttcaacattcaattaaattctgaaagaactatttgtaaaacacctgaacctggaattatatatgtgtatttcccttactctgttatgataggggtccacaacaagattgatggagaaactaataattggggtgcagatggtgaaaatcttttctaaaggtgtgtgtgtgtgtatggctctgtgtatgtttagatagattcttaagtttatactgaatttgaaagtgaagattgacgagattgcctatacaaaatacttaacaagtgagctaatttctgcccgaattctgtagtcttactcctgtatgtcacatcactattcttcctctcatatgtgaatgtgtaaaatagaggctgtgtgggatgggtccagaaggaacttgtggtcatcctctcaggcttgaatctcaccactctatctggctttgtgtttacaattaatttaagtttaattacctgtttcagttttactttgacatctacctaacctattttttgctttatttctttctttctgatcttttgttttaatctttgggggtaaaataatgcaataatgataaaacaaaattcaaaagcctgtaaagctatgggatctgcttgggattttcaagggtgagatagggtctataatagacatgtgtttactgattgtgaccccaggcattggttttctgtccttcattgttaggataggtggatctggggacacagactgagtggagtggagaagaaaggatttattaataatcagggaggagcatgtgggatagatctgaggtatctgcaagcatttgagaactactgattgtaactatatgaactgaagatggctcagtgcaatcctgggtctttccacattccatatttaattaaaggcctttgccatatcttggttcctggctcaattttagtcagataaaatttaagttattataaaataataacaaatttggcatataaggttttaaactgatcacggtagctggacagcattagcaacaatagttgaaaaaatagagcttctttatgcagtgatatctgtataatctatttagctcaaagataacattgagtttatatccacgtatgtttatgaatgtgtaatttggacacctgggattttattgtatgtagatgttttatccgttccctttttaaaatccaatgttctatctgtaatgctctgccactacacattctttcaaaaaaattctgattctaaatctttaatgatgatatgcctcaatcttcttttaacatagatagctcttctggaaaaaaaacaaaaaaacaaaaacaaatccttcaaaacagccctcttcataacaaaacatcttagtctttttgccaagttagtgaaggaatactggttttttttgttttttgttttttgtttttttccttaactacgcgtgctttaaaatctcagttaaatttcttccttgagcattactttcttagagtggcctttcccactgtgttcatcagaacattagttttgttggctaaatggcactatgtgacataaagccaaatgagattgggaaatttcagtctagattggacacacgtcaccctctccaatccctaggacttcttagagctgtaaacgctaatgtacattgtggatctctgggagggatatgtattatacagtttccattaaacttaatctgaccaaggaatctcctttcattttctttttttgaagctaatattatgggaagagtctagagacaagtcttgggtttcttgtcatctatgcttaaacagttaccgtattaaaatcccaggcagagcttagctaaacttgcagtgagcatggcagaatgttctgaaataccataatattttttcagaaaaggttcttatagttgaagctttctaagcctgttacttatccaactccaaattatgaacggattatatgtttactttttttgcccatatataaagcttttcatatcctagaagtcaggaaaaagttatttaattttattatgagaagttgctttcaagtatatatatattttaagatcagttttctttggaacatttctccatacttaacaaaagagagaaaatgactcctgtgtgtgtgtgtgtgtaatttgtttttgtcagagggaaaaatgatgctaattaggttaaaataaggagttggcactaaatagggtggtagctaaaccaaattttgtattttgtaccaaatttctaaatcccttttgttgcgtgaatggattagctggttcattgtaatgtttgtgttatctgttggatatgtctatggttgtccttagtccattggttctcagatgggtgcaggccatttaaactgctccctgtggtagagtaggagtgagcctagtgctttgtgagttgtttcctagtttcatgaggaagaactattgcatatgaaggcacaaagttacttcccttcatttttagagatacacacacatgcacatgcacacatacagagtatattacaggtataagttctcagtatgtcttcataacatctggttttaatcttatattaaatttggcacttttaatactactaatagtaataaaacttactgaatatacttggcttactggtgctgtgaagacagcgagcattctaattgcactatgttatctttatggtaagcatctattagattcactatactgtatatgtgtgtcagtttaccaaatggatttgcagtgattgacacagatttattaagggagaacaaagaaagctgttagttatattggtggattgagttaataattgagattttcttttctattgattaacaggtaggaaaacagaaaaaagcaacattagtacataaaaatattaaactacctttactattcaatgatagttttcaccaaatgctggcaacatagtcaaagacattcctacaaagcacagcactcgttatttttgttatgagtgaaaatctaatttacatataataaaatgtcaattcacatcataaccatcaagataaatagaaacatttatactcttcgatgagctactctttttgaatttaagtgctgtgcttggctctttgcccagagaccagttgaaatagcctaagtttaacagagaagtagggatgaagttgaaactgacttgtgtgcaaatgtaaagtcagattggcctatgtgaatcaacagttgtcattgcagatattttaattgtgtgtgtgtgtgttttgagaggaaaacaaaaggaaaaactacttttctgcagggaaacaaatggtaacatttctcaatttgcacagtgaaattatgatcttattccaatcagggattttaatacatttgcctctcactggttatgaaaggaaaaataatcaattccccttgccttttgaggctccatgaggtattcttgctctattttagtttccctagttagtgaaataggtgcattctttttatatatatacatgtgtcctacagtgtcattgtgactatagcctaaagtctttgaaaaaagaaagttttgtaattttcttataaaagtacagtggttaatgcattttttctttaacatgtatttggatatatgaagattcatttaggcaaataggacatttattacttacttaccacactatctccttttacctagacaagtgcatttgaaatgagatatttaaaatctagagaacatagcaagatgaaataaaagcctaataaaatgtgtttgggctagcatcaaaacctttgaaataggatatctaaataatgtgcattttatctcagagggcttttggttagttctagtgtccagatgactattaatgggcttttgtgctctgaagcatatgttaatagaaatgatcattttggattagtttgatgtgaattaataagagatttatttggtggaagttgtttgaaggtgttgacatttaaaactcaacaagatttaagatgttcaaaaatagctttaaaaatttgggaacagtcaattcagagagagcaaattaaatagaaatggataggaaagaacaggatctgacattgagtttacgaagtttgaagcagtttataaaaaaagcgatctaccattgaagtattgccttggaatctgaagaaatagaaaacatctaaactccttcagtgattcttgagtttgtgaattggataaacaatgttctcttgcattttatagttcacttaagcaatctgattttgatctgtatatatggagtagacaggattcaagtgttttttttttttccctaaaccaatgagcaaacacatatgttctttcaaaactgaactgtatacattgttcatatggaagctatctagtttgctctaggcccaagatttgaccttccttttattttgctatcacttgcttaattctttaaattctttgtggggacttttgatcaaaagaaacattttttctttcttttaaaagtttttttaaaaataaaagctacatgaaatgtgtaattaataactcagtactcttatgctgatgtgtatacaagcaagcatggaagaaaacatactttttaaggcgaagaccatcgatgacttttctttttgtgttaagctttgatttcaaacagttgaaaagttttataagctggaaaaacaaaaagaaaatgtcatctggcattacatattatgaaaataagaactgttacttataattaaaaattatgcgcaacaagatttgaaactgaggtccaattacaggatcttgccctcctgattttttagagtcttgttcagaatgtgatgtgtgtgtgtctgtacatatatatgcacacacatatttgtttatgaaattatatttagaaagatactcagaagtgtcagttttccttgaggagttccttatagtcattttctttgctttttaagcatatctttctttcttaaattaatgacaaataataaaattaaagtcatcttgcttagtgtgtttggcacataactgaggttggatatatttactgaatgaatgaatattgggggaagtgagaaattgaagcaaagataggcttcggtggtatttaaaccacccttggcgccggtggtttgctgttctgtagtctttcagtgcaattgggcaaactttttaaaggtaaaattgaagtgctattaaccggaactattgtagagtcacagaggtgggggaattttagaaataatttattcaaattcccttattgtacaggtaaagatggaggctcagagaagcaaaaggacttgcccttgatcacacgagcaggtgatttaaatcaggtgtagaaactggatatgcaatttccatacgatttttactcatgttttgattctttactttgcttagggtcaagatactacaaagaatatagaatttatagaatttacacctcttaccttcaaagagtttctcatctaatggaaataaattttagttcacctgtgttgagctgatgcgtgatctaagctctgtttttaaattactgtgatagttgatttatttagttgaataatttatttgattatctattgcaaggttagttggagtaaatatgtcattaaatgtatgcatgtatatatttatatataatatatgaaatataactaaaacactagtggttaatttacagtatctagataatgatagaaaactcaaatcccttttgctgtgaaggtgccctcttgagaacatcagtcagtcttttacaggagaagatttttttttcttatgtatttaagcactttaaatagtgagataaaatagttagaattatttttaagctctaatgctgattatttctactgcataaatctgtctaaattatacggtaacagaaatagtgcactcctatttttataaaagtaaacacattttctaagaaagcaaagcatttagatttgttttatttagaaggaaatacggttaattaagagtagaaatttatgatttttacagatggaatgtcttatatctcagcaatgaaaattaatacaaatagaatattttgggaaagctacatatatttttaacctgcctaaatatcttggcgtataatatgcattctcattatatgggctgttcaggtggagaataatgtaatgtaggcctgctcactattacatagccccagaggtcaatttttaatctcacaattaaatagaggacttaaaatagcaattttgagctttgctgttctcctttaaattctttacctcctctttctcaacttcacttttagcccatcatctaaaatggcaattcatagtagacttactctaacgggcattttgaacttttccaggggtaaggtagactgcatgaaggatattgctatgtagtaggatgataaagtttaaaatagagttgccaaaactaatgactgtgttcattgttgtgattacgtattttaattgctttaagattttccctataaaagcatttgctggtgtttacaaattaagatcttttatccccaccccaatgtagttaagtattatggtcattagggttgaaggggttttagaggttaaataatttcaccaacatcacagtctgttatgaaaatgacttatgtcctgtaaccttttatatcatgttcctccttctcttgttgctttattaaaaccctggggagggagaggatcttgctccagatttgctcatgcttttatatctttcaggcagcctatgatgccagcatattaatatattttaggtgtgatacatgaaaatatgtttacatcatttaggaaggaaaatttttcttttgctttgttttgcagatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtatgattttacaagtatgtgatctattttttcaagtgaaaatgttaactggaaaagttcttggcacacagtaaaacatcgtgcaatctgttatttgtcttagagataataacttgagggtggctatagtcttatggtatctaacttacgactcgctaggggagtttcttccacttagaagtatgacaaatgtgcttatatttacataatctgtcactctgaaaaattacgatgatataattccagtaaaattatttcttctatagctacttcaaagtatagtcaactaaattaagcacatttttttaaaaaacagcaactaaagaacatgcccccgcccccacaacacaaaataaaacccaaatgacctttcagagatttctttgaagttttagcagtttaacagtctttgcaatgtatattattaagggctctattcagcataaggagtcatgagtcataagtgttctaagtatctgttcttgggtagaagaaggaactgaaattttagaaagatgataatttaattaagtcatattttctcccagccactaaagatgctggttgagtagtctttaaactatgacccattatatctcttcaatgtaacaataaatcaactagagctaaagcttctttttgttttgaaaaataagttaatttttaaaatactaatgtatttagatctattcacttttaagtattttatcttggttcccttgctatttaaaatgttgccattttcctaatcgctcaccctggcgttaacatatgggcataaaccattttctcatcattttgatggaaggctaaccttaatgaattagattatttcttcctcatttctttgtgagtcctgtcttttgatataggatttttatcttttttgtgtgtgtaaccttattcatttcatttaggtgattcagtgttaagttctagtcatcttaagaagaaactgttaaaatagaaatgatatagttattcagtaagggaagattatattgtaatagttagtgaagacattatgtgtaatggaaaaaattaacaatcaggaaattctggagggaaaggtaagagaagttgtatcaaaccttcacaattttatgtgtaggaatgtttgattacaacctaaaatatccttttctgtagaccaagttaaaaccatgcatattttgctcaaccttatattttaaatgataactaattttttcagtttgctcatttagtctttctttccctgttttccctttattgactactagtaaaattgcccttcggttttctgcatattttcacacattcccagggcttctttagtcacttctgacaaaagaatacaggactcctaaaaggttgacataacacataagacattgaaatgcaaacattaaaaaaaaatagtttaccagtgtttccttttttaacagtggttatcaagttttgttaattttagggcctaatagaatgacaccaagatgggaagctcatattccccttctttcctccagaagtcagtcaggtttacattgcctcaacgccaacactttcacttgaaacttcactcttccatcctatatatgtaattttgttccaagagggagcttttataggtatttggcgaataacattattgatgtgtaagaagaacagtgtactttctttctttttgtttttgtttttgcttttgtttttttttttgagatggagtttcactcttgtcgcccaggctggagtgcaatggcatgatcttggctcactgcaacctccgcttcctgggttcaagcagttctcctgcctcagcctccctagtagctgggattacaggcatgcaccaccacacccagctaatttttgtattttttttgtagagatggaatttcgccatgttggtcagctggtcttgaactcctgacctcaggtgatccacccgccgtggcctcccaaagtgctgggattacaggcgtgagcccctgtgcttggcccagtgtactttcttaagtaccattatgctatttttcacattattcactgtggcacatttttactttataaatgattccttatactctagtgcactatccttgttcagtgattcatataaaaattttgcatgaccagcttttcagaagcaaaggtacacttgtctatccaaagccagtgtggtacttcagtacttgtgagaaattatagatgaaaatgactaaacctcatgttattaatttagattttctcagcatgttttggataattgcggtataactaactgttagtccttatggcgaagtcaactaacaaagaagtcttgtttaatcagaatgtcacaggtggaattttccaagagacatttggggtgatgacttacacagcactcgacagctttttaagctgagtgattaagaaacagcagccacggaacccagtcctcgaccagcctttgttaatgcattctttaattgacactacacaaattgtttcttagtttattttatattcttaaagttctgactcattctactccagcagaagaatttgttccagtattcttcttttgaccccagtcactgatgtcactaacttaacttgagagacatggttgagctaatgtgtaaaggtgaaccatagcaaactgctaatattttgctgttttgaactacacaaggacaatgtcatatggttcagcttaatcttctttcttagtcagtttccagtgtgctcccagtggtggaacaggtactgttttcaccaggctgcatatggacacccagagcttattaggttccccagcatgctggacagagtcctaggaaaacctgatctgaccactgtgatgcatagcaggtctttcttctgactttcaggcaagccccaaatgtggctcaaagaaatttgttggtaggtcagagctggaacgtttgtcatcctccgcttcctgaaagtgatgaggcagttttcactctgtttataacatagctgtttctgtctttttgactatgaagatattttgtttgaaactatatttacaacccggttacatagggtaacaatatcgaattccaatttatgttatttatgtatacatatatgtaccatataaataaatgtgatgtattctataaccataaacacatatatgtattttataaacataacatgtgtacatgttatatataatatagaccatatataaatatataagcatgcatatatattgttagctacaatcaaaggaagaaattgggcaaaaatatattttcaggaaagaataagtaatagggagggtaaacctagtaataaaaataaatccttcattattcctaaaaccaccttaaaataataaatgagccagtcttggttacaaaagtaattctaaatgtaaattgtttgttttagtctcaactttttgctgtttttagaatgggtttttttttttttcctagaggaagcatttgattatgcaccttaaaaaactcacataagtaaaatattccagattcaactgtatctctgtaactttcagataacactgtatctgccttttccctttatctttgcagatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtttgtactttgtattgtctctttgtacagaaaaagttattagaaatgaaatgtgaattcttatattcatgttaaaaccaaggtcccagtaccagacaggtagcctgctagatctagcagaagagatggacacactccatagctacttcatacaagtatattcagagttgtctaaagacaacttttagcctcttattgtggaaaacaatcctagcatttttttaaatttgggaaagtcttttcatggaattagctaagcttcacaattctgggcatatgtcatggtaatttgatgttttcacagtcttccaaaaatgttactaatctttatggttgcacatgataataattcatgccttgttccagttttagattataaggcttttgctataatctttctttcagtgaggatatttcctgtatcttggattaggatttgattttatattcatcctgacggttcatattgatggttgcagagatagtcctgaaaaggcaaaataattgcaaatgaaaactgggatataacattttatgttgattagaaagaagtaaatgttattttaagtattagggacagcagaatgaccttggtaggggccaataaagcattcctttctgcatttaaggaaaatggcaataatttatgaaagcatttagtaataatttagatttttacttttattaaaaacagcctacctttttgttctatctttctgtctttagtttatggcatatgtgaaatggaaaaaagaaactgttaccattttgaatagaacgaaacatggaactgagtctaaataaatgtatacatttaattttagtaattttagcatagtcaaaattcatggtcagcttgagaaagtgtattagtttttgttacagtttgtagatttttattgtattataaggccagggggatttcaaaacatattagctttactagtaactttttttaggaatgattagaagtacccagagaactaatgaaataaatcccttaaaatatcagtcatttttatccacttgatagctacagctcatttgtctcagacctctctattgacctaataccaattaagaaaagcaggcaaagaggttgtaaataacaggtagtgaacatattttgcaatacttgtaagaagaatcagaagagaaatttcctggtcctttaaatgtcagaatggcaatcttatcactttaagggagatataaagaactcttaaaacaccagtttcatcttggtaaagttctctaaaaattccatcttagtttgtgattttccacagatagaattatttctgtggagcagcaaattaacccaacatagttattatgcatgaaagctacatgctttgaactgctgtctattaaagatcatttcactgtcttatgtcagatacactctgctgtcaaactatgattgggaagcaaatacttgttttagataaaagggttggaagtgaataatgtcagtatgtgaaacagtgttttataattagcaagtaatatgaagttaatacctggatttccggcaggcgtttcagtctgttcactctagggacaacttctgagggaagctgatctaggctgtcagggaaaactctaaaaacgaaaattactaaggcctatagtttggaagaattcagatttttaaacacacttccatttcccccaaacagttatttgttaggttcttagttatttatagtaaagtttatgtttgggtagaaggagctggacacttttcctgggcagtgattttagaagtaaaacagatgtgtgagctatctgagtttgaactaatagaactagaaataaaacagctgatcctagactatgctgtctgctaaatccttgcagcacacaccgaggaagacaaaaagtggtaggaaagagcatgcaggaacataatcttgttaagataatttttttccaagataaataatactgttaaaaatagaaaaaagtaatctgtggcaacagcgcgtgattatttcaaacaaacaattggattttgaaacgcatctaaagggttaacttcaatttgtgaggataacactgaatatacttgtagatcgaatgctaatcttgaatgctttgcacatatgccagatactgctgcagaaaaatgtctgaagataagtaacttattagtatcttcatgctgaaataaatattgaacagtttttctatatgcataaaatgaataaaaacgcatctgaaatttccttttataccaacaagtttatgttactgaaatgctatttgagagattctttccttggtggttaaacttcgtggaggctaaaagctgtgggagataaaatgctgactatagaatttctttaatgtagttttgtcagaaatatatagtaagttaatggcctgtgtgtattctgataaaaagatgttggtaaatatgagtattacagacaatcgttcaattttaggaattatatataagtccataatttaagctaattgaagtaatagatgaagaattcattaatccttttcaattaaacttgctttttaaaaaacattcagaacagttggtggttaatgatagatttatgacattttaggccaaaaaaaaaaaaaaagtaacagaagccaaaagcaaaacactgaaagaactctatggctttgatctatattttggtttgacatggatggttttaaataatttgaatggacttgagagcaaatatgagatatacagttgggaaaagaagtacataatttaaacaaattcgaagatttcccggtttaagtgcaagttatttcaaatatacttggaggaataattgaaatttagacatgcttgtgctgataatatccacttttgtataaattagatcacaaatgactaagtcaaagaattacaactttgtaaaaatactgccaaataacaatgtttctttgtgctgcatagaagatagagccccagccggataatggaggtcactgtaaatagccatcagaaagccaagactgtcctttctgagtgtggcatttatcagattctccccccaacaccttgaggtagcatgcccagtcctaaaagcagaagacatgtaaattctttaccaagaaaacaagagaagctataatggctagcttagagctaattgatttgaccaggatgttagttttccaatttttcatttatccagcatgttctatcagttgtcatgcttaaatttgtaaaaatcatagatgcagcatgattggttagcttttcatgtaatatttactatctgtattcggccatagaggctcacatggagaccaataatacaagagatcgagttcttaaaaaagtaattacagcttctttctttttatttttttctttttctttttggagatggagatctcactctgtcacccaggctggagtgcagtggcatggtctcagctcactgcaacctccgcctcccaggttcaagttattctcctgcctcagcctcccgagtagctgagataacaggtgtgcaccaccacgcccagctaatttttttgtatttttagtagagacggggtttcaccatattggccaggctggtctcgaactcctgaccacccgcctcggcctcccaaagtgctgggattacaggcgtgagccaccgcgccctgctagcttctttctttttaatctgctttattatgcttatatttaaaccattactgaatggaggcctgcattaacaacgcggcctttgctgtttcattagggtgtaatgcgctgtgcattgggtgtttgcatcatctttattggggagcttttagccctcagatcaggttataaaagtaggagtcttgtcaagttgtgcttcccacgggaaagtgtttatgctatcccaagttcagatgcttatgatatatatgttgccttttcatattagtgaattctttttattactgcattattcaggactttaagaaggtagctactggtttccagctattaaatttattttggcccttaatgaaattctaaggctaatagaagaatcacatgattaacttaccaagtactgtcttatgtttgagctaggagtgttacatttctgtgttgtaaatatttttatcagagttgcacaatatgtcatgttagaagcaggaagaacagattttagagagaggaagtcatcctttggatttgtattttcaacagatttaattgtatgagtttatagatctttaacatgtatcagtacaatcgtttgagcaggggattacagtttggtttgaaaaaaaaatcagagaccattaatcttactgtggtttattttgacttgtcttgaattttacttctaaacatttattttttgccttggcattttctttgatctggagtaggagggaagttgtagatcttagcaggttctgtttctttgtttttctgagttgaggacaattgcagtttagaaaaactggtgaatgagacttttatcaattcagactgtctatagaatacagaatgtttggcatatgaacccacacttctttttcaggactgtgtctccttaacaagtaataaagtgtgcaaaataagacatatgctcacctcaaggccataaagcaaggcaaagttctggtatttaccaggttattttcatcagtggagatggcagagctaaataatgtagccaccctagtagaatagttcaactatcattactaatccctttacctgcatgacagttaaatcttttttggccttgttcatgacagttggtatcatctttgatttttggtttatttgttatcatttaaaggaacatgtataattttgttgaatatcagtatttttctctatgcagaatgtttaggagaataaattgtggttatcagtggattcaatcaaatttagcattattcaactcctaagaaaatcttttacctctcctatggcctgctctgctaaccatctcaagtcaggaggttactcagtgtttttttatttcttggatcattgtaattacagcatacgtgcagctgttagaaacacagatatacaagtagtgtgccaatacggggaaagtttggagagagaaagttgttctgtttcattttctgatttcctttgtagagtctgattctgacagtcattagaccatagatgtcttgaattcttcatcaggcgatccacatttgaggcaaatgttatacgttttcagaatatcatacaaacccttgtttaattttaattgaaagtcaaatgtaaaatttatttttctgtcttacatttaagttgattcatacttctttcatcttttagtttacataatcaaaatttgtacagatcccttatttttttccaattttggattcacatctaataatagctaaaatttactaagggttcttatgtgtgtatgtggagctcagttttttacatgtattaatgaactcatcttcataatagccctagaagtaaacactaaccttatgtccatttaaaaaaataaggaaacagcatatattaaagtatcctgcccaagatcacagagttgcataagtagagagaatgggatgtaaaccatgatagacaggccacggaagcctgtcttcacaaccacactgatatatggcctggccaaacatgagtctgagtttactgccaatagcaaagcaatagaaggtaggccaattgcatgtaagggaggagatagaagacataaatcagagctctttgatgcagtctctctgaatgaggttgattttggggacttgggtgatttctttgagattatctgctatctgctccgtgtagtgtaatgctaccttatttgaacttactaagcttctattcgaaatcagtaaaaagaaaattaaatttgctgactcatctttttaaaattacagtgattccttttccctggtacttttgctgcaggaattagttctggtagagcgaataaggtgcaaattttgatgtaatcaattaaggatgtaatgtttgatccccaaattaagggacatttcatccaggtgtttgactttttttgtactcccctcatttagaggactttgttttaggaatttattatttaaatgatggtctgaaagttgtcttatgctcttctagttaccaggcacaatttaggttgttttttttccatgcagattacatgttaaggagatacactccattcccatttatgtcctccaaggctgtgtaattaaggttttatcctccgcctacattcagtgcaggaatgggtgtggaagcagagaacaaatcagaatgcctttagagtgtccaatttgagtgtgctggattctccagctgtgcttggagctgtgtgatttcattgaattcagaaagcaatagacgggtgggacatagtgaggagtttgggaattcacagagtctcctggcctagcatttctcctttcatgtttagttgaactgttgatataagattaaagaatgcctgcatcctttcatgtgtccaggaacatatctgggaatcttataataaatgatggtttgttccaagacctgtttttccagctgatgggaagctccaccttggaattcattggcacttcaaagtcaacatatgtaaaagtgaagttccccacaacaactttctttttgcctcctttcttctttactcctgttttcagctaagtcaggctggaaatcttggagttaccttggatttctgtttgatatcacgccccaaacacttgagcagtgtgtcccattgttcccttctttattcttttactgtcacttctttcaagtaaatccttattgatttcttttctgttgttctagctttatcttcccttcttgtctcttcctttcccttctcttctcacctcctattctttcctcctcctcctcatcttcctctcctttcctttgatttcttttttgtgctctttcttgtcttcttctgtttttatttccttcctcattccttcttcttcctcctctcttttgcctcttttttctgttcttttcttctgtcctccttcttttatcttcctttctccttctctttttttcatcctccttcctttctctttttttctcccaccctctcaccttcctttctttcttctttcctttaatttttaaaaattctgtttattgatcagttgtcctacattttatagcaagtatgggactacttctgttgaaaagcatatcatctaattatacttgcttatgtaaatatcagctctccaataagacattaactttccagattaaatctcactattcttccagaaaggataatagtaagaacaaggctagcacatttatattacttattacatttatattacttattacatagcaagcaccgttatgtaccatattccatttaacgatttgataatgcctcggccctcctcagtatttcctgagagcagcttgcattgtcttactctcgctgttgattttactggttttgtttccttcacctgaaatgccctttcatgatcactgcctttgaggctaaccttcacatatcagctcatctgtccacagctcagttgttacttctgggagcctttgctgactcctcagtctgggttaggggctcttcctctgtgttgtcatggaacctgttacatgtctcagcagaagcatgttttccattgttgttgtctttttagttgtgagctttttgtgctaaaccatagacatgttacgatttttgactatgtcattctttttgtatttccagtgcttggcacatagtagatgtgttaaaacagcaaccttccctggaggaaggatgttctatattttcggagattagattttctcttttcccattaagatgctctttagaatacatgtgcaattctgacatatctccattatgaaccagcagcacctgcaggttggatgctgtagaggagtgctatggggaattcacttagctttgtaacccacttgaactgcattttgtcttgtttatttttcctataaaatattgtcttccaatttattaagatggactttttttttttttttttgatatggagtcttgctctgttgcccaggctggagtgcagtggcatggtctcggctcactgcaacctccgccccccaggctcaagcgattctcccacctcagcctcccgagtagctgggattacaggcacctgccaccacatctggctaatttttgtatttttattagacacagggtttcaccatgttggccaggctggtctcgaactcctgatctcaggtgatccgcccgccttggcctcccaaagtgctgggattacaggtgtgagccactgtccccggcctattaagatggactttaagatttattggtactctgtcatctgaaataccagataatatagaaaaattaattcagaattatactgagtaaaatgagaaaaccagtttagggtaaactgtttattgctattatgcaaaaagccaataataaaaatctgcataatgaggaatatgcagtattttcttcttcaatgtgcccagtgtaggagtttgagttttggtttcccctgtaccctcccctgccgttggttggctcttgtattataaatccaaataagggagttgttacagtgtcactgataggaataaacctcagaaataagctatggatggcatgagagtcagatgatgccatataatttgagttgttattgagattctgaaacatttattctccatcaaaagtatatcactgaagcacactctatattctagaatgtttttttgaagcactatacatgcagaaaaattcccgatgtatataagcagattaattctggctgtagttattttccgctaagatcggcccttacagacttttttcaagttattcgaaatatcagtatttgaacagtgatttttttttaacaacttagctttttatttttaagcttttacctctttgactatcagcccataacctcaagttctcttaaattagtacccttataattgtctctgttgctatcaattatagtacttgaaaatgaaccacaactgagaagaggtttgtgtttagttcaaacaactctttctttgctgcgttgaaaataagtacatgtgttgaagtgtcattttaagagctctgaggctttaagaaatattttcctttgacatattattttagatattattcttgttagcttttgctccatattattgggaggaaagaaagaaactgagattaatgaccttgaaagaaaccaacccttttatattcttcacttctacggtaaaacatttttgtgtgtgtgtaaaaagacatatgtaaataaattataaatgaaagccatggaaaacacttcatggaaggaatagtttttaaaactagggctaaaatcaagtataaaaagccatgctagtccttagtcagtgaaaaagactttaaaatactcttttttgtgccttaattgttttaggtgtttttatataactttaattcacaatcaaaggactccatagtcagtcatttgcttgtggacaaaagatgcattttgtagtttcttgaagaaggccatgtatgccaggtcaagtcagtggtgagggtgccatgaagtactgtggccagcgaatctcaggtaactcaggggccttggtgagacattttcatctgcttacatctcccttcgttcattcattcagtcaaaatgcattgaactcctgctttcttctagatgtgaataagactattcttgtagctcaagaaggaatataaacagaagtattatcttagtaacagcagattgaacctttgcatttacagctaagaatattgatagtgacaagtgtgtgagtttgtcactgaatgaatttaccacttcccttctatgtaatctctttatcccatttgcaggaaaaatttacttgaatgattcattttattaaataataatcctacctatgcacatgttactgttgagtgtgctatctaatatggtattccctaacaaaatgtggctatttaaattttaggctgggcatggtggtgcatgccgtaatcccagcattttgtgaggccaaggcaagtggctagcttgagcccaggagttcaagaccagtctgggcaacatggcaaaaccctgtttccacaaaaaatacaaaaattagctgggtgtggtggcatgtgtctgttgtctcagctactctggaggctaaggtgggaagattcacttgagcccaggaggcagaggtgacagtgagcggagatcgtgacattgcactccagcctgggtgacagactgagaccctgcctctaaaaaagaaatttttaaaataaatacatttcagttaattacaaataaattagtgaaatgctgagaaaaatatatgaaagtaaatttaaaaaacagttcttcatttttactaagcctacttgtggctagtggctaccatattggccaaggaaggctatggaacatttttatcatctcaggaagtactattggacagcacaaatccatagttctcacttgatcctcacgataatcctataaaatgacaagttgtacagtattgtatccatagaggccaggagactaaggttccaagaggttaaataatgtatcttttcatagaacttgagctagagaacttcctctagaagcaaataaatacaggcagatgtaaatacaaataaataaagggttttatctacaatttttaaatcttacaatgtaagtatcttgaaggcagagatgttgtctacctcttcaatattatatgcctaatatctattgcagagtctgacacaagccgaacacttagttactactaattagagggataaatacgtgtagtttttggcccaaacagaaattacagtttaatataattgtaaaaatttggatgtctttaccaaaggaactgctgggtttaaagggttataattaaagttctggttagtaaaagaaggaagtttgaaagctctgctctctattctgcttgcactctctttttagtatagtcacagctaagaagcagtaaattttcctactccgtgatggattcagccatttgaaaagtttgcaatattctatgaatgtgtaggcactgtttccagacaataagtttcaataaaccattgctgaaaacacttattttgcataattgttctcactgtgtatttgtttttaccctagaaaagaatagatttaaaatagcataaatggggcatgcaaataaaatgagtatggtcaatagacaccagtagtgtctcctaaaataataaattatgttttattgtagaatggcatttaaatgttgtatgtcatctatatttcgctatgacttgagtgtacatctaccagtatagaaagtataaaaattgccacaaatagagcttttaggtgttctttttgaaataaaaaaggaatagaacactgtcattatgttttccaaaactgcgttttaaaatatgtgattctaatattatattagcttttaataatatataatactaatattatttaccgatattaaccaaaaacgcaaatatgtgacctatagaagtgtcattattgttcttgccattaaatgagatccgtgagttttcattttttagcttggcttttgaaagagcagtcaatagtatgaaggtattcattcttcagcataattaaaatatatagcccttaaaagcttcttaaataatgaagttggcacattttccctgggtttaacaaaaaaaaaaaaacacatctagacacgtacaccaacttcaaagacctaactcgttttttatagcttagttaatcctaaaccaaaatgctttactgataatttttcacaaagttgccttctttcgtagtcccttctcctgatagtattgattcgtagcctgggttttctgacttcttaggttgtttttaaataacaacaacctttttagtatgttgggatgcttagtaataatttaaatccacttcagaatcatatgtttagggatttcttaagtatatgtatgctctttgttcaaccctttcagtgtgatcatggcacatgaggcttaaagattgcaaaatcaaagaaatagtgatgatgcctggtggtttcttgggaatcttgggtcaacaagcagaagttcaaagcattttataatagggaagcttggcaaggcagatgcaatgtgaaagcttaaacaagaaaatttttatctctagattttgcatactttctttctttgcctgtgttaaagaaggggatacatctgaatttatcccttttgaatcaagtttaagttccggaacaaagaacctgattgatggctatccatttaaatatatatatgtattttttttttttttttggcaaatgaaccttctctttacctccagtgaattgggaaatatatgtagagatttttacaatattatgaattatatttcagtattatgaattatatttcagtgcaagttttagttgctttagtcacttaaatgctagattagagtgttctgtgctgtatccttgagtgtatggctttgaaacctctcacaccattgaatgattgtcaggttgctgcctggaagggtgccccattcttagctttctggctggttgatgctctgtcattgacagactgaaatctatgtgattggggttctggttatagacattgcctaatgtgaaatattacatcctttgattaaaggctgtggaaaacttctgtaagatcctatcttaatgtacagtaaatgttgagttgtttatatattaatgcacatttcttagaactataatactggacataaatttggaggttgccccagttgaagaagctattggccagagagattaagtaatttgatcaaggtcacatctctttttaatagcaaaaagaatacttcaatcttagtcctgtacaatagaggtacaaacatatctctcagtgtactacagcaatattatttgcatttcaaatagagcctttacgtgattttgagatgcctgagacttttctcatgcagtgatttggatatgaacagcgatcacacgtgtcatttttgaacagctgttgaagaaggcagaagatgattatgccacttgcttaatatattacatctggttgctgggaaaatttaaaaattccctggtggttggaagagaaattgttttccctttttggagtatttcattcaaaaactctattttaaactctgaattttggctgctcagtggtggcttaattgtactgcctattgaggtgcacactgagaatggaggaaggattttatgcaaagtgccctttgaaggctttcatagtcctgattccatgtaatttcataatttgggaaagaaagcagagttgtagtgattttttatggtggaattattttattttaccattcagacatcatgacctactcatgtgagaagttgggagccctttgcaatgaaacagaaccttaatcaaataaggcatggaagatttttctttttttttgtttgttctagatggggaaacattcaaaattctttatttacacggttcttctttgctagtatttcctgcatactcaattcatctttttgtttgtttcactgtgctttaattataagccattttgggtggtcattggagcacctttattttacctaaaacagagacctcatctttgcctgcagcctcattgctgtaggaactgaacagaatatttccttggagaacatctgcattgagtaatttttgagcaagtgcctctagttttgacagtaacgcttcaccttttgaaaagaaatcccatgtgatttggatgcttctgtaggaatgtgatttgaaggaggcaatagtaaaatgtactgtgttgaaaattgttttcttagtttaaaaaatgtattattaagtctttcaaattatagtgcatttattacttaccttcacctgttactttggcctacagtgtataacataatgagcctctcaaagagtagctgttgagaaatgaagagtgaatttatttggctctgattattcaagtgatttcataataagcaggagtactattgtattttttgatgtggaatacttggcagtaccctccccctcccctgcagagggcccattgaattaatgacaccttggaagtaaagtccatttcttctgttctccaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggtgaggcatggggggtggggtcgggaggaatatacaaataaaataatagaaaaaatccatagaaagagggctgaaccgggaattgttgagagtgattccaatgacttggggaagttataggagaagaccacataaaagttcatcacagatttgcaggtgatatagttacagctgtgatcactgtagattttaatttggttccttcttttggactgtatgctcatgtttcatacttgtgttataccatttactgattgtctttttaaattcacagtgattctaataatgctgatgagtttactaatttaccgtagtccatttatttatccttactaaatatgactccacatcctatatttttttgacagagctaaatgaaagatgctattgtaaatatatcctattctctattctgcaaaaaaattttgagaacctgttgctcatttttattttaaaatgagattatatattcttctggctttgaacaattctgcaacatccttgtttagcatacaaacagtaatctaaaggtgagaatttttgtactatgtgtgattttggatgtagacttgctcctccaagcaggtaaaactgcttgagttattccagattcttaaatggatgtgggatgtttgtgttttccttctgctttcactctattctctttataaacattaactttcccagttaatcttttataatatctagagataagcataggatatgtatctttatttcatgtatgcattcattctttaattaattgatttcaaaaatcctattgtaccaggcattgaatatacaagagaagacatagtcagtgccctcatggaacttacagtttagtagggaagatgagacacttagatgattacaagagtaataagtgtcataaaagatgaagtacaaggcagtgtgtttgaatataatgataacataacctaatatggtagattaggaaattacttcctcgggaaggagcatttaaactgagacttggttataaataggaattagttcagcaaagcattggtggtaccctgcgtttaggtattatttagtgctcattgggtactttctcattattatgcctttcagcatcaaagtagaaagctttacttactataccaatatgctagtctaaaaatctattcaatttctacatcccatgatattaaacagtttcttccactccttttaaaagttttgtgttagtgcaagtgtgtgtatgttttttcagtcaccagtaatgaagcagttcatgtccaacaataggctcataatgtgagatgttaatttgaagggcatcccaatgttcacagtgaatcaaaatgttcaaaaaacacttacttgagatttacactgtttaatttataaggtcagccctgggaaagacacagtcctgcatcaaatatgtgttcacacttgcaatgagtgtttctggctcctctgatgttagctgcatgttaatttatttctgaggctcgcagacatcagctgctttctgagctttactagcgtggatatgtgtgtatgtgcacattgtgcatgtacatgtgttgagtgatgtaaaaatcagatagtccattctttttttgaaaaggacaaggacaactttttttttgagaaatcttcatgattttctttaatcatgaggaaaccagccagaacacacacacatcttggacctgcacacccacgtatgtgcgcacacacacacacacgcacacgcactcattctgatacatctagataccagctcagttggacaagtggtttttctattgatgcagctgaggcattgcttgagaatgtctgggaaaacagggttttcacatgctttaggtaaacaaaataatcccccaagaaataaaatatgaataaaactattactgaataatgtcagaatttagttaatattcagtgatgaaagtaagctctagagaaaagagaactattcttttcttgttcaccactgtatctgcacgatttaacacagtggcaggatgcctaatgggagttcaatgagtatctttatgtaaatgagatccctgtgagtttttgacttcacagtagttatgaataagctgagatttccaggtgagttacattttaatgcttcactattatatggtcttggaacccttctgaggacctaggcttccatgccaaatgacagttgtctgttcattttgaccttaagtcaacttctcagcattttattagctaaaaattgaaatagcacttgtccatagggcattaaaatattcttgcacttatgtttaaatcctgatatagtttggctgaccagggatcctttaaggtgctgagtagtttatctctaatctgtttctgagttcttatagagatatttgaaatttggagccttacaatttcagaagtcacagcttagtagaaaagataaagaaactcgactgaaagctgaacagtaatagtggccccagagatgtgaaagaacatagtcacgtggatgtttagaacttgatctgctatcaaagcattttctaaaaatgctccccttttaagataaaataagaggacaagtttaccttatcacgtagtatctttataatttaatttgtttactcagattattcatgttgggaaacttctgccataattctgtgttatttctgtgaaatattctaggcttttgagtgctttatatagaagacttaatggtgtagtaaaaattagcataagccatgaactgtataatatgtgaaatcatttagctataaaatgactatagctgagaagcagaagagtttatctagagctctgagtgaaaaacctcagtgtcgattctgttgcatgggtgctttctttaagagctaagttaaacttggtggaactgcaaacatgatctagtcagcaacagggacttagtacattcacttaatgtttagtatttacctataatacccctaactcagactataactgggttattatattccacccatgaatggttttctcactgcatttcttttattatttatcatttaattcaactgtgtacctgctctctattaactgctacttttcttatcaaaattttcagtgttataacttaggtttttggcacgagtaggaggattacttccctacaaaacaactatactagataaaacatattttgtaatgcattgccagacttctacaaagtaagaaaaatttttggagcctttgttctccctttcatcaagagtgcactaaacacagagtagggagaagtgaagggtaagcttggaatgtgaggttacactgagggcaaatgccaatgtcgatgttgcatttgatctgaagactaagcctggagttactcatagagagaaggggacgaatctgagttttgctttaagcttagatcttaaaggtggctaggatttttacattagttcttcctctgacttctggcataattaaacacaaatttgtctgtagaaaagtactccaaattttacctccaagatattgatagatgcagataaatcttacatgagctcactattacgaaaattcaccatatggacaggaaaataagccatcatgtgtgaaatcagtagaaaacacaaataatagatgtatatacccagtcacttcagatacaggagttttcaattataaaatactaataagcattcaaagatatgaatgttacaattaaaaaatcatcaagcaacatgagactatatgaacaggcacttcgcaaaagaagatatttatgcggccaataaacatatgagaaaagctcatcaccactgatcattagagaaatgcaagtcaaaaacacaatgagataccatctcatgccagttagaatggagattattaaaaagtcaggaaacagatgctggtgaggatgtggagaaataggaacacttttacactgttggtgggagtgtaaattagttcaaccattgtggaagactatgtgatgattcctcaaggatctagaaccagaaattaccatttgacccagcaatcccattactgggtatatacgcaaaggattataaatcattctactataaagacacatgcacatgtatgtttattgtaccattgttcacaatagcaaagacttggaaccaacccaaatgtccaccaatgatagattggataaagaaaatgtggcacatatacaccacggaatactatgcagccataaaaaagcgagttggtgtcctttgcagggacatggatggagccggaaaccatcattctcagcaaactaacacaggaacagaaaaccaaacaccgcatgttctcacttataagtgggagttgaacaatgagaacatatggacacggtgtggagggggacatcacacactgggcttgttggagagtcgggggcaaggggagggagagcattaggacaaatacctaatgcatgtggggcttaaaacctagatgacaggttgataggtgcagcaaaccacgatggcacatgtatacctgtgtaacaaacctgcacggtctgcacatgtaccccaaaacttaaagtaaaattaaaaaaaaatcaagatcaccaaaaaattaacaaataacattgttttaattgagaaatataactctcgaaacttaaaacatatggattgattaaactacatattagacaaagagagcaaatgaattaatcaaaatgaggcattagacagaatatttaagagagagcaaggaggggcaaaatatcaaagacatttagtaagatatggaatataatgagctattgtaacatacatctaatcagagtcccagaagaaagaaaatgtacagaatagagagtaggtaatcagtatttgaggagaaaatggaaaaagattttctagaaccaatgaaagacataaatactcagatacaaagaagcgtagcatacactaagcaggatgatgtataggaataaattcagttacacacacattgtagcaaaaatgagaatgccaaggcagagacatccttaaaaacagctgtagactaacaagaaatcgactactcagaaaagacatttaggttggcagactttttattagcaacaatggaaactggaggaaggaggaatattattcagagtttggaaaaaacatcaaatagtcaaccttgtattttctgcccatcaaagctatctcctaagaataagagcaaagcaaagacattttctgataagtgaagaccagggaaacatctgagcaaatccaaacaaacattgcctgtcttgtttatgtagttcaaaaaggaacagactaggcagggcacagtggctcacacctgaaatcccagcatgtgggaggccaaggcttgaacccagaagtttgagatcagcctgggcagcataccaagatctcgtctctaaaaaaaacaaaaaataaaaacatgatctgagtatagtggtgattacctgtggtcccaggtactcaggcgctgagatgggaggatcacttaagcccaggaggtcgaggctgcagtaagccatgatcatgccactggcctgggcgacaaagactaaggtattgcttagtgctactatgtaagtttgaagggaaaatgactagaattaaggtattctaagacacctgaattgttgggagttagcgagctaggactttgttatacatacttggaaaaatttaaggataactaatgaaagaataggaaatgaatgcataacttccaaaactatagaggagaaaaaatggaatgatgaaataaagaacacccataaaattcaatcaactttttaaaaaatggtgagaaaatatgtgggaagtgttagacatgtagacattttaaagtaaaatctataaaaattgtagatatcaaaagtcttaacctgtgtttgttaaacttttccactgaaaagatatcagatgatgtaactgtatcctgcatactgtatatacacctgaaacataagtctctggatgttcaaaagaaaagaatagacttagttataccagcaaatataaactaaaggaaaattgaggtatctttattaatctcatacaattttaagaatttattacaaatagcctatggaggaaagaagggatcattgcataataagaggtttaacttcttcagaaagtacaatggttctaaatacataacacataaatacaaataagtaaagcaaaaagtgatagaggaactacagggaaaacatgacacaccacactcacaatgataaagttttaggaaaattccttattaaaagttaagcacaaaaaatttttcaaaattgaaaagatttgagcaacaaattatcacacctgatttgataaaaatatacaaattctgtaccaaacaattagagaatgtacatgcttttgaagcacatatagagcagttctaaaaattgagacatattaagccaaaaagaaattaaatgtcaaaaaaacagtatctcatagaacatctcctttgactcagtgcaatgaaatgagacctcaatgacaaaaagctaaggattgataaagttatacagggccaatcataaccaaacaaaaagaaagagatccctttatatccctttattaatctcagaaaacatagattttacgataaaacaccttatgagggatagaaatggtcggaacatactactttggaaggcaaatttggcaaaatttggcaatatcagatgttcatattcccagtgactacataattttacttttcagaagaaaaccttttcataggtttgctaggaaacgtgcaaaaatgttcataattgcattttttagaaagaacaaaacaaccaaaacaaagtcagtccaaaataaaaacaggaaaaaactctgattgtctttccaaaaaagattaatttatttgtagaattttcaagcagtggaatgttttacagtagtgaatttaataaatgacaagtgactacaacataaatgaatcttataagaataattttgacggaataaaaacagatgataaagacaagtcacagtgggatagtgttttatataaattcaaaagataaaactatacaaattttcatgttatatgtttatgatatacatatgaatatcatatgcatgcatacatatacatacatatgtgtacatgcatggataaatacatctgaaatatacacatacatagatgtatgtatacatacatatgatatatgcacatagatatatgtatatatgtatgcatacatataagtatatatgtatatgatactcatgtatatcatatacatatactctactgtaccataaatagtactttctttatcatatgtaatcatatctatatctatccatatagaatctcttcctctctacacacgcatagatctcgattcagttatgtaaaatcacattctatgattctgtaatcgcttcagtttttaatttgtttgcgaacttagatgtaaatgaatatgtgtgtgtttatttatttgtatgtcactaacatacagtgtacagctttaaaattaaaaaatgcatcaattctcatcattgcccatgtcaagtaaatatatgaatgaatgatcaatctcactattaaataacttactgtgaaagaactactacaaactcagtaatataattatggtctagtacaaatattaaaatgttcattgttggctaaaatgtggaaaactacacacatattttggtagtgtatgcgatgacaagactgtgtattaggagatttacgaatgcattttaaaatttttaaacagtgcttgcaacttccagacgtaaaatgggtaaaatcagactgaaagagttgacattggttgcagtaggtagtcaaattaatttagctcctgctcaatctctatcttacatttaaatttgtgtatgttatgtgtcatatttttcaaaataatacctaataaatcagttgcttataataccttgaaataaacatgatagttcaattagaaaatacccactatgagacaaaaagttacccaggatgttatagttcaccaaacaaacaaacaaacaaacaaataaaacctcacaaagcaatattacctttatttgtatacatgatttattagaaatttcggaactaatgcttctgaatactatgcaagaacagttatcaagtcttggaataagatacattttagccacagtttcaattccattgacatttgtataaataatttcctattccttatttactttctattttattgaaagactttctacatgaacattttgtagggaatgtttaccttttgaaaggggattctaagtttgatttttaagatatggtgttagtagtgttttttctaccacttgaagatgtgagcacctcatcccatgtccccaaaagccagttactattactgagcaaatcctaatcagattatttcaacttaaaaatgcaagatgagtaaacaacataattattttcatccagaatttcaatttttcttggattatgttctgtagactatttctcctcttttaactagtttacagttctcaaggactgacctaataatccatctgtaattctgtttttgtctttgttcctgctactctcttctcgtttttcattttatcattttacagtggcagtaatgccacatgccactcattgtagacatttatagcaacaatgcatatattacaaaaatgactaactttattagatttcagacctacttgaactacatttaaatttaagtatttgaatcacctcccttttccccacttctgtgataatttatctgtagttgtttgattctgtaataaccaaaaaaaacctctgaaagtctaatcaattagtatttatgatttattcatttactttgatgcttcatttagtcattgaagaataaaaactgtggttaaaattattcattgattgtctttaagatttaaaaaaattactgaaagtaacatgctattatctagtaaaaaagagctcttcaagtgatgacataaatctcaagttaacatttaaaagaaaaaaaacaaggcatccctcagctgcagggttggtttattataaaaataaaaatattatcagagcatagtaaaggagtagcatcttttagctgatttttttctagaagcattcctcaatgctttatgaattatgaaaataattcataatattctctactaatgaatgaaatactactattgtgaataaagactattgtgcattgaaacatggaaggatcaaaaaacaaatgcttttttatggcacatgaaaattctataaagtagaataagaaataacattttttcacagaggttctaagtcacttgaattaaatacaaatttgatctttttaggcaatttgatgtcgtttgcctagagagaaagcatgatttagttttttaatcaaaatttctttgacttgcctccacattgtcgaatattgtatgggacacagtgagattttataaaagtatgtcccaaatattttatgcagcattcactaaaatattcatttattatctgaaatttaaatttaactgagcattctgtgttttatgtgatgaccttgtgcttatgctaatgagatctataaaatgacatctttttttctcagataatatgaagacagtgtttgctgtcagtgtggcaggaggatatagcatttagattaatacaaagcatatatttgtaaaaaatttgaaattagtttggcttaatgtacccagaggttttaggagtttttaactaatgaagggtttattcataggatcactcaaaatatgccatctgcaaaatatctgtgtacatcttaatatttctctgctgctttgtgaccctacatattaaatccagcatcctgaacatccagagctgtgactgtccatttctttgttattaagcagatacttactgtcaatctggatgttttgtgatgaggggaatcaatagatgtgtgagctttggtcttgaccttagggtaattacatatacttgtaaagtgaggcatatgtgattttaatcacataccatctgtgattaaaaaaattgaagaggaatacaaggatttagaataacgaagaagacactagatttattcttggattgaatcatttgggaagtctttatggatgcgggggtggttaagttgggtcttgagaaatagaggaaaaatttcctgaatgtctttgaagttttcatgttaatgctgatgaaaagaaagtgcatttagtaggttggaggagagtccaaattaatgtactttcacaatgactaaacttttattcttgagaaaagttttcttttactggggtttattataatctagtcttattatttggaagtgtgacattacattgaagatcttgtcagttattattgagagactgatacatgtcagaaaatatgctcaaatcttttaggtactaattcctgaacaaccattgctttaactatcaaataacgtacgtgaaacagtaaccatagacaagagcaaaagtattctattttgccttcaatatttttatgttaattaactcttctgtgcttccacttctttatctgcaaaatggggtggaaatatatactttgtgttattgctgcgggcaatatatgtaaatgacctggcactaaagaatatttaaagacaatctccaaacaatgataaagaaaaaatgaattgggattattcctgacaattttgtgcttgtagtttattttataaagctgtgaatgttgactcagaaggtgtatgtgacttaaaaactataacaatgttgccattcataaaaaattcatcttggacctgagtatggtggtgcatgcctctaatcccagctactcaggaggctgacgtgggaggatcccttgagcccaggagttcaaggccagcctgggcgacatagtgagacctcgtttcttaaaaaaaaaaaaatttatttgggaatgttctaaaagtgctgaatatatacaggtatattaagagtacactccaagccaacacacttgtcatgagctatttatgaccatagctgcatgattcttgctactcaaggtgtggtctggggaccttgtaagaaatacagagtattatcaggatctgggaaaatttgaaataaaagaagaaacacagaatattagattctaccctagtcttccagcatcagaatatgaatttgaatgaaatccccaggtgatttttacacattagtttgagaagcactggtctaaattttagtataggttattgaaaagttcatattgctccaggcttttgacagtaatgttgtctttttaatatgttttctgtcattcagttagaactgataatataaggagaaaggagttgttcaagtctcaagagcactttatagcaaattgccttttctgcttcacctagtggtgttcaatagcctgaaagattgagcagtttaacagtttactgcttaaatgtcaagctttactcttttttcattaatagtagtaagacccagagtcttaagattctgaataacaataatagtaagatcattacctgtattttattaaagccttgggagttaggagatgtcttgtgagtttattcattaagttgcttagagccatgatgtagctagtaatacagtttatgggtactggtccctgcgttggtgtcatttgaggactttgttaaagttaaacatttagattctcagattatgcccaggatattctggttcagtgggataagaaagacttggaatctctatcgctgagaaagaaactctttgggttgcaatgctgcccagcctgttttgcaaaccattgctgtagtcagtttcttttttctctgttagaagaccttttccatcccctgtgttttcatttggcatatcgtcagtagttaacatttatataaaattagaaaggtaggaagtggaaagtagaaaaatataacattgttctgggagtttgaagccctgtgttcttgacttgatatagataaaatgggcaaggcactctttctccattttactatctgtgaaatgggccgtatacttcagtggaacatgagaacctgtagacatgagtgctttgaactttcaaaagaagtgtgaattgagcttgtttttacaaccttgttgtaatatccttccgttaaaatgtgttttccttttcgacataaaacctgggtctcacggaaaacttacccctgcactttctgtttcctttgtactttattcctatccccactcttctctgtgttcctacagctctccagcacctgtaccatgggcggttttgcctaggtcggttggttcacgaggtcctctccaggatgatgacagcagctcctgctgagacatgccaggagtcagggagttttcctttgggacaggaacttcaaactagaaaacctagaagactcagacaccttgtctcagggtgtcataccctgtgatgaactcatgttttgggcagggacctaggaccttgtatatttaggaagaagtactagttaaataataggtgaagattatgtaacttcaatatctactgattctgcaatctagaaatattcttaagcgacccctattccttcatctttattcagaatcagtagacattgaagtaacataatcttaattacttagctatattcctagatatgccatgttctaaacaactttaatgaatacattcataaaacatccttacctcccaaggttttaataaaacacaggtaatgcccttactgtctttgttatttagaatttgaagatactggctctgactgctattaatgaaaaaagagtaaagcttgacaattaagcagtaaaaggctaaactgctcattctttcatgtcattaaacgccgctagatgaagcagaaaagcatagaatatattctactgggccatgtcctaaagcaaaggatcttctaggacataagcttggttttaaaaatgttttttttttttggtcatggttaaggtacatgggggaatggcaatgaatgataccaaaacaccagtttgtaagtttaaactcttgcagaaacagtacagaatgtggattcacagagaacagaggggctttatttaattttaggatttatactgattaactctcatttatttacttattatgcacaagaaccatatcaggagacaactttattttcattttgcagatgaggaaactgagacaggttcagtaaattattcgaagttacttacattgtagaatacagagccaaagtttgaagcttaagcattctccttaagagtctacatgcttacatgtggttggtcgtttcaccagtaagaactgagagtctaccgtttgaaaataattttgctttgtggtccacaggaattttgtatttcttttcatatatgttgatcccttctccttcttgtcaccctggtatttacagtcttgatatcttgaaacagaatcactatgattctttggcattttatcactggagttaccagttttggtagaagtgtcagtggtaatttgtagttttaatttataggcatggatttctttagagaattcaagcagagatctcaccatgtcaaggaaccacaaatatgctaaagtggacagtgagtccattataaccatcttggggtgaaaatcaatcatggtttgttaagtgctttcagaagttgttgttgctgttttaatttccatgactcgatatattgtgtagaatatattcagtagggtaattttggatttatgtgtttatctcccgttagattaaactagaatgtgtgtgggttttttttgttgttgttgttttgttttgtttgagatggcgtctcgctctgtcgcccaggttggagcacagtgtcgtgatctcggctcactgcaacctccgcctcccaggttcaagtaattctcctgcctcagcctcccgagtaactgggattacaggctcccgccaccacacccagctaatttttgtatttttattagagatggggtttcaccatgttggtcaggctggtctcgaacttctgacctcaggtgatctgcccgcctctgcttcccaaagtgctgagattacaggcgtgagccaccaggccctgcctagaatgtgtttttgataagaagcttttgtagatgagctccacagaggttctaggtcctagattttaggtattgtctattgtcttttgtattcttagtcctgtttttgaattttctggccttgacattggtggcaagattattcctcttgttgataatcgtcttcacgttaaaggttaggctgtttccacttgagggaattaattttactattgtgcttttatggtcaattcatcctcccattatttgtcatttgttgtatatttctttactacttaaacaatgaaaaaaatagggaaaagattggaaacaatcttctgtaaaaagtaaatatggatatttactcaacaaaatgtaagctcttgtatgctacattaagcactctcaacaaatacttgagattttgtttcatgttttatacctttgaattttccttccataaaataggaacattcttttggaatttcagccatcagacatgtcttataaaggaatgaagttattgataaacattacagccccagagtaattaaaacatgcatttgagcacctactccccagctgattgccttcctttacctttgacgagatcccctgtccctaccatgacctacaaagctctagataacccttcaagcttgtcagttgacattcttcctctcacttattcctctaaaaccacaatgtcctcttttcagtgtctcagactagctagaatgtggcttcctttccccttcctcatcctccaaggatagcttcttttcaccctttgatttcatatatctccctcagaaagtccttcctgattacctacgcagccctttataccaattactatccatttcattcttagcacctgtcactctttgtacttaatagacttatagtcatgtgaaacttcctgtctagtcattcctgacgagactctaagcagcaggtgggcaaagactatatatcttttattcaccaatgtgtacccagtgcctggcaaggaaatattttgatgattatctaaaattacatgtatgagtacataacttgcagtatcttacagctttaagtaatagctcacaaaatttattttgttactttaatttggtaattcatagcaagttatatcagggaagtagaaagtgtttccctgatatttatttagacagccatacacagtttttatagttaaacaaaatatgactttttccacatcacttgtgtatctttcgggtatgctttttacagtgcaatacttctgttcttcttttttaatcaaatatttgtcctaatgtagcagtcactgttctctctttaacagcagaagatggtagggaatttgataataaaattgtcttgttttatgccatttaaaaagaaaacacacacacacccttttaatgaatatatttgtaaagcctctattatggtgtttgacactcaacagacactcaatttcttgaatgtgtttacgttctcatagatggatagaatttgtttagagaaaaatcatgggttataaatacatcttattttctagactttacagatcagtgagcaatatttaattcactaaatggatttaaatttgatgatagaaaagaacactttatttcttttttaaaatcatttaataatttgataatgatttattattttatatttaaatttagttccttttaatatatggaaaagctgtacaaagcatttcagcattagaaattgaagtgtatctacagggggaaaaatcctcaatttagtttaaataacagaaagtgaaaagggcattttaaatcaggtgtgaaaacttaagaatagtgacttaaatgatataattcatgattatccatcagggtaaactgcatctatcaaggcaaaatgaacagagtggggcatttaacagtaattcaaactaaccagttttaatgctaatcacctggaatgtatgcgcacaagcacgagcagcgtgcgtgcgtgcgtgcacgatgcgtgtgtgtgtgtgtgtgtgtgtctgtgttatacctattactgctaatataacaagggcactttgaactctttatatagaactgaaaatgcctgttaattacattccagttttggggtgttaagaatattgcatttctttctacctactatattgcatgagtaggtagaaaattcaggtgcttaaaggctattaaaaataaaacaacccttcagaacgctgtctttgcagtaactgttttcttcttctccaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacgggtaggatggtttcatttttaaataattcctttgttttgaagggcaaaaggaggaacacacattctttctctacaggattgtgttgtgtgtgaagtgaaacttaatgatctgtctcaatctggggatttatactcctaaggccaaagtggcagcaagtaactcatgtgtgtttgtgtgtgctgtgcacttacttgatacagtgttaggcagtcacttgtttgtctttgctcttagctcagattgaatgttggttaatcattcctggtgactatacaaaacaacaaggccatatttggagaagggaggtttagaatcccagaaggatgtacatctgctacactgaaataactaaatgacttttaaattttaggctgctatgacaatatatggttaataaggaagtcagaagagatttaaatcactaagaatgtaatgtccttgatgagatgttcataccaaaatacggagttttttaaaacccacgatataattatgtataaatgacaatgcttgttgttgtcgagttgccaacaagagggggaaaaatgagaaaaggctaagtgtgaatagtgtgaaaagcggccaaagaagagtgccatgcatttgatatgaacaggatcttttagggggaaagacctagttccatgtggaaaaagaaaacaaaacctctgagtaaggtaagatcctcgattgctctcttcatactatgtagactcagcattgttaaaaagtattttagattttgaaaattcatgagctcccaataagtgatagttgctcgatgcctaagacaccacctcttggacattttaccttaagtctgtgaaagttttgagcttctctggatgattttgaagctttgtttgtgcatagaaggtaggatcagaaaccagctaacctttacaaaagatccagttgggaaatagagttccattagccaggtgctttgacctgcgggtcatagaccagtgagttctctctggatgtattctggggagaaaaattgctcttcccaatgtctgcttggctgctctgctctcatttcctgcagattctctgaagcctatctgtgcttctcagtattctctagcggagttgaaaaacgccccttagaggtgcacagttaattatagaagctgttagctttcccatctgtagtcatgccctggagctaagagaaggacttgaatacagaagaggagatgccccctgtacagagagaaacaaagaatccttcctgcagggaagaagcaagtttattaggagtaacttcgggaaaaaaagagaaacagtttctgtgcccttcaagagggggttcaatttagggaactcccctccagtgaatatacatggagctgcatttttatcattgtcaatatttgttgttttctcagcatgtcattactcttctggcctcaagtgactcatggcttctggttataaggcgggaatgaaatgtcctatgttttattaaattcatactgcattttgagagtatggtatatttggggaccttatatctatatcactggaacccctttccttcctttttctacttaaaattggtttcatccatgacatcttcatttgacgccatattgtttgactgtttctggaatattaccttttctgccattgtttatatactctaagactttgaaatgacaatttattaagcaatggtataaaaaacctgagcgtagtggttgcattttttgagcaagatggagatgttaatacttttctaaaaagttgtttttctcaattcctccacttccttaaatccctgatttcaagtttctattgcatcattttaaccgccttttcagttcctccacattagctgctgaagtaggaaaccttaaacaagagattccttagctgtgttctacaataatagccaaattccaaccctatgatttattatcttcaaaggctgtaatctactaaatttcagagatctgataaaattacattaatatatacaaatacatgcatatgcatatataaaaggaagaatattgaatcattctgtggttgcaataaaatttaaatcttttaagattcacattttatatttgaatagtgcttttggaaatcaccaattttattggatatttggaataggaagggtagccaatttaatttattgggcaacatttaggttattagctgtatatgaaatttttaatgtgtacatatcttagatgatgagctttttaagacacctaacagaattaagaaacagcccattctcattgtgaatttgacaccaattctactttggtggtattagttggtattctgaaattatcataccgaattacctacctctaattcattaccctaccagtggtagaaaaaaaaaaaaaagcagaattttgaggtcatgtttactaaaggccaaaaaaaaagtactataagtttatagtttcagaggcatagttattagtgaagatgtcctgtaataatttaaaatacaccatagaaatatacagatataatttacatgttttgaacccaaattacagtagtgtataaatatatgcctacagaatgcatgtttatatttgaaacaataaaatagaacttgaaagtaactacaattattcagaaattgtaagcaatttaagaaatgtaaactatcagattttaaaagtacctttttaattaaatagttttttcaatatagcattaatagagcaagtatattaatacatttatatatacagtttctaatactaaagtaaaacttaatcatttaaaaatactatacagagtgatatcaagaattaagtatggaaaacttgcccaacagaaaatgttgatttaatatagttcaatactatgctggtaaataatggaaacattttgaaataaaaggctgaatgtagttaggattgtgttacaaagcacataattaaaatgttgctttcagcatattagtctttctgataacttttttttttaaactggttttagcaatgaaagtttgctgtacttctcaaagtgaggaaggaaatataagaatcacaagaaaagctaaaatttcgaaatgttctcttcattaacattagtggttttctcctttttttggcttatgtcagggtcagtgtttggcttttagttttgtgttcaatatgatatcatttatgtatatttttatttagtaaatgtctatatttttcccttgttattagtatggaattgatcttgatataaaaattttcagttgcatatgcctctgtgttgacttctgtgctttgagtatgacaaaagccacattgccataaacttgatcttataaattgctctaggaaaactaggcttttttttgcatattaatcacacaatatttctacaaaatttttgagtattttcttgtgttagtaggaagaagtattaagggctttagaatctttgctagaaatagtctaagcttatatgacaactttattatcttaacatttctagaatagatcttatagaacatgaatcacctcctgaaaatggttaccaacatttactaataatattttgaaaacccagtgtttttatttaaagtttaggtctgtgaagaggttaacatgtttaaaattacctgtaccaacagtataagtaaattattttatatattccaatagatgtttcttaatcattttaaactaagtagtatagtatagtcagcattcatgtaaagttgtatacttttctgacaagtttttttttatgatgtacatctacacaaaggtatttattttttagataaatttatgcagatgcaactgtattaattttattgtttcctgaataagaaattctggattttatttttgtaatggaatttttagattggatattccattgcagaaaacttggctttttatctgataactacatgaataaggatccaaaaatcgatcattaaatttcacaaaaaaattaaccaacattgtgtagtttttcatttgttaataaaatacggaagtacagttaagcttattgggtgagtctttagggggagctcatggaaaatcaacattcaggtaaactcctccatgttatttgtcaaaacggaatgttatagataacttgtagctcaggttcttccataggttcaaatgctgtagttattagagcacttttttcttgcagctagaggaaagataaatctccttgagattgatcttggtttccagtttaaatttctttagaaaagtctgtcagttgtaacatctacattttgtgctacttggcttcagcggagatgctcaaccatgggcctggggagttgagttccaagttctggaagttgagttccaagttgagccactgactttcaaaggaagggcctcccaggatctccgttcatctgtcgcttggagaggatcatgctgcctgccaccctcacaggagtgttgtgcagcttagttaattaacgtttgtcaggccatttgagatcctcagatgcagagtgctagataagtggaaatagtctgattatttgttcattttgtaagtgtgataccaggacagtacaatgagaatgttatttccccttttcttcagcagcgttaaatttatagtttaaagattgttgataccggacagactattgagatgcaaaaatgttcttttggggacagtccattggcagccaaacagacgtttaaacaagtgacaatgttgaatgcctttacaaccactgacagaagactgcaggagcttttttttaactaaagatggtctgaagtgaaaagtgatattcattgttttgcttcatatttaattaaaatgaaagcaaaattccagttatcaaagaggtagcactgacttaatgtttatgtacataactgttttctcacccgatttggactttttacatgtgcataagtaaaataccaaagagatcagactatatcaggaaaaatgggaagtatatacctctctaaacactggttatgaagccatgactttaggccctgttggtagtttctctttaggtagcagttgatattttctttgcctgagagtaaaataaatgattaaaaactattgactatatgcagagatgaaaaatccttgtacatgtctctgcttctgtgccatatagatgtatttctgttgacatctatttgaaaaatatatgatttaaactcaaatatgttttagtttagattttaaaaatacaatccatgtatcaaattcattatgtgtaatagtgaacatgacagttctgttttaccgtgtaaaagtgaagtagctttttcttatttattgattattcatcttttacatttatataccatttttgacagtagaaagttgtcaaattcgttccatattccataggtatagaagtttggttttattagtttgattaatgagatttttaagcaatctaatttcttttctataagtctgcttcattaacccacacattttttaaagcactttttttttaatgcacacacaataattgtacatattgtggggaacatagtgctgttgtgatacatataatgtgtggtggaaggattagggtaatttgtatatccatcacctcaacatttgtaatttctttgtattagggacattcactattccagctatttgaaactacatactgctgttaagtacaggcatcctacagtgctacagaacactgaaacttactcctcccgtctagctataacttcatatccttcaacaaatctctgcctattctccctttccccctacccttcctatcctctaatatcttctcttccgtttttggtttctacaagataaattttttttttttttagcttccacatataagtgagaacatgcagtgtttaactttctattccaggcttatttcacttaaaataacgttcgcctgttctattcacgttgctgcaaatgacagaattttattctttttttatgactgaatatattccattgtgtgtatttacctcattttgtttattcatttatctgtcgttggacacctaggctgattccgtatcttgattattgtcaatagtgctgcagtgaacatgggggtacaggtgtctctttaatatactaatttcctttcctttggaaaaatactcaggagagggattgctggatcatgtatgtagctctgtttgcggtttttttgaggagcctccatactgttctccatagtggctgccctagtttacactcccacccacattaatagcacttgaaaaacgacaacaacaatgtttttgtaacctaggctgtttgtgaggtctggcatagttctgctggcccaggtttctaaagcaggtgaagcagatgtatcttagtgaattggactgtaggtttgcagctactgtgaaatgttatcctttagtgcagtatctgttcattatttcctatataactatcttttgcttggcttctcttttccatggactgcatgagtcaggacataacagggcccccaaaagaacccattgttgagcattcttagatgttggaagtgaagagtatacagaaggtggcccaagtttcaggagcacagggccagaatgattcaaaaatgaggtatgtagtgttgatgtgaatctggtaattttccggcagagcccagtctgatgggtccattttacaggcacattaatacctaaaatgccacaacgaggttttattttggatttttggggattttgttattttcaccaaaaaggtaaatattatctccattgtctctcatatatatatatatatatattttttttttttcttctctcccttccattagatactgttcaaaactttccttaagtgtttgtaagcaaaggcattgattagtagactgctctgcttgttaactcaaggaagcttggcaagctaggtactgctgtatctagttgtgttatcagtttaaggaaaggcaaattgtttcattgatgtttgaagaccctttttccttttggagaagcaatactacttatagacttttattatgaactataatttacaaatacaaggaagtctggaacacagctttatatcagtggttaggagtgaagcaaaggaatcttagttttgtttttttctgatgacagcacacttgtgataaattgagcgtttggcatcattgttcatctcagaatgattaaatgcctccctctcacttgtaattttatatgttaacttgcctcttttaaacaaggcagtttcttaattttgaagaattactttggacatattaattaggaaaaggataaaccattttctaccatggaaatttatatatgtgtaacatcatgaataaccagaaaatgctaagtatatgcactatagatatctatttttaaaggcaaaatacactttataattttgctaccattaaaaaaggtactgattatgaatcaaacttttatgagaatttaggtacaaaatggaaaagatttttaaaatagatttctggttaaaatgatattttgtgtgaaggaagtgataagatccctgacaacatgatttattgaattgcatttgcctgtagtgttacatttagtttaaatttttatacaagactgatgcttgatcataaaaaaagtcttggtagacaaagcacatagaatctcagggaattaactttctgattgtagctatatacattgggtaacacaagaatacctgtttgtaggtgttaaatttgaattcttaatgaagaaaagaaaatctggtgaaactactttagaacaattgtataggaaagcattacaaaaaatatttggttaaaatagacggatatttataactggttgtcaatttagcattcagtttctaggattaagcttactacctttccattaatttattactggatggattcctttcatcctcaccagaactctttgaggttgaaactattattatccccatcatttaaatgagtaaactgaggcctggatattaagtattttgcctagatcacactgcttataatggcagacattaaattctagctctggcaattctagagtccctgctcataaccattgcatagcctcttttggttcaatatggtttgctaataaatacttgggtgactttctacagtttcagaattaatttgtttcatctaagcatacacgtttttatgtgtgtatgtacaaaacaaaatacctttttgaaattacataagtgatacatgcttattgtgaaagagttggataatacaatatactgtaaagaagatgaaaaccactcataaattccaacctgtaaatactttcgtgttcatattttggcatctaatgtatcctttatgtatatttaaatatatattttattcaagtataggatcatgtacctccctgttttataattttcttttttaatttttcagtgtattgtggacatcttttctcatcaacaaatacatcccacaatgttcatttttgtgcctcattataccatggaatagtgacatcctagtatgtttaagacattccttattaatgaacaattaggctacttccaatttttaattataaaggacattttgaaggacttccttgtacatattattctattgctttatcatctttttgggataatttcatgtagtatatttccagttatttaaatgagaaagtacatggtttataacaaatggtatttaacgtccaagtcactgctatctaaaggggtaatttttaaggtataaaataatttggcttataaaaaatgcgtgggaaaaatatcctagaaatatttaaggattaacttctaaattgtaaattgacatatttaatgatagattcaaaaaattaggagaaaagcaagtggcaattttatcacatatatggaatacagtacatgtccgatacaaggtaaatagtataataagcttactttatattgcatatgcagtatagtttattctttagagaaattgatttgtaagaagaactcattttcttaagcagagttgagtcaagggttttaattaaaagcagtctactcaggctttgcctttctcgggcgaataatttctctcttttctctgcttttgctttgcctccatggatgatgctcctgctacccttcacgctttgtcaaaccagttttgaagttttcgccttcccccgatgtatgtcgcatgtgtgggtaatggcatgggctttgagggagtacaagagaaaagaattgatttctcttttctttaaaagatggcatttaattatctttgtttttatttttttgctgaaatatattaaatgcacattgattccgttaagtatttttctttgataaagttgtcagaatgtcagaatatgctttttttctgttattgatgcataatatttcatacattggtgaggtatacgtgggaattttctgcaaacatagaataaataatggtcaagtcagggtttttggggtatccattaccttgagtatttatcagaatttcaatgtgctggtaacattttaagtcctctgttctagccattttgaaatatgcaatatattattgctaactatagaatatttttattattttttatgaaaatttgaagaagcaggggcaagaatactttctgaattaacattgcatttgtgctacctatatgctaaaaatacagattctcaggccactcttaaccatacatttataaaaagatgtatgatgttatttatgaatgtttaagacaaacaagttaagccactcttctatatggaatctaaaaatgtacaaacactgcatttgaaagagacattcactttacttaaaaataattatttgctatttttttaaaaaaagactcagagtggaacttttgaaacatcctcttttgtacattgaacagtgaaaaaaaactttacttgttaacattttagaagtatatttgtttgcaaaatcatggtataattgaaggcaatactggctatattttaggagatgcacatatttggcttatctaaatcttagtgtcagaaattgcctacctgaaagttccctggtaatatagaaaaatctgtcctctttgcctgacttacaaactaattctaagaaggttggatgtttttaaagtgtaaattgtctggatggacagtttgtggtctacaaatttattatccagctaatactgtcataactttatgctgtgtgactactgagtgtttttgagtttttaaaatcagagctttcctcaaattcacatgtgattaaaatatttttgaagagtctaaaatatatactaacctttgaggttccagctgggtttggaggtaggtatgctccacatttaactctggctgtggttcaggcctgcctgtattttattttctggtaaaattagatgttattttttctttttgctcttcccttgtgatgtagtggaaagtgctctggattggaggaaaggagactttgtgttctagattcactttgtgactaactagccgtgtgaccctgggtgagtcactcaagcctcatatactgtttcctgctttggaagattatagtttgaagtatgcagtttctcaaatctctttacaattgcagagtcaagcaaatctagagtcaagtaaatttcctttaaaaccttaaacattcagatctatgaattgatacccgaggcaactttaagacaaaatcttatattttggacgtagtgatgctgatgtccaaagatctagatctatatctatatctatatctatatctatatatatatatgaactacaaattcttaaatatgatttccaaccagtggctgagaatccataagttataagcaactgtcacacatacagtctgaaagcttcaaaaattgtattatttgaacttatcttgtacaagaaagcccattctttggaaacaactttgctgcaaaagaatcatgtcaaggggctgctgatgaatgaagttaaaggaaagtaagcacaatgagaaaataattctatgagaaagtgacatgcttaaagtctccttcctcagtttcttggcattgagcgatgatgcctgttttgttcacagtcagatgttcaaatcagaattttggatgcagaaactaattttagtaggtggggtgcaaatttcttatgagtccatgaatagactctaatcccagctgtttcattacaattataaaaataaaattggctgtgaatcattcaaactctgtttaatggatgtgaataattcagtttcatcccactgaaatcttaaaactataaacctatctttgttctttatgttccttcagagatcatatgtcattactcatatatgaattatttgaagtatgggtgatcatgatgaaagtgaccaaatttctacttagctcctgtgggtttcaggagaggaggtggcctctagggtgaggctagggattaagtggagaaacaaattgggaaaagtccaggaaaagagaaaagggtgttaaattaggatttcttggcattatctttcctatcaagatatatgttcattatagacattttagaaaatataaacaagcaaaaagaagaaaataagttttcaacgtttttaatgtatttacttctggacacagacacacaggcacatgcacactcagacatgctcactcacacacatagacatgcacctgcaaacatagatttgtatgtttattattaaataacttttaatttcactttctaataaattacacgctgttttatagcagcgtatattctgctacatcatatttattgacttcatagtatttcactatatgttgtactagttgtcctagaaaaactgtctatcgatttcttattgttggacatttatttctattttttgctattatcaatagtgccacttttagtatgtttatagctgaataattgcaacttgcttgcgattttaaattttgagaattggcgtcccaacagtcaggctcctctatgggaccacacagtagtagagtttattggcaagcataggtcactttaccagatcatgtatatagactcctgagaaacaggaaaacagtattatttcttggcttccattattttgaattgccttgcagtgatagctaagaaatagaaaccctgaagttttttaaacattattatagtggaaaaagtgaatatgattatttgaataaggtgcatttcttgagcagcagcaaagaatcagccaggtattgattttactttcataattgaaagatttctcagtcacttggacattcagagaatatttcataggacaatgcacttataaagttatatatatatatatgggatttaactgccttcaaaacatttcttaatatgtcaaatttcttaatgtgttttggtgagcacatgaagttgatgccagtaactactcagtgaagtgtttggtgcacaaactgaattttgaaatatttaaattttctttcatttgcttacagctatttgtacagtttattgtaagataagaatgaaaatcaggtgttaaagcaaagagtacaaaactattctatgtcctgtctcttttcagttgcttctccaagcattagacttctctaggcaaagtcctttcataacactagagattcattatatttggtagttcatgaaattttaacaagacacacttctgtttgtgggattggaatgcgtgttggtgagtgtccgaatttaaatatattggtattcatatggattcaggatttattttcaaagaacagatattcactagaccaaactaacctgtactcaaacttgaaagaaatagaaatagaaaaagcagaggataactttgtagagttaattcctgatatactggtctctaaagtttcttgttgtccgataaatattaatttagcacctgctgggtttcaggcaggaactgtggaagaacttataaagggtatgaaaatgagtatatcaagatttctgtactcaagttatatacagttagctgtaggtgataagacaggtatggtgacagctaaaatacaatcagacttccataaaagaggtgaagggagacgagaatgattatgattgtttaaagaggaacagatcacattgtgttgagaaaaccgacttagttgtcccaaaaggttttctgagcttgtttcggaaaggaagactggacttttagcaggtgaatatgacagcatgaagggtaagccaatatagaagaaacaatgtaagattacaaggggcattttcaggatataggaaagagaaaagcttgatgaaaagttaggtatagtatagtatggggagctaagacttgacataaaggttaggataattttctaaaatgtttatttgaaaaactttatctcagaaggaaatagggaaccattccaggatttgggcaaaggataatttgatgaaacctttaatagggttaatatgaccatcttacataggttgacatggaaaggaggtggacggggttgaggtgacgaagactcattagtaggctgatctcttactctatgagtaataacagggagcctacactaggataatgatgttgggaagtgatttctgtagctatgctgagcagacagtcttcaagagttagcaaagtttatatgtgcgggtgacaaaaaagaggctttgagttttgatgactgaaaggagacaaataatagctaatctttgataaagactaactatgggcaaggctttactctttgtttgtagtaacttacttaatcctcattataacccctttatatagatgctgtattttctccattttacagagaggaagtagagcctcagagatgttatgtcacttgtcaaaagtcacccagctagtgaatggctggatcaaactggatcatgtccaagtagcctggcttcaaagttcacacgctttactatatttattcttttttttttttcttttgagatggagtttcgctcttgttgcccaggctggagcacaatggcatgatctcagcttaccacaacctccacctcctgggttcaagcgactctcctgcctcagcctcccgagtagctgggatgcgccaccacgcctggctaattttgtatttttagtagagacggggtttctccattgttggttaggctggtctcaaactcctgacctcaggtgatccacccacctcggcctcccaaagtgctgggattacaggcgtgagccacggagtctggcgtatatttattttcagtgtatcattagcagaattctagagtcagctgttctgtgagggtaaaataatgaagctggttttgtacttaccaagtttgtaaggcattcagatgaaaatatctaatggatagctggaaacgtaggctgtcatagggaatagaggagttggaatgacttccaaattaactaacattcatttaataattgaatataaactgaaagcctagtttgttcagaatattataggagcagcattaccatgactaagctatagacactgattctttaagacttttgcaaaccagtagcaaaaataatgttcaataaaccgattacagcacaagaaaaaaagagtgtcaggtaccacagagtgagaaaaaacaacaacaataacaaaaaaaaaatagcaaaatgttgtagaaatttaaaaaaggaaatgaccccttctcaattaatctatcaagacagtgttccagaagaggttgcttatcagttggttcttgaaaagtggtatttggaaagcttaagaaacatagtacactagcctacagagaatctaagcagaagttgaacttttcactccaactaaaaatctatgttaaaaaaaatgagtgaggccccctctgcagtgaaagttactattttgacatttgtgagatcaaattttaagatcctctgggtatgtcaaagtcttttcgtaattgataggattcagaaacaccacaaagacatgcatgctttaagtatcttattgtaaccagctaaactaaaagaagagtacgttttagaacagaaggtgggtatttaaatcaaagtctaaaataaaaatttaattgtttaattatgtaaataacttcaaaacgtttatcttcttttaaatatataaatatatatgtagggtgtgtatatatgtaaatagcgtttattcagatataaataaaaaatagccctactacttagggtcgtatatacatattatcaaagaaaaaaatatacatgaaaagattcttgaatacccatttaaaaatgaatgccgtatttactatgcctgttggatagattcattatatataagaactatcaaattttagttttatgtattggtgttctgatttattcgctaatcatttctcttagatttaacccagtggcttattttcaagtcttgtttaatgtcttattttataattgaggaaaaaagagaaatgcttgcctgtgatatatcacctgttgtttaatcgctaacactgttacatatcttaatactgtatcacattaagtcattttaaaagcattctgctttcccttttgtttaaaattcctacgatccctgggatattggtagggggttaatggaagtcttgattaaaatcttccaagctttaaggctttcagttcttgtaaacaatttggatctgagagataggcctatttatgactttttactagcctatttacccatttaatgttaagaaaaaaatatgcttattaaaagttttgttataataagtacaaattaaaatgtcttttaaaaaatcagccacacttcgttgtgtgatgatcacagaatttatggtagttcttttgaaaattgtctgaagatgtattataatcattttaaaagtaaaggaactaccctgagtataccaattttccattattttaaacaaaccttttaagttttatatctagattgcttttaagtagttatttccaaacttgaaggactatgaactctaatcataatcaatctgcacttgtgtcataatagctaacctaactatatagtgggtgaaagtcttggaaataggtaacaatacagttggagtttacacttgggcttacaggcccagtccagacgattgatccagtggaccagcccaagctagtctgacctttcttatggctggcaacactgactgcacagtattctggttcggtcagaagtcttggttattctatttttaatgaacagacatgctgagtttcaaacatggtggttttggtttacatgggattgagttggcatgcatgtagtttccagttcttatgattttaaggtatcaatttcatggcaatgttggggtttctgtgatactccctgggcttgaaattgaagttcattgaagtgtgagtgtgtgtgtgagtgtgtgtgtgtgtgtgtgtgtgagtgtgtgtgtgttttttttgaggtttttccactaaaagcaaggagcttttagacaagtatgggacacagtagaacaaagatatgagagatactgcaaatactagttcttttaatttatccatttgcaaattttcctcctttagcagactgagagctcctgagggctgtgcatttttatatttttgtttcttgttggccctgttatactgctaatcttttaggaggtctaaaatcaatatatctttaatggaatagaattatatgaggaaatatgcattttttaaaatttggaaaaccatattttatttgctgtatgagactgccgtaccgcctgtgtaaattttctaccattaagattataattataaattgattattatttgtatactcttttaggactgatgaattagtaaattattactttgtgcattatttccaataacctttagggtataagattatctagtgagttacttactctggaaaaaatcaattacagcaatttagggttcgtataacaataaaaaggatttgagctttaatggaacattttaacacttggcatgtatctatatctacatatatatctatatatatcccttttttctgagttatctggtgaaacagagatttctttatagaattttgtgacacaggaatctagagacacaatctgccagtgcatttctaggttttaaaagtttcagttcaaacctaaaaagtctatttgttaaatcatgactccaaaatttattttttatataccttctttttttaataaaattgactctaggttcaattttggttgaacttaatcagtcttctttctacacagctatattattagtttatatagaacacagtgctggcaagtgttgaaacaaaaatgtgaagaatgatttaccataccaatatactgcttccttctaaagaagggagatattttagaatattagatactgggctcaagataaccagaaatgtgtaatgggaccatttatctatatcattttatggccaagtcagagaagcaaaggcatatagcccagaaagtgtgataagaagaagagaaagatactagtagattattattccttaagtctgcagcatgacttaactagagacaaacctggatacgagaacttgaaagcttttgtgaactcaggaatgcatatgatgtttgtactacaaactcaacctcatcatcttaatctctttgcctagaagagatgaataaaagtacaggttatatttatgaaactgaaatctataaaggcatggagctcttttcctcaagtgggaattcttgtgtgtttatttgaccctttagcaaattagtggaagtaaaggagggagagagggtatagctgtatggaaataaagctggtgaagtattctgctcttctgttcttcttagtcttgatggtgaaccatgcctacactatactatcactctggtaccagatttattgcctgccaggattggaattcatgcagagaggaaggattcatgaaaaaaataatcaaagtcaggaaagtctttttctgtaatcttgtctcatacagtgagttatttttgtctgggtagtttacggggatgtaactccttcagtcatctaaccgtgatgtagtaaaagtcatttgcaggaaatgaaactccactttgttacttttttcacttaaaggctaatctgattagctttaaaacatttgttcatcttttaattcagtatttgtatgatgcctatggaagacatatggatttaaatagaacttggctaaccatctgccaataagagaaagtgagatgctaaatcagagaggcaggaaagtctatttcagtaaaagctattttgatctgaaatactgtaggcagtcttacagagtattttaattgggaggatattgatgcatgctagtaaaagaagtgtatttgctgatatggttgaagttatgtaatcattaaatttctatataagtttagagatgtggaactatgtgaaattttgatcctgttaattataattttttttcctaaaaaagccatttgtggaaaaaaattttctgatatattttttagagcagtggcacgttttatatctcatgccagaaactagagcataaaatatcaacttttcaaataaattaactagaaataaagaacaatttattcagtgctaatttgttgataattttttatagtaaactatgttttaaaaatttaactttggggaaattagaaagaagaaaaagaatatcttttctcatgatggtaaaatgctgatgtataaagctgaaaaatttacaattatgtcatatttatgttttaatttaaaattgtgagagtttagagtcatgtaagcattaagaaagataaaatatctgaattatatatatttgcatatatgtgcatgtatatactattcaacttaacctttataaataagccttatttttattattcagattaattgttcattcttatataaaatgtgtctggcatttggtttttgctgggggagtacaataatacatggtatctgccttctgggaagaagtacagtaatgggtcaggaattaggacagtcactgtcagtcacagtcatcatctcagttaatcctccaaataacattatgatgctgggcattgtcaactcaattttattgatggcactaaggtatagaaaagttaagtaagttgccccaaaataacacaactggtttaaaactctcagtatgagaggtgttgaaaccatagcctcttacaactagaagatcactgtattcaatactctaatccctgatatatcatgaatgctgaaagaggatttagactctactacacagccgccctgaaagagctgcaggaggcacagggaattatattaacatagtggattgcacgttagggacagaaatggaccaaggagcacatgagaagtccacattgatagaggtgcctggcatgggctccccttctctgcccagatggtgttggtgtgacctgatgggtggcaccttcttgacaaggatccttgctttagatatttggaatattttatgttatcaagctatttagaaattttaagtcactgcaaaagtgctcattccaaattctgtttcttgcctttgtcttgaatccatatctgaatatttaggaagatttggtattggtatagagaggtatcaatttggcaaagatccttctttgccaaattcctggaagtggaattgctgtgtcaaggacagtgcacctgaaaatgtggacaggtaatgccagatttccccacccccctttctaataacagtgaatgacctgagaagtaattgtgtccatttagaatttcattagattacgatggaaatgaaggtagaaatgaagaatcaacatgtggaaaaaatatgtctgtaactaggaattgatgtactgagtttttctgtccatgttgatttattattcccttgatggcatttttgagaccaattatttcaacatgtggtgaatctttttattcatctgtctctctgtatctggaacaagtatatcttggatatacctgaggcctaaaacttggtgttaaccagactttcctctctatggtgtaaactgccatagttggcaagaaatattccagggaaagcaatgtaaattttctcaaatgagaaagatgcgtgggtttatttaggataaaaagcagagacataaatgctacaaacatatatggtattagaatgattattacatttatcctatcaggttttgaagcagtattattgccttagtttcttgcatcaatttttctcttcatttttccatcttatctctttcctttcacagaatggtttgatgaaattataggcactaaaccatttttaattacagatctcttgaaaacatatcatctcactaaacttcgaggcaaaatgaaaatgtgtgattatcccaatttattagaacttttgtagctgtcttaaatttttacagatagaggttgaagttgccattacttagtgaagagtcattgtccgtggtttgaagaatgagtgacaaaattaatcaaattctgtttttttttctgttttctgatttctggaatattgccattttccatatgtttttctgaccttaggaataccagctggctacaaaaaaaaagaagaaagaaaaaaatgcaaaaacaacagcaaaactcagaaatcattgcttccctaagccatgccattggcactgcccctcccttagtgccacataacctggagctcactagcaaggttctagatctgcatcacttccattttctattttgccaactggccttgagcaacaggtgtgtattcttcttgttgctgcaggcttgaaggaactgtagggtagcttctgtccacaattctgaccacttgccttttggcaatctgtttagtgactttaggctcttctatcaaggccatcttgtagactggggggttgtccagaattttatgatacatgcaacattctgaccacctgctaagacttaaatgaacagactacatgtagatattctttctttctctcatacttaacttttgcccatgcacattagtatcaaagatgttatggtaattcaatatgtacagttttctttaaaataggatatggccacgaatttgctaaaatctatgccatggtatgaggataacttacatgaaaatatggtacaagattaggtaaacagtgttgttcatatgagaacttaaaaattcccttaccttgaagtttcaagtaaatgtctttcgtccttttaatttggtgtgataagaaatattgcctttggtgtaatcagaattatgtagcatgatgcttcttcttggtgctgttatttttactgcagtaaatatttattttagttggcattgttgagttacctcatttgtgagcacagctagtaaagctatggttaaattttattgcttttactcttagaatcactttctcagctagtttaccttggagagacaactttacgttttccaccaaattaaagaagctgagaaaattgggtggaatttttttctttttttttctgtttaaaatgtggttactttgtagtactttggcgaactcactaatgtatgtatgaaagcacacgcttatcaaatggaaaataaaatcaaaacaatgaactccagtatgtttagtaataaagaaaaaaaaaacctgtcattttttccaatgcaattaaatacaaagagaccactaatattacatttatctaattcatgtcttctcggcaatatgaaccattcagatgttcctccacctcttttgagagggatgtatgctgtcagactttaccaatgggatacacagttggggttttggaaataattttgaatctccttgcagggtagcctgctaaaagacagggttgtagaaccacttccgagggccttctaaacttaaaaaagaaaaacacctgtagctgtcagcactactttcagcaaacagtccacatcgttatgtgtcatttaactgctttctgcttgtcagcaggagtctttgtttcacacctaagagttgtcacatcagaaatcagaataaaggcctaaggtctctattcccacggggcagtaacatgttatgtattattttcctctaagtattctccatctactcaactctctcctggaaacctacatgtttattcgaagcccctatatatatagtgtagggtatgaagaaaaacgtgtttggctttttaatgacagtcttttcaagtgtatgtaccattatttataaacctatgaatgtaacattcagtggagttaatgtgttcacaagtataccatgagtgtggatggtggccagaaaagtattattcctgaaaagaacacaactatgtaagcaactcctgtattttgactacttgctgtagataaacatgctcccctcatccaagtctgctacaggagtggacagaaatcttggggtaccaatattgtgagggggttggttgaattcagcattttggcaacagaaactggaaagaaataattggcggcccatacggtatgtgtaatgggcactatgagctgtttaaacgtacaccaattattttgaagctttccaaacccatctgtcaccatattgtctagtcacatgacatagaattgtcatttctccctgcataaactgatacagttacaattgatttttgcttcaatcgtttgtataaatagacctgtgtcatcaggatctattgtttttgttttgttttgcttttgcttttgtttcccctaccagtgatctatggtacaatttacttgaaaaacaaaaacaggtatagctagagggccacagcataaaaaataaaattaagtattaaaggcacttaatatagggttaaaaaataccctgtgaaagctacggcacatcttttccaatgtgtacaattgagtcaagaaagcatagttgtatctttattgcaaatctaataatgtaccccatagtattgtatttaatcgctgctatttttctctcctattcatcattgtgtaacgtgtaatttgacataaattcctggccactgactctttctgcggtgttggcaggctcagttcataactggaggtaattggagtgagatttgagcactgttcactgcaagaactgaacaatgtttaggatacctctgattctcgtgagaattctgtggggcataaaggggaacatgaaagaataggaaagtgcacttttctttttttccaacggtggcagaatcaggagatttcttggtaactgattcactggttcctgagtctgttttacctctggcaatgttaaataaacccaagactgcattgatttcccttagaaggtgtatactctagcagtacccattatcattgcatgagttatcataacacctaatacctcagctggagtttaagcattatgacagcttgggaacttaaagtgagtacagtaaagactttaggagggcctgtgaatacaagttaaagatcacgtggttggctcccatggaagatttacattgttaaagtaaacttgtgtggtcactttgaagtcatagattttccatataaattaatgaagaaaaataaatttctctaagatagtgtttctctttttacatttgcatgagaggaaatgaaacagtataaagttttaatttccccaccttctggctaaccatcggtttagtgattagcagaggagacttttatattaggtttggagctcagtttcctggctgcaattcattgaaccttgacgtaaatctgaaataagtattttgtaaggggttagccttttgtgcagggtgtgtgagaaatcctgctggaccaggttggttacagaaactagtgtcaagttgcctgtgccctaagtggtgaataagaaaatgcagacaacagaaaagtagaagaaaaaaatcttcctaagaacaccttcacccgccacttccgaaagccttactgtctaccttaaaaggacttgcagttctttttagtgatgcatgtttgttgggtgggacgttttttcttttttagaaattatacagtcattgctagtgggtagagtgtgtcagtacagaagacaagtgtttcattcacataatccacatgttgtgtggtgcttgttgaggctggttgctttgcatttaatctactcgatcatgctatttgccttaggtgatcagcaacctttaatgtaaatcctagccaatctaataaactaatggagagagaggaacaccacacacacacacacacacacacacacacacacacacacacacacacacacacacagacactgtgggtagggggagtaggcatgcgttctttcatggtttatatccacattatcttagaaggtagaaaagttatgtgccatctctcctttgatctctcctttgatatatatgctcctttttttctccttttgtttaagtaagtacactatattgtttggtaatagaaaaagaacatcttatcagcgcagtgtcttgaacttggaaacttgaaaaaaaattcaaaattttgttcagcctgactagtctatattcagttagtcttaaaattgttttaaaacaaatcatgttactaaaattcaacaacattttttccccttatataaactgcagttcagtattgtttaagctttttttttttttttcctggcaatcacactgaccaactgttttgagttttggattattttggaaaagagaagagggaacaattcttgataattccaattacagatttgaattaagtactaaaacttaaaaatgtggtttttttaaataaacaacttctttaaaatattgaaaaaagttaggaaaattgatgaaagtgaataaccattttctttatccattggaacaatcagagtaaagagactattgaaagcttcaaaataaagggaatggtcttcctctttgatataagtacgtttaaatggctctacagaattaggatttttatttttaatatcattggtctattttttaaaattacaatgtttgttaagagggtgaaattatacttgcctacaaaaatttaccttctcatacctcctttcatggagctttttattgttatatttgttttgttcttactgctatcgtcttgatgtattataactgcttattactcaaggggcatttatacacgtactgggaaaacgtaattcttcgttcatcattaagttttgaaaaatatttttggatttgtcgatcatgatctgcacatgattaaggtgcttggcttcccttccctctgcaagctcagttcatattggtaattcctaggtttttgtttttactagcaattgtgttcttttttttttagatggggttgtaagtttttggagtattccagtacatgcttgatggtagtattaatggtggtcagaacaggttgggtactttttcttgcatttttcttgcatgcattcgtagctgtgcatgactggagccagtagcttgacgatgcacactgagtatagatggatctttagactttactcaggttatcgttcctcctgtagcaggtttcgttcaatttatcctactgtaaaggttaccgagggtaaaattctatttccattacttaatagtgttaggtattgtgttgttgttgtttctacatgcccccaaattgcaccccttgttgctactggagttccaaactaattaagagaaaaaaaaaaacacaagattaaggaagttgagagaacaaaatatcacctttcatctgattcagctagtgttgaagaatgtggcttgtcctgtgttcagatcagcttcctaaaattgaatttcacagccttgtagaagtagctcatggctgccttgtgtgtgccagagaccccagactgcacatacaaatgccaagatgcacgccttgccttcacggtgttttcagcctgtcagggaagataagccatgcacacagatgcccagaatataggtgaagatttgtaaatgtcaaatgcaaggaataagcatttcaaaaattggtgtaatattcacacttctcttactttgtaccacagaggttttgtttataaaatattttgaaacattcacatagaaagcgttctgttaggacaaagtaatcgttgcaccagtccatgattaatgttaatgttccttttgtctttataaaaataaagctgtggttttcgtactttgagttccagtaaatgtgttagaggtaatgaggtaggagaatgttaacgttaaaatcataataagcagagttagacttttattgtttacctcctaaaacaagctttctgcctttaagctgaagttttacttggtgttaccaactcagtagggatttttatgctaaactgatggtgtttaatacttcagcagtcaaaagaggagtgaaaaatcgttacttgttttcctaccatggtgtctgccaggtagcattgtaaaaatctaaatgtgccttgggtatcactccaggccattcatccagtccagtttctgaaaggaccctgcattttacccagagttgataaaagtaaactttgtaagttcaggagcaggggcagtttacaccaatgtacaaattttactcacaatttcttaagttaaaagtttcttttaacttttctcacagtgtggctaattttgcatttgggactccctaaaatggattcagcagcatttccctggaatgttcaaaatagttcaaggcacaaagtaacctagatatttaaatggcccctttacaccttagcaacgtggttgttatgattttatgaaaacagtctttgtttcttttctctgctaacttctggctttagtcagcaaagatttctctgcctcattaatgttgtaaggactctaaataaaatttttcttcgtggattcctttttgggcaggcctgatattgatcactgatttaatgcttctagtttcctgacctgttttataaattgtgggaatagcctttttagattttgaatgcccacagtagtcctctttctagctttgggaaatgatttgagaaatgaaggaatgttgattttatttttactctactttgaaaacaaacaaacaaacagattaatcagattaataaacagcaacatgaaggtggatggagctgagaagagagtcatctttaaattctcttaaagtataagcaactcattcttgtgctttgggaacctagtgcctcccaagaaagtcaagatgaagatttgaaatgtatacatttatgactcagtatttctataagtatataatgttagtaaaggaattgtataaaaagacttaaaaggccagttcatccatccattgtctgttattgaagtcaacaacttgatgatttggtttcatataaaagatgtacacctgggggaaagtgcatttcaagggcactttcaagggtaagattttacaggaatttgacattttttaaaaaataaaatctttggaaatttgatttcaaattttaattcatttataaactctgtattgccctaaaatgattttctcatatggcatcgaatgtgatgaagctagattcattcacacattcaataaacatatatcagtgtctgctgagagcagggctttatgctgggtactgggtattcagtagtgaaccatacagaaatatctctcatggcagttacttcttctgtgtatatctgaacattcaagggtaataaacataaaccatttgtggtgcgtgagacctaggaataaatcagaatgagctcacacctacttacttcttattataaccctaagattgacactttatgaatttagtgttatccaaataatgatgcagtatcaaagatgaatacctagatttaaaatgctaaaagcttgttttagaaagccagtgaataatgtactctcacttttgtatcaatatttcaagtgctgctgggtaacatattgaaatgctcacaccagccatggatgataataaatatggcatttttattaatgttaataaactgggtagcataaatggagaagacatcttcataggatttcataatgtattttgttattcagaaatattaatgtactttgtaatgctgatgcagtaacattaaagaataaaagacagaggttttatcttgaaattgtatggtgtttagtagattttgaaatgtggatacatttaaaataaagttcaagagcccctaaggcagctgataaccacgggtattctgatagcaatgttaccccttaacatatgaatttttttaggtatagcatctttgtaaaagtggttttaaatttcatctccttatcctttaaaaaaataccacattagcattccaaagattctttatcatttctagttatagcagttgttttatcattaacacggtgctttcttatatctagcaggtttgattctagataatttgataactccaaaagcatatgcaatttgtcataaaactatgttacagaaatataattgtaattatggatttgaaaaatcttaattgtacagaaccccactgagtagatgatgaaaaaaagcagtgattaagtacaggccaataatgggaagatataaatccacaaagtgaattttatgcttccaggagtaagtgtttttcatacttaattgctaaaatgctttgcagcactgagaagaaatattgagaagcaagattagttgtgccaaactataaccttgaattctatggaaaaccagtgcctggatgccttagtggctcagcctctttatctaggggaggtagaacagctaggcttaagcctcgactggccattccttccccactggcttgttttctgattttcatttataatcatctggaaattgaagagctttgattgaacgccagtgggagattttagctttatttcatcaacctttcccaatattaacagtaaattacaactatctttattactgctagattaagttaaattatagtaagatggtttatcatcatgtgtcctttatccctggtcttagactagagtttacagaatatctcacaaatttgaagaataatatacaatgttttatctgtgttagcaagaaatgcaaagccttttttttttttttcctgtctgttttgtgaattgagcttagaactgtcctcgtaattagaaatctggttacttggattctaagcttagagtttcttagttttaagaacacatcacctcataattgtaccataattatgaacgttacaagtagtagtgtttttgtgtctcttactgtcagtgacaagcaaaaaattcgctagaatatattactcttccctaactctgagatggaagacagataatagccatggtgcttgaaacatgtggtgctattgggatgggaaattgtaacagcatttgacatgcaagggtcatgtttgcacctcttcttggatccagtgaaaatgtattagttcattctcactttgcaatgaagaaatatccaagactgggtaatttgcaaaggaaagaggtgtcattgactcacagttctttatggctgggaaggccttaggcaacttataatcatggcggaaagggaagcagacatgtccttcacaaggcagcaggagagagaagaatgaaagctgaatgaagggggaagccccttataaaaccatcagctctctcaagaactcagtcactatcacaaggacaacaaggggtaactgctcccatgattcaattacttcccactgggtcacttccatgacatgtggggattatgggacctgcaattcaagatgagattagagtgggacatagccaaaccgtattaagaggcttttagattttggggggaaaaggagaaagtttcattgtagtcatgacttaccatcttttgagtttgagacatatgaggatgagaaacagggtcttaaataaccagtgatatagtttggctgtgtccccacccaaatctagtcttgaattcccatgtattgtgggagggacctggtgggagttaattgaatcatgggggcaggtctttcccatggtgttctcatgatagtgagtaagtctcacgagatcaggtggttttaaaaagaggggtttccctgcacaagctctctctctttgcctaatgccatccatgtaagatgtgacttgcttctccttgccttccaccttgattgtgaggcctcttcagccatgtggaattgtaagtccattaaacctctttcttttgtaaattgctcagtcttggatatgtctttatcagcagcatgaaagcatactaatacaaccagtaaactccagcactgaatctgttctttgcatgggctgacgtttaaattgctagggctaaaaatgctagggatgaggtaataggaagcttggaaatgtggcatacatgcatacttagcatcataaaaaataggaaatgccactagacatgatgaatttctggagatcttagacagaagtgttcccaacttcattaagttgccagatttgctgaatagatatttgtgtgtaaaggactcaaaaatactaggaatatatagcagtaggatacactacttggcctaagaaacatgcagtctgttttgtaaagcagaacacaggcacatgaattggcacaggaatggcatttgccatccttttagacagatatggtagcagtataccatatgaatatcaaaagagcacagaataaataaaggaccatggttttgaataaaaggacgttgattttcaagacctgtacagttgactccgagagatttaaagctagggtcagtctttggatggaggatatgcaggcattgcaggtgtgttaataggcaatttaaatatgctgcttatcagtcagtaaaaaaaagttcagaatttagaatatcacagtatttcaaagcagccattcaggcatattatctttgccatcagtttctctgttaaaaaaaatagttttgtcattctgtagtttttaaaagacaatttcaaaactttcagggggaagcaataattgccaacaggaaccttgacacctagaggttgccaatgtgatcagccttttgaatggtaatcttttaccatccctgtttgagatccacatgtagagtagttgggatatattgaaatcacacttagtgtcttagtcttgaaagttctttttactttattttattttattttttttcagacaaagtctctgtcgtccaggctggaatacagtggtgcaatcatggttcactgcagcctccctcctcccaggctcaggtgatcctcccacctcagcctcctgagtagctgggactacatagcaagccaccatgcctggcttttttttttgtttgtttgtttgtttgtttgtattttttgtagagacgagattttaccatgttgctcaggctggtctcgaactcctagactcaagcaatctgcccacttagccccgaagagctgagattacaggcgtgagccactgtgccctgctagtctttaaaattctgcaataggtttagcagtgtcttagcagaaagtgctatttgagtgctggcgactggcttgcatagtggaaatatactggcctgagctctgcccacctgaccacatactgatgtcattatcctcccttcatcaaccccctctgcttcacatagtcttgtctgaagggaatgggtcagctggaagaaaaaaaaaaagaagtacttgccaaagaaatctgttttctaaaatccatagaaaaggtcattaatgtttcataacatattggaagtgttcggaaaaactgttaggttttctttcttgtttttaataattacaaaggaattcttgatgttggaagtgagaaacagatgttgaaataatcagtttcatttaccttacatactcctacatttaggacatgtaatcttaagagtccgattgaaattctacctgatatgaaagaaattctacctgatatcttactgaatgttctaagagcgaagttagcagtacagaaaaaaaaccaagtatattttttaattggattatcatttaggaactatccattcagaagactgtgaaaactgtgattgttaagtgtctgttaaactgtgtttgcctttgacagttagtagcttctagggtttgggtgtttggggaatgtagctcccacagatactttgggaagagataggaaggtatcagtaactaggaagtagaaagagagtccctcagtgtttgaggtagaaccacttattttcgccctcttgccctgttccattcatgctcattgtcaaactggtctcagtcaccctgttcttccctttgtccttctcctcacctacccccgggcctctcatctccctcttcacactggcacgcctttcaaagggccttctcctctgaacctgtgccatctagagcagctgcccttatctcaggactccattgacttgcccccttttctaatctgtttggaagccttatctcttcgttttggcctctacactgtaatttatttctgcttctattattacattgataaatctcacatttaaccagactttgagggatatgctgttgaactgatgtaaatcttgaatcgaaaactgcggtgcaatcctcattggtcataatgtgtgggctgttttgcgcataataactgatggaggcatctcagttttaaagtttgagaatgaagcattgttcagttttgtcaccctgaatcaatcattttattttgtgcattgttttatcgtgatgtttttggaataaagattggttctaggaaaggggtgggtcatttcatttggtgataacggaaatgcccttctactttttaagtgtctttggtatgaggtggggccctaggtagggcctggatgtctgactgtcctgtcattttgaaaagctcccttttaagacaagtgggactctactcttaggttatctctgaggacttgaaagaaagggagaaaaaaatcctcccctattattcattaatgactagaaatgctgagccagtttcacagattttcttctcttgtttgcttttctattaatattaagaatgcttttgaggaactagtttagtgaatgggaaagcaataaacacttttgtagaaatgtttattaatatttcatacttttaaacattccacactcttagtttctttaaaattaaaaatgtttttataacttgtagtatacaaatacattttaagaatttttggaaaaaagtaagtgtttaataaagactataaatttggaattcaagtttagcaaatactcagctatcagagcctgataataaattcattgaagtgttaattgtatgaggaatatcatgaactccacatattctctatttataatcagatcacaaatttagatgattttccaaattttagctatcactttctaaaggattcaacagtctaatataaatttatttacctctatgctactgtgaaaaagaagaagagcaatgaaagtttctaatatctatcatcagagtatcttagcctagaaaactaaatgttattgaaaattaagctgcttatatatgttgtggtgacatttacattctcctaaataattcattgtctatttacttatgactacttacttatcaaagctaccttcatatcaaagaggaaaatagaatattgtacaataacatatattatcataaacgataagcagcaataatggtttttaactagctagaaaggtttttaacagcgtggtcagcctaaacttcatgttagtatattagtgtgttagttaagaaactactttttgaaggatttacatatacctatacatagagtgagttaaacattcagaatgtggataattcatttgttgattcagtcattatttatttttacagacactctaaatgatcaagattctgatctgggcattgcaattacaaagttgaaatatgcaagattcctgcccaagtaaaggttacatctcaataatcttggtaaaaagcaacaaaaaatactacttactcaacataataaaaaattttaatatattatgatttatataatgttatgtataaaaatatgtaattttggtactgtttaaaaatcaaggttttatgtaaacttaaaattggcccactatcattaggacacacgctttgagtttctttagtagcagatgtaatacttttgtgaatattcgtcttattctcttggacaccttatctccctattaggtagtgatgcatttttacatttcagcattctagaagtgtgtagtctgtgaccattgtactaggtcaaatttaattagttatttcttggatgaacctttcactgtggatattgccaggattaaagtttgaaggtaagagggctttagggggtggggggaattgctgacaaataaagtaccttcaatgagttgtataaattggagattcagtttttataagagctaatgggaacacttattataacaaccaaatggttacaaaaattataagaagagtgttattgatatagctcaaatatggtacagtttgcagtttgctggttgtgtttagttaagttaccaaggaagttactatgctacagtttttaattaaaaatactaatttatttatttctgtactgtaacaaagggatatattgcataaatgatggtcatttgctgtataatatatttctgttgaaaagttatgcataaaattcttagtttaatatgcatttgattttccactcatgattactaatctttgcattaaagtaacaggattattgctttttcatgatgtgaagggataaagtggtaggagtaaacaacagatcagaatatcttttcattttttttaaagaggtgaaatgactcccttaacaaattccagcatttttagattgtaaagtacattatgtaacttcattcatcatgtagacctcagacagatactttaatttttttttgaaaaggtcttgtagcacacttaatctgcagatcttttctggcaggaggaaaaaaaagcatatactgttagatttggtgacataaaggtcaaaagataaactgtaagtgatacctatgtttatttttttgacagtgttaaattagcaacccctcagacctctcttggagcagtacaacctgagtaattgaacatgtcgctggggagtatgcttggttaagctgattcctattatgttgacttgtcagggaccaataattaaagctgaagagcgatgctcattagtgtctgcaagatgattcgaagaatgagaagaagtccttgaggcacacctgcaaaaggcaggcattgcatggaggtgagagcagacggactggcctgcttttctgctatgttagcaagccagcgataaaggggatacactaaattaagtgttgcaaatgtattctccccaatttagattataaaatgcattttacttccgcctttgaacataattttattccaattttattccatgtaatcatattttgctcaattatgcttttaatgctatataagatgttttagaaactagatataagtctattcaaaagcactttgaaaaactttatactaggaatcatttcattcattttcctggaagcatcataataatcaaaatctgctttgcttctttgaactctcaatactctgcacgtaaaacatgtgagttatccagctttgatgataaagactttagtggcatacatttgtcacatttacttcacaaaaatggaatttttaaatgtgtatttaacatgtactaaaccacatacagtacacaagcattggctcccgagaaggccagaggaaaacactacatcataagtatagaatttatatttatcacaacttgagcaaagctgttgacttttggaaacagttcaaactttttagcactggaatgatacagaaactcaatcctaaagctctgagaagcatttttcttcttttgaaatttgccttaggtaggctcactttttacaaatctatcataaaatcatgggatatacaaatatcctaatattttggaatattaagaaaaataatttattggatcttttttctgtaatctggttttgaaaaaagtgctttatagtggtgaagtggcctttttacttccagtgttgtgcctgttaaatttatcctgtgcactttggctggagggatgcatgtgccttttattcagagtgaaggctggagtctttacacagaagtcctccgtgtttgtatcttcaggagtcactgtgagattatctctttgaagaggcccttcctgaaactaaactttgtagaacttgtattactgatattccatgttagcatgaaattgtccgtgtttcggtttcctccaactgaaggaagtccctcaatggaagggactgattctcgctaatgtttacatgaacagtggttggagctcaataaaagttggttaaacttaacatagtcaaggtgcagaagagacttgcagggtagttatagatttccaagaataccaagggctttagaagtcaaatagaacaacctccaactcaatgtcaagaatttcttacaggatgttctttaacagataggtcctctcctggcttggtagaagatttccagtaccagagaggtcactactttgcaaagtagctgtttctagattgatcaactccaatttatagtaatgacaaatggtagttaaaagagttgtactttatatgaatttgcattaattgtcatttagtcttcacagtatccttaagatttagccactaaatatgattatcttcattgtacagataaggctcctgaacttcagagaggttgagtgacttacccaaagccccacagctaagtagtggctgagccagcatgagagtccaccagtatctgacttaagagctggaatgctttggcatcatagcccacagctgcccctcttttgttattgttacagaactatttttaattactttcctttaaaagccccacaaatcattggttgccattagaaatcattcttttttgagacagagtcttgctcagttgcccaggctggagtacaatagtgagatcttggctcactgcaacctccacccccggttaagcaattctactgtcgcagcctcccaagtagctgggattacaggtgcccaccaccacgcctggctaattttttgtatttttagtagagatggggtttcgccatgttggtcaggctggtctcaaactcctgacctcaggtgatccacccacgtgggtctcccaaagtgctgggattacaggcatgagccaccaggcccagcctagaaatcatttttgttttgtttgttttctttaatagagcaaggagagactcttgcaacatttgttacctatccagggttactaggacagcattgcccatcctacaattgctgcatagtagtggtatgaaaagcactccccaaaacaaatagattcttgagtttatccagtaaaactctaatttactctaatttaacacttcctgtgtcttaaatcttaactccaaagggctgttttgtttagcgtttttttttttttttttaatagagtattatagtagagaagctacttgaccaaggttcctaagtctgtctgagtagctgcaaacatttgggctaactacacaactcaaggaatatagatagccttttcagctgtcaaaaggggacaggggaatcccttttctactaatcgtccatctttgatattggagtacaatggactatatatgagaacattcttaccaattgatgtattaaaacttataacttttgcttagaagaatttatggtattgatgttatcatcttatacaatatgatgttttcctaggacctgtcatattggaaacataattgatattgactcttgttacaattatataatgctgaatacatattcatttgcatgaaagagattgacagtgattgaatttagcaggatctgtcataagccttgagcattcttttcttaaaggttcctgatagcagggggttagggagagatgtttagacatttcaattttttaatgaatttattgatatacagtaggaacagttcggctttcacattaattcatacatttcaaagatttttctttgtgatagaatgatgtaaagctattatatattctgcccagaatgtctctcatctgtttctttaaaaaacgttaaagcaccattgaaccaatttttacggtactattaatcagtgtaatcagtattaatacactactttaccagctcagtgccacttgtcagtaatatgacagggtgaattttacatcttcttcacaaaggctttcatctattagggagagaaaaaggagatcaggattttaattgttagcaatcagaagcctatgtgattaagacaggcattctgaataagacacagcacagattatactgagaatatttttcatcctttactaattcttttatgaatttgaatgtagtcttatttacctgaaactttaattatagactcaaaggagagtaatatgcctattagaaatataagaatttaatgttaaaggttttaatgtggttctggctggcttctttctctctttatatcttggcttgcagtgttcccaaatcctcaggtttcctccaaatgaatgttgttggccaggcacagtggctcatgcctgtaattccagcactttgggaggctgaggtgggcagaatcaggagttcgcgatcagcagggcgtggtggcgggcggggcacctgtaatcccagctactcaggaggctgaggcaggagaatcgcttgaacctgggaggcagaggttgcggtgagctgggattgcaccactacactccagcctgggcgacagagtgagactctgtctcaaaaacaaacaaacaaaacccaaaaaacaaaaacaaaaaaatgaatgttgttgatttggtttctaaaatgcccacaattaaaacttgatttctttaggtttaggattatttatatatatgtattttttgaatcttgctgtgtcacccaggctggaatacactggtgcaatcatggctcactgcagcctcaacctcctgagtttcagtgatcctcctgccttagcctcctgagtagctgggcttagaggcatgcgccaaccacaccagacttatttttttttttttttatgtagagatggtgtttcactacgttgctcaggctggtcttgaactcctgaccccaagcagttctcctgcttcagctctcaaagtgctgggattactgatgtgagccactatgcctggccaggtttaggattattatgcgtagaagttttctcttaaaatagaagtgatccttagagtagccacaagttaatttatttctagtgtttacaacccagcacagtttagttctcaggtaattaattcactgttcaaagtagacaacaggacacaaaaggaaaaccgaaataagtgcagcgtagaaggaatggtggagagatggctaagataaaggcagctactcttcgggagtgaaaggaatgaagcctttcccgggatgagggtagctcaagggactagggaccgtggcaagatggtgaagagtctctctagagggaggcaggttgggagaaaacagagaagcctaagaaagaagttctgattgccctgaagctaattacggtgactgccttctatttgaaacactaacctgtgtgtgatgcgtttaatgaccagagaatcaaataacttgcttaaaatcctagctctaggggcaggtattcacactcaggtcactaccatacagccacaagcttaaaccccatgcttcactggcccagctaaagctaaagactcatcagattatttcagcttagcacagagttaaaaagacggagaggcagagggagagagggctatagaagggaagagagagagggagaaagggaaggggagggcgagaggtagagacagagagagagaattgagtcattctttgttccctttcctgatttaaaaaagcaagtgatgcttagaaagtcagcttaacaaagtatgggtaataaaagcatcttttaatcatttgctatttgatatggcatttttatgattttatcaggcatgaattataccatttgatatatttcttaatataattaaaaagtaaaattaagtaaacatcccgtaatttggatgctagattaaaaacttaatttctaggaaattacaaagtctgtgatgaacttcaaatgtagttgacaactacactggcagttttattatttaaacatttgaactggactttgtgggaacagttaacgtaggattgggacgtttttctttgaattatttaataattgcctcttgtccgtacttgtgacatctgtgcttctgttttaccaacctggatctcgaaggaacctctgctctgtgttaaaaagtaagcaaattttaactaaagttgcttattcagctcacagtaatgaagagttatgtaaactgttttgcccaagtttacagatgtctgcttatattaggtacttataatagtagatattttgaaaagatttttaaaaagtaatttatggaaataatttatggaaatgttacattagttaaacactaaaacctccgtggctctgtgtgtgtgtgtgtgtgtgtgtgtgtgtgtcacatttttacatgccagagagttacatttatattttttcctactttatccattggatgtatattatttcttgaaacactaaggataagaacatgccaaattcagagttacttacaaaagcaaatattattatgctatcactgttatatctttgaaattaaaaacaaatagtatcccaggtatcacttaagtgtattagaatatagatttgattgttagagaaagtcacctattagtacgatgtttttatattttttgtttatttagcattttttagctagcattgggaatcttgttaaaactattgcaaatgctttttaaatatatatgtatatagtgtatacatatgtgtgtatttaattaaatgcaagaatttaatttttacatattatataaatatatatattcatttcaatttgttgcatgttatttattttgaaagttgcttgctgcccaccattgacattttctaaatatgttcttacatataaataatgctagcttaagttcacaatgtggacaatttgaaaagatattctttttctttaggtgagggatgataataattaaagacactgtaattccattgttatatacttttttgagatcataaactgttttaggttatctgcaagttttattgtactctgtgatatcttagataaaagaattaaaattggtgaaataagttgcaaagtgtgcatttcactcagataactttctattccttttcacttctttgaatctgttcttgaaataaaacaatgaagccatttgtcctaaaaataatgttgaaaaattgattcatcaagtataactaaaagatagtatgaatttgactgatgagatcattagttgtattggaatttttcataaatctgaattggatctttatctaaaatatgaatgaagaaatggtctgcctaattttaatatttttttaaagtaagtacagtaaatagtataggtctatttatttgtttttagtttggccttaatttcagatggtttcaagggtagaataattgacaccattgaatgccttgtgctattttaatgactttctgctctttaagttaagttgtagcaaccaataatgtccaaggctcttaggcatagtgaagaagggatatgaattatctagataggaattagagagaatatttaagaaaacacagagttaactattaaacttgacgtcttccaccatccagtgaaaaatgctactgaatagaggaaggaaaagtataattcgtgcagtttaattagataggttaccacactgacaccagtggaagaaactccagtgtgaattcagacagcagcaccttatgtttctttatttcagcatactcggtcatcagtgtattctttcttcctgtgcttgactgcatttgatagtagtttctgagtgtgaaagctttgtcaagaaggatcctttccaaccataagcgtgcatccactttggaaactacctagaaaagctgcaaatgataattttgataaagagaattttgtttggaagatactaaaaatacagttaacaatgagcaaatagcattctctgacttactcgaaggaccagtttatatgtaattttagatacctgcatttttaaatgattgtatttattagtatgaattttagaaaaaatattaaaagaggggaaccaaaaaaagttatatcttgctttttttcttgtcctttccctccaccttcttctcctccttctcctgtagttaagttcaattacttgtaaaatctgaggttcatcaactacagaatttcacaaaagcaaaaactgggaattctacagaagttacactggagaatgatttaataaattaatgaaagggtgttaacgaatgcaaatgttacagcattggtggacgtaagtgcctccatatcaggcaaaaatggttgtgtttgaatccttgttgatagaaataacattaagttattataaatattgtacatgaaatgggttttcttaggctgctggatgtctaataattttagtgagtgaatcaataaaatacagctttttaattagtatttttaggtgtagttggaagaattgcttagcacactgtggtgttaggtatagctctagcaacatcctcagcagatgccagggaggtacaggacttagatttcagtggcttcctggcccttccacctgcctccaatccagcattttataggtcacattcatgacattcctcagggtcaggaagtaaaatatttttatacattaacttactaaatcctcatagtaatgctatgagatagatactataactcccatttccctgataaggcaaatgaggcctgaagaaggcaagtggctggctgggagttaaattaggctacttagtgatgggctgcaatttgagatttcatactagatccttcctcttagccgcttgtttcttctgcttcctttccattgttgtgttcacaaaaatgccacttcacaggtttgaaattattctctttttagcctgaaatgttctttacatttcttgataggaggattttattttatgtctaaatacattttcttgttcacttttgtcttgatgaattacaagtaacagtttttaaattccatgtcttaatgtttaggatatttgcatttttatgttttattattaagggaactgtcaatattatgttaaacagacatgagcatcgaacgtgttgtagagcaaatttcagagaaatcacttcttaaattatttttgtcaggacaaatcaaagaattgtataagataggtaattgatctataaactggtgaaggggtcattttaaaatccaggctaatttaagttagattcttacttgacttacagtattgtgttggctttggttcatttttttcaccttctcatggtacataaaaagaagaaagattcttggcttaaacaaatcgctaaagttaatcttgtatgaagaagaaaaaatgaggacatcatttttcaatttgctaaagagttagcctcaatttttaaaactttttatcttggtatatagatatatattttttaaatgctcacttgcatatcttagaaccaaaggcctaataacaaaaaataaacacttggttctttcagaagaaaaatcacagatggcaaaaaaaatttaaaaaaaattattggatcttttgaaagctaattggcaatttttatgtcattgctaatcttgaaagagacaatagataaaactccatattagaggtggatgtgtaatacataacccaatagcaatagcaacagagctgacatagccacaatttagtttaatccttgtcacctctatgtggtacactgaggtcctggaagctgtgtcttttccataagaccatgcctgcttccctataacagtgatagtgaggataacaacagcgagcccacttacttattttccctttgtgtttcaagtggtggtgaaaatattctcagtcttttttttttacccgtctgtcctttgggcctccacatcccttaggacaccaacctgcttcaaaactgccataatgacttgctgaaatcgtttatgtcaaggttaaggagagtatagattctctgctttttgcaagtataaaagagaaaatgtgagtcttctccctgtatttgttcaataaattgaaaggagaaagcttaagcttgtgcttttccctcatggaactatgattatttcagagtaggtcatattgtgggacttaaaactgtaattatagcattgggcagttctctcataataataatagttagcatttatataacccgtttcatcttcaaagcatttcacaggcactaattaatcctcacaacatgtctgtgaggtgagtatcatcatccccattttacagatgtggaaattgattcaagtaagttaagagtcttgccatgggccataggaggaagtcagagtctaaaagcagggtgcaaacttgggagtggccggcgcctaaatccttttccacagccctaaattagaccttctccctttttctccccatctccccgtctttatttctttttttttctaagttctggaaaggactctggcgtttttcctttcagtcttccttttagagagtagtttttttaacactgcccccagaaataaataaatcatcttagtataatagctttaaagatctaatgtgtctaatcaggatataaatatttcggaaagtcaggaaatgaattaggtttgggtgcaagaaaggattccaaattacattttgcctaataaatatcgcatccgtaaacagtaaaagtaatgatagtgattagttaacagtaccaaataaaacgtgcatttaaaatgaacctgaccgggcatttttgtgtcatgctgactgatgtgtacacagtccattctttgaaaaatcaaggcgctcatttgaattgtaaattgccaacactgcaaatagtaaattgcagtagtcttattgtgctgtgatgtgacaaattacaaatggaatattggctaggcttccatatcttgcatttctcttccacttgctgctactatcaccattaatctcttttgcagaagttctatggcaaattgttctggacatggaaaggacattaagttgcattgttgactattgcagggctctgtgtggcttctctgacctctgacttctcttattggtgtaatccagtatagtgatactcattttgggtcctgctgtgtgtggatataagggttctggcacagtttatgtctgacatttcacttaaatattgtattacggtcaagaattttggctgaaatgtgtcaagtatatcttaaagtggaatgtggtcctttaaaatacatccatatcagaaacataaactatattaaggatgagtagcttcttagtttggcctttcgttttacaaatgaggaacctgagattgaatgctgttaataaagattagtttttggatataaggcaggctatgtaactgtcagagctgaaaaacaattgatttcaagtggaatgcttgacctctgaacctaatttttaattattgagttttcattttaaaacacaagtaaattatggatataagtttggaagtatgtctacaaagagaggttactttttaaaggtgaaagtgttctattgccttggcataaccagtgaaaattggttacactagaataaagaatagctatagtttcctgttctttatcgttcgtggtgaaagcattaatgtgtattgagtggagggtagagttgaaaattttgcactgtggtgaaaaagaaagatggatatcaaaaaagtatagtaagaaaccctcctaagccatccctatgtaaccagttctctctggaccttcttggtaaaatgcaccatctgatgtccacagcatgctgagtgccttcagatagtaggctttgttctctaatgtaacatacattcgcttctgctactattagttgacctgtacgttcaccaagagttgttggggattgttccaaacctgttatggtatgtgaacttattaatatacttatgtaaataaattaaatattatataagtgtataaaatctgagaatgaaaaggaagttcttcagtgacacaaaaatgaatgcttcagaaagaaagatttaataaaaatgtatcacttgaggtgtcagattaagtgtgggtgagataattgtagcagattggggaaaagatcataagcatttgaaaattttattttctttttaattttcatgggtatatattagatatatatttatggggtgcgtaagttgttttgatacaggcatgcaatgaagaaattttagaggatctattatgtgcacaagtttatgtaaaaaagacaactggtatgtaattcaaagtttagccaaagtatgtattttttgtgttttgacatataattcctgattaaataaaataattaatttaaataatataattagtaatttaaatggtgattacatttttttttatgattccccactttaactgactttttcagttaactgactactactgatcagtcaactgataagatgaattctgcagtaatggaagatcaagaaatgctattctcaagatctttttattcacctcttcaagaatcctttttatttttctgagaatggaaagttctaactaaattctttgttgctggactcatttcgttttattgtggtttatttataggaggcacacagaaccaaccaccagtcatccatcgcttgttttgagtttttctgttacaatattgctgatctttaatatattccttaatatttaccaatgtcttactacattttcttattaattatactttcccactagctttctgatttcactataacatttgtgaattctcaaatatcgctgttaaatgtgtccattgtgctgtttttctattttgtactaaagcatgttaagctttcttccatgatggaatttataactcaagagaaataaaatcagattatgaattctaaattctaaggaatgagaaaagaatgtgggatagaagagacattgcggtcaagaggtggtgtgtgaagtttgaaagttctgttgccaaacatatgcaactctcattcaagagaaaaacaatctgcaaagactttgaagaatgagagaaacatgattcttaggagcaggctttcagattctcgatgatggatcatgtagacggcagatattatccagcaaaatcaggataattcctgagtcggaggctgcattccagcctctatgtcccaggctggagcagtggcaggatctcagctcattgcaacctctgcctcccgggctcaagcaatcctactatctcggcctcccgagtagctgagactacaggtgtgtgccaccatgcctggctaattttgggggattatttatttttattttaatttttgtagagatgggattttgccatgttgtccaggctggtctcaaagccatgggctcaagcagtcttcccttctcagcctcccagtgttggaattacaggcatgagccaccatgcctggccaaatttctttatctcaattgacccatcttcaggtttgctgattcttgcatctaccaactcaaattcgattgctttacttttcaactacataattttcatttcgttctttttgaataataaataataaaatcaggaactgggtagaggatgggactagacataaaatatttagaaatggtgcaaaaattagatagctgaagctaaatagattgagttagagcccagaaattttttaaaataacattggaaattaaaatgaaatttatctggaaccgctaacctttctttgaaacccttgttgctacctataccagtgaacctatcatgctgtgttacagtcatgtctttactgataggtctcctgcactagcctagggaagggttctttgcttcttattccttatatttctaggatctgagccattataggccctcaatacattagctgaatgcagtaacaaatcaggaagtagagttgtttttacagccttactgttaggttgactcaggtttaacatgatgtgacatttttaagcatcttggacttactgcgtgcacatctgtagtttcttttccttatggttttctttgatgtagatatgcaaggtaagagaatactttacttttttgatattatgttggagaggttgttttaaaaagtacgactttagatttagaagaactgagttcaaactatagatctataacctcttactggctcagtagtcattaacaagttatttacattttctgaatctcagattaattgtcagtgaaataggagttgtcttcttgtctctcagtattttttaatattacaatagaaaatactaaattagaatattagaaaacatatggtatctagcacagagtatgttctcagtaattttttattctaaatattggtcacagaaaaatgaatgcatctcagaagatacatttggaagctcatttttttttttttattttctgaaattgagaatttgaccctcactctccactctcagaaattactcatagtcatttgggtagttggattgtctttccattggctttcatatataaggcaaaaaatgtccaaaaatactgagaagcaccaaatggtgctagtaatgcaattcatgaacattttccaaatttgctagcaagatagtcggtaaaatgtgccattttcacatcttgttcatagagcaaacaaaataatacttaactatgcaataatatacagtattaaatccccctgggaaaagagttggttttaaatactttgaaaagaaactttcaagttagtgatttacacagttaattataaacaacaagacttgtaattaagtgttgccattttgggttgaattggtttcacccatcactaatccgtctatccttgtctttggctgttgagagattacgggaaaatgcacacgatgaaaagtttaacttgtcaagtataaatttagatgcaaagtccggaatatcaaacaccacaagtgataattatcagcacctggaaataatttgtaccactaagttaagtaaagaattctctttctgctgatggggagattttaacctcatgatcactgaagcactccctgcagtttacagtgatgtatcttgtggttcattcccagtagtcaacatagcaccaagcaattagtagaacactggaggataagtgttagctctgtacaatgtgactaagattaaaccgggagcaaattagagcaaggataattgtccagtttttaagttgctcgaagtccaactcacttacgtattacattgaggttcctgcaaagcctggattttttgtttttgaaaaataataaatacaatttttaaaccgttgaatttcctggattatattttagtatcttaacatatgtattttctcctaagttaaaaatttattttggagtctcaggacatgtcttttttttataggagactaatttgggtcccccaaaacattatcagaagacaagttattataatacgtaaacatggtatttaaataaattttgcagaggcatcgacttatgggttttgtggcagaagttgtctggattctctgatggcttgttatatgtgattttcttagctttattaagtttctgtggttgttaatgagatttctttatagtcctctgtaggtaagggttgattttgaaattttggctgcttgtgtttaagatttgattctcattctcaaacatttacatgtataattttgagaacacattttatttaacacaatatagtaaacagaatgaatcataactatgaacgttttccagaagcatttcttagataaattattttataaaaagaaaaacaacacaacatctaagatttagagtggaagaatatacttgtagttaacttccttgttgatttaaaaaatatatttggatttattttggcagggtgggggaatcatctaataaaaaatttaaagcaaacttcattttttctaaccagagtgaagagacagggagagaatcaaatatgtgtgagctccctctgttgctctgtaacagcattttattcatgatttgtgatgtgataaggaaatttttgctaatgtgtcaaaacaaattcaattttcccttaaggcaatttataactttatttaaatggaatataaaggaagaaccccctatatgtaaaattctgaccttcaaatttatgttaatatttttaaattattaaaacattaaaaatgcatctatttctcaccactaagagggaaaaaaaaaacaaaaaaaaaacttcagctatatttagtaagtactcactgaagtcctaaacattaggataaaatgcagggcctaattgagtaaagtatcaactgggatgatgatagtgaacaggttggcaaatttgccaactggatttatggtaccttttatattaattacataagagtaaaatgtgaactcacaaaatagtaatggcaaaaatgaggagttgttttaaaagtatgtaaatggcattttacaatgctgtgaaatacatttttttttttttttttttgagacggagtctccctctgtcgcccaggctgcagtgcagtggcgcaatctccgctcactgcaagctccgcctcccgggttcacgccattctcctgcctcaggctcctgagtagctgggactacaggcgcccgccaccacgcctggctaatttttttttgtatttttagtagcgatggggtttcaccatgttagccaggatgatctcaatctcctgacctcctgatccgcccgcctcggcctcccaaagtgctgggattacaggggtgagccaccgcacccagcctgtgaaatactatttttatggtaagctagaattttaaaactatttcttgcaagtttaggattaaatgaattacattatgtaaaattacatctttgtctgtattacgtatttgtatacagttgaatagttttggtaacacgtaccttagtgctttacattgattggctcattaattttatattttgagtaataatcatctaattttattattgtacaattcagtcttaaattatgttatgatgtgaaaatggtagctttcttgagtgtatttatttttgtagtagtgggcaatgtaattatcacacataaaatgaactgtgagacttttgagcctgaaatattattcatattataatgctctgcagttttattaataacaatgagagatgaagcactaactttaactggtatccaaagtaggtgaatcaaaaggcttgactctcatatatatatatatgacagtctcatatatatatacacatatacatgtatatatatatgaaaaaacttagcatatatatgtaattttttttgtatttttagtagagatggggtttcaccgtgttagccaggatggtcttgatctcctgacctcgtgatctgcccacctcggcctcccaaagtgctgggattacaggggtgagccaccgcacccagcctgtgaaatactaattatatatatatatatatgcgctatatatatgcgctatatatgcgctatatatatgcgctatatatatgctatatatatgctatatatgtgtgatatgtatatgctatatatgcactatatacgctatatatatgcactatatatatgcactatatatgctatatatatgcgctatatatgtgctatatatatgctatatatatgtgctatgtatatgctatatatatgcgctatatatgctctatatatgctatatatgctctatatatgctatatatatgctatatatgctatatatatgctatatatatgctatatatgctatatatgctatatatatatgctatatatgctatacatatgctatatatatgctatacatatgctatatatgcaatacatatgctatacatatgctatatatatgctatatatatgctatacatatgcgatatatatgctatacatatgcgatatatatgctatatatatgcttatatatatgctatacatatgctatatatatgctatatatatatgcttatatatatgctatatatatgctatatatatttatatgccaagtgttttactttagatatcttttcaaaaggactttttcttcaccttctccaacctaaagcattcattttatagaaggcagtagagtaagttcctagtgtatttctaactttaaaactagtatttatattttacccaaataattagtaaactggtagttgaaaaggaaaggattaagtaatgtagtttctttctccacattctgctgctgcttgaatctcattccaaaacagtttagcatcatatattattaccactctctgaatatcactgttgttgatatgcttaacataccttgatcttcaaaaaggaaaaaaagcgagaaagagaatgagttttggggagttgtctcttttgtctttacatgacacaaagcatgaaacatgttttctttttcagcagtcctttgccatgtgttatgactgaatgttgctccccaaataccatcacaccgggggttagagcttcaacctccagtatgatggtattgaggttagagcttcaacctccagtgtgatggtatcggggttagagcttcaatctccagtgtgatggtactgcggttagagcttcaatctccagtgtgatggtatcggggttagagcttcaatctccagtgtgatggtatcggggttagagcttcaatctccagtgtgatggtactgcggttagagcttcagtctccagtgtgatggtatcggggttagagcttcaatctccagtgtgatggtatcggggttagagcttcaatctccagtgtgatggtactgcagttagagcttcaatctccagtgtgatggtattagggttagatcttcaatctccagtgtgatggtatcagggttagagcttcagcctccagtgtgatggtatcagggttagagcttcagcctccagtgtgatggtatcggggttagatcttcaatccccagtggtggtggttagagcttcaatctccagtgtgatggtattggggttagagcttcaatctccagtctgatggtgtttcgggatggggcttttaagatgtaattagggtttaagatcataagggacctggtctgatggggattagtaggcttatatgaagagacacaagagggcttgctctatctctgactctcccacacacaaagtagaggccatgttagcctatggagagaagatggccatctgcaagccaggaagaaagccctcactagaaaccaaaccctgcaaaaccttaatcctggactcccagccttcagaactgtgagaaaatttatttctgttgtttaagccacccagtctatggtattttgttctggcagcccaagcagactaagacaccatgttcagacagaatttgaaaattacttttaagtttgcaccagaatgtaactacatttgatatttaaggggcaaaagcaggtgtagagtttgtaggaaacctttatgttatttaatccctgtaatcatggtaccctcttgagagtttgcatgtttgaaatatttaaatttaactcactcatgatttttttcagaaaaaaaaaaaaaaaaaaaaaaacagattacatgtgggaagcgggccccttaatgtttggtcttgttcagaatcagaaagttcatataggtactccctgtgtggcattgtagacaggatttaccgtaattgacaacattagaaatattggaactagttttcctactgaccttgattcaccagagggtggtgggagagtatttgggaggttttctcaaagagtgtggtgaacaacctagcggataacctcacagttaagactgaatcttctgtttttgagccattaaaagtttgctcaagctagaatttactctctcatattccagcattcagtgttgctccagtatgaaattttagatcctatagaagttaaagtgcagaacacctgggactcatatcctgtcaatcactaatttatcttctgtttcactcctttggtttagaccgtgttctcttttctaaactctcacaatagctgctgaacttctcttctttcctgtgggttgttgtctctaatctatcctctactctgccaacagagtaacctttatgaaatctgataatgttcctctttggctcttgaataaaacccttctctgccttcttatcatcctcgtggcacccaaagcccttcatttattcactactcttctgatgcagcctcatctcctgatattcctctctcatggtttgcagaccagtcagatttattcacttactactcagagattttgaggactttttgtgtccaggactaccaagataattaacgtacagtgcctgtctcaatataaatatattggtctcaatataaattctattcatgcttcagaactcagctcaacccttcaagtccaaagggaagtcttctctcattgggcctactattagggagtagctctgtcctgtatattttactgatctttctaaaatggcaccatattataattagttgtttacagatttatttctcttctagacactgagcttccaagatggggactatgtcctatccacatattccagacaccaagcttagtgcctgattgaaataatccctcagccagtatttgtagattttaatttactgcaatatgcctgaaaagtctttgggttatagattcttcatctattctctgacttacagttttcatcagtcaaatatttgctgtactatttaccatgccatttaccatgtatggtaaaaaaaaaaaaatgcgctctgatttcattccatttcttgcttagattaggtagacttatttcagaagtattggaccaattatagatattttgaaatcctggtgcaaatatgtattttccaaggtctgattatctaatctgtatatcgttttgtatgtttggtgactctcccaatatctctctttatgaatatctcaacatcgtgagtgtcagtagcccttcgactcctttttcttcagatattcacaagcatgcagtccctcagatttcgtcattcctcatggcaacagccccatacaaccagcaactcagaaaccccgatctgtgaccacatcctcccattctttcttgtaccttctccatttcttcagcctttatgaaataagcacccgcctccatcagacgtcttcatgctctggattccctgttatgcctccacttgtgctcagcgatccttttactggtctttatttgactgcccatgttattcctcccaaacaaggctcttcactttgttttttttaacccttctcagctatgtattctaaactcttactctttgtaagtaatattttattttaccacaaaggcatccccagcttcctcccattcctaacagggaaagggtactccaccttctttcctaacctgtcttctttaatccctttcatccgtccttctgacttccacactagcctttgatttcagtcttcctttctaccaatctatttatttctgcacaaaagtatgttaaattatcccctattttctttacattttcctctgaagctttttcccttccttcagctcatggcctagagctgaaagattcctgccaggttagggccgtagttaatggattcaacagtaatcaacaagtatcttgaatttgctagtctgtctagtgacccgatttgcaaacatttttgattacaagaatactttgactatttaatttaatagaaagttcagaactagccggtttaatattgtcaggaagcctttctctattacttcagtctgcctgatgtttccttctcaaaatttctcaggcacctatatcattcgtttttgcagttatcttgttaattcataaaattaacaaatcaaaagttctttagagacctctttgttctgacatgaaaatcacttaacatactctttttttaaattttattattatactttaagttctagggtacatgtatacaatgtgcaggtttgttacatatgtatacatgtgccatgttggtgtgctgcacccattaactcgtcatttacattaggtatatctcctaatgctatccctccccccttcccccaccccatgacaggccctggtgtgtgatgttccccttcctgtgtccaggtgttctcattgttcaattcctacctatgagtgagaacatgcagtgtttggttttctgtccttgagatagtttgctgagaatgatggtttccagcttcatccatgtccctacaaaggacatgaactcatcattttttatggctgcataatattccatggtgtatatgtgccacattttcttaatccagtctgtcattgatgggcatttgggttggttccaagtctttgctgttgtgaatagtgccacaataaacatacggaaaaatcacttaacatattttttactgcaattgacaaccctgacaaatgggttatgtttctcctgtaattactgcatttaccttagtgttactccatgttttcacactggtttgcacacgtatctaagttcaatcagggtggattatttttgtcttgccttacccaggactatacacctaacttgtttcctcatactgattaagtgctctttctataccagatccctaggttactggcctattttctcccaagacgacttcacattttaccatttctggactttgtcttgtctttcaccaatactcttattgtctctaaatttctcagaacagtgctgaatgtgggggtcaatatttactaatttatgtcatgatatttatagaatatctgaaaacagagtcaggtaaaataaaggtttgtacattatgctggaatattatggaatattatcatgacattaaaagtcaggccttcaaagaataatgacacaacacggtcagtttatgagatttattagaatgcctacagtactaataacatgaacttttttaaaaaaattattaagttcttcagattgggaggaaaatataggaacccgatattcaggctcagcttttggttaccctgtctttacccctttctttctgatggattttctcatttaatgcatctctgccattttaattttgtaaagatctcctatacacaaagcacctttatatttccctgccagttactgttagatattttgtgtgattagcatcctctgaatgttgaggaactatgctttctacatgctggtttaccaggtgctgaaaactagagttatcaagtaactacctggtgttgccctctcattttctatagttctgctcaatatagtgggcattgttggcacaaaataaataagtacactggacactttctgtaatataatacagattttatgctgtggaaacatgctgcagatgactccagtctcatgcatatgaatggggtgcaaaatgggtgtggaattttctgtagggtaaacctttctcttcttcaggagaggtagtcatagatgtttactgcactaagatgttgaaagaacctgtccagtgaaggcacatttttttgttaatgtaaaatcaattcttaagagtaatctttttcagtgatttccggatcatgccttttaattagcataaaaacatggaagcaatattaataatgaaaatatatatcgtgtaattttcaatctacatcttacatatacaattgttattttaaaatttgactcagatcggcttcttcaaagacacagcaaaaccttgcataagtttttgaaggtctacacttagattttacatatttgctcacctgacctccacagttctgctcactggcatgtacaccatttctgtacctctcctgcaaaaaaaatctccagctgtattttattccttctcattcttacctgatagccaatcagccaaaatgccaattttttgccagtttttcatgtacatttcctttttatattccctgtgtcactgcctcagcttagtttttaatcgtctccttcctagctcatagcattggttccttaattgtttaactggatgatgccagtgatactgttcttaatttcattctcttggtgaggttcttaacggtaaccattgtgtaccttgtttgtcctcataatgtttagctactctgatttgtgattctattctagttgacctcacattctattttgaaatagtttttaaaagaatcataaaaaattagggaacttagtatttgtcctttataactgcatgttataccatctctacagttgaatgactatatatacatatatatatctttatatgcctctagatgagattttatacgtcatctagagactatttataataaagtgattagtagttaaagactactgattaatctgaacactgtctactgggttagttttgaattttgtttttcaattatcatttattaccctaggatttctagtaccattctgaggatagtagctggattaataatggtcagtgaagtttaaggtgtcatatgaatgtaacacaagaaaattagagatcaggtgtgtttgaaatcttttaaaatcgtatttaaataaaaatgtggcttccttattggtgtggactcatactttattggttgtaatcctgaccctctcattttctgtctatgcgagtgctatttaacctctctcagagtgctgctgtgaggattaagagaggtagcgtataactcaaattaatgccatgctttgtgactcttaagtgctcagtatatattagttgttattataactcatttcctatgataaataggtacacaataatcttatagttatgtacaaaggggagtgtaacaacttttttcacgtaaattgctcagcttgcaaattattatagagtttagtaaataatcagccttcagttttactttcccagaaaggttgtatcagtcttttatggtgactatttaagttacttacttttttctgcagtgattgcttcttaatgctgaaatcagaaagaatgtcagcaagaaggagagcaggccaatttataattctccatttgggatatatgaacaagcaattgattatgctttgatctttccggttttacctgtccattgaaatctaagatggctggaaacaaaatcgtcctcatttcctggtaatgtgttagaaaggttctaatttggggtaccttactcagattctgacactttgagaatagataaccatgaccgttcgatttttatttagaaggaacagtttatctcaaccctattagctgaagtgtaataccagaatggcttctttttattaatgctcaattatcctgagcatttggggaggtaaatgtctcttcatctattaactgtacttttttaaagttgacttttcttctcaggaccattttcaagtgagggtataattggctagtgaaagagacctttacctcacagtttcagttttattataaattgcccattagtgcattagaaacaaagtgaaaaagtgagaattgtaactattcttttattctatttgttctaatcctgccactgaatttttttcaacttttttttaatatatgaactcagtatgaaagatgttggggaaattgaatacattattggttaagttgtcaggaatagtatgatcttcaaatattcatttttctgacttcaaaactgaacaaagcctcacacgcatttggagttaagctatttcaccttgtatattaaatataattttgcacatctgaaaaatagcaggtaatgtactcacctaaacgatatcattcttttgtgaggcacatattttcttgggagattagagcttagagaataaagattaagtgactactaaaaattaataagaaggcggagtcagaatgaaaaaaaaaggctgagggctgaagtctttgtttatatcagcttatataatcaacaccttctctttatcaaattcttgaagccatgagtaataacaattttattttatgaggaaacgtgatatcccctggaaaacttgtatataaattgcacagtcttatgttcccaaaggatgctgggcccttgaaagaaacacagggttatacatatattagagggtaggtaagtagctggaaaaatctatgaaaggaagcctcacatcagtgtatctctcctagaaattaaaccatttggattctccttcctaaaaattccttggtaggagaccaagtttgagttattgttcaaaattgggttactggcagtgtttcaagggtcaattctgtaattaatccttgtgtgactatctaatttattgctagtagaaacaaatagtctggttctttgacacataatttaaggcaggacagtctggggatcccttttctaatgtactagaactaatgttttgtctttagcacatagcttattgccatttctatataaggcatgaatttgtgatttttaactgtgattttgttattttaaaatttacagtacttaggcattctctcttctctcttgctttcagaattgagtccctttctaacatttttgtttttgtccaaattgtagatgtattatattgttggaaaatagaagaaagaaacaacagatttagaatgttgaaagataataataatactgttttttaaaatatattacctactaattcaaacatcttcaggttttagaaaactagacccatgttgagtccattctagtattaccagcattaccagtttgagtagatgacccagaacattctttatctcctttcttttttttgagacagtcttgctctgtcacccacgctggagtgtaagtggcgtgatgtcagctcactgcaacctccagctcccgggttcaagagattctcctgcctcagtctctcgagtagctgggattacaggcacgcactaccacacctgactaatttttgtatttttagtagaaatggggtttcaccgtgttggccaggctgctctcgagacccagaacgttcttaatcattttacatgttttcatgttagcctaatttatcttgatattgtgttctgcccttcttcccacagtgtaaaatctttgcaaataatttattgcccaacagtatttttcagcatgtactctgccagtggtatcactaccattttagctgaaagatttgcttaacacaccatcattgttgtcttttaaattatttccattggttataccaaacaagtgaaatcctgtatagatttccactactttgaactcctccacatttcagtgctcttagaaatttttgtgatgttggaaattttctatagtatgtgctgtccaatatggtagcacaatttatagaatatgtgctttgcatctgagttttagaaatagctgtgaagacaatataaaaagaataagtgttgctgttacattatctttttgtattcagaagctttgtttctaaccactctctcactctactaagatgttaatgaaaatcaacactatagttttcaggaatctgctaaataatcagattgagaatggttattaccattctacatattaacccataaaatattaaatatattcctgttgcttttttctgctgcctgtcccaccaccaccattgtttaggatgaaatatcttatacactggcatacatggtacttatgaacgttccacaacaccatgtggaacgctgagtgagcctgatagagatagaatacagcttcttctttcctggcttctctgtactatagacaaattcttactttatctgaatttagaagtccttaaaatttcattcaaattcaatttgtagggcattgaattagtggcatttttctctgataggttttctgtatcttatgagaaattttactatacaatcctcgtatgttcatagggagaactgatctgctttcactaaatccagagtatgccagaagatctgaccataagatacttaatttctggtaaaattgaaagttttttttgttcaaataaaatgcatcaggtgctttcggaagacttggtgaagataacaataaatacattttttatctttaaaagatgtacttctatgtactgacaagaaacaaatctttaaaggacacagttgtttgaactaatgactccttcattagcagccatactaaaatctttgtaaaagttcaagaaattatacattttggaataaccactattatagtgttacatatatctataagcaactttgatcactggtattggctatgtaaaattatgttgatcgatactaagatgtttattgaagacagttaatttaattgcattcatacatcattagattttttttcaaagaagctccattttaatgccattttatattattttagaactttctattgtttgtttaccacagatttatatttgagagtaagagttgatattaatacaaatggcatgtgccttttctgatattactcttagaaataagaagaaaatgctgggtgtggtggctcacacctgtaatcccagcactttgggaggctgaggtgggcagatcatgaggtcaggagttcgagaccagcctgaccaacatggtgaaaccctgtctctactaaaaatacaaaaattagctgggcgtggtggcgcatgcctgtaatcccagctactcaggaggctgaggcaagagaattgcttgaacctgggatgtggaggttgcggtgagctgagatcacaccattgcactccagcctgagcaacagagcaagatgccaaaaaaaaaaaaaaaaaaaaaggaagaagaagaaaatgcaaagaaaacaaaaatcagaattgtgagtgttttatgttatgaaacaatacagtggtctatcagcacatgccaattattgctgaagagcagacaataaagcgaccagttaaagccaaatctgtcccttaatgtacatatttagcatctagatggggaagtaaaacacattctcacccacttatcttattattttaataacactatcatagaaatgattgaataaattcagttatggataatttttaagaagcttgaccaaaaaacaattttctggactctggagtttttgtttgtaaaattgttgtgaaatagtgtcctgatagattgtattcttttatttttcgtgaaggctaaactagtcttaaaactattttggaaagagaatggaagattcttttctatatcttgattttggcagtaaccttgtcagccttccagttggccaggaattttttacaattcacttcatttgagtaacaatcctgacactcaattgatgggctggaaagaaagcttccttttgacagccaagccttagccggagactcatccatgtatcaacggatattgttatcatcatgctcttttagatagcctttttgttttgtttcaggttggctttgcgatatattaaagcctcggactacagagaaacctttaaatattcagaatagaatttagggattaatcagcagtcttttaaatgcaagtttgcctagagtttgagacagctttccaaatggtttatatggatagttattattatttttgagacagagcctcgctctattgcccaggctggagtgcagtagagtgatctcggctcactgcagctcttatatagatagttttaatggaattgctttccagatactaaactttcacatgtacccacatgttcataaccaccttagaaaagaaaagcatagccattacataccccaagtcttaccatggtgcatattcctgacggaagggagatcaaacactattttttctggatccctccttctggtttatgaaactacctgaaaccttttaagcccttctgatttatcaaaattactgaaaccttttaagcctcttgcctttcccggtcctttacaattcttatatatttctgttaagggtaaaacttgcacttaacagtatattttgggatatgttgggattctctgagaacaatttttttttctcccctaaactcaggatctaatcttggaaaagcaaaatcaaaaggtttatcacaggggatttgtgtgattcaaataggataaaagtgcctagaaacaatagcttggctaattgttaatcagaaggacaatgcaaatttttaaatcaacatggaagtaacatgattgctatgaactgtagatctttcagaatcaagaacttaacaaagacaacaacaacaacaaaaaactcaaagtatagaaacttatggtggtaaaccacatccctgttatctgaatttattacagaaggtaaaaaataaccttttactaatctttgctgagaacagagtaaatgctgtaagaccaatgtattattttaacagttattaaaaatatgtcgaatttacattaacataatatgtagtggcaaataatttacatgctttcttttctttgatattattttatgaataagtctatcaacttaccaaaatttcacacatttcattatttcctttcaggctcattattttctggtgttatcaaactgagtcagctctcacctcttacacaacttgtactcacttaagttttgtctttcaccataccttttcatattataaagcgaccagacactttactttgaaaacttcttttttaaaaaatttccacttgacaaatgaagaacataatccataacttagttacacagttgaacttttctcccccattgcttgtataaagtgtggagcacccatatgaattataacacagagagctaagaggtagatatttgagatatatctatcatttatagtcattttcacagatatgcaaagctcataaatgccatcacacaatctcctactgtcatactcattgatattacactttattattgtgggaaaaagtacttacattataattactcaaagatatagccatgctataattctaacaggttggtgattagtttgtcaataccctatcttacgtagaaattcaccagttatctaaaaacgatccattaaatcgacttaattatgtttaacctgacaaactacagcacatacttattgttgacataaaaagattttggttgaattcatagttttatgtctttctcagtgctcgacattgttgttagcagtaaacgtttataatacgtttaagtttagattaattcgtctcttcatgaggacattaaaccaaattttatttaaaaaataattgtaatcttggaatatacttaatattggtaaaatcagggaaagatatatagtgttttcaaaccaaaattataaaaaatgtcatagtagtttgaatatttaccttaattgcataaacttggtttatatccttattcaagaatgctctgaggttgtatcttctacaaatattgctattttttaaataaagtattagcacatttaaattttttaaatacaggtgttttttatttttttggaattctgggaacgttagatgaatgtgattattaacttctcaaagcaatcataacagaactcattattagagatattattgtataatttattaacacatcgtggatataggaaaacatctgaaagttacagtgagagatgaagtcctttctaaattaaataaacacagaaacacagagagctttcagcttccattcttcaacctcagccttgggtcaagagtaaacaaacacaaaaactcactgcttcaaatgtgaaatttttcttctctttttttttcctgtgtatgaaatatgttcttgcacaaacgaatcaatacaagaaactacaaaatacaatctctgttgcctctcatccagtggataatagagaatcgtagttagagattaccaaatggtcagcagtaggattcactatcattgccgtcaccaactaggaataacttatttgctgtgtgcacaccagaagaagaaccaaacaagtaggctaggaaccagaaatagtaacacaaacatagagttaggataagaaagagaaatagagaactcttacagaaggtaaagttctaatattgataacttctattgtttgaaattgactcctgggaccagagaaaagtgtgcctttgcttaaatatttctagtaggtaaatcacctctgggaggcataagcgtggaacctccaaaactgtcgaagaatagttatgaaaaggtttgaaacatcacacctgtacaaatatagagtaaacatatgttaaaaatttaactcattaataaggaaaatagtgagatggaaaaactgctttaaaggaaaatcagaggaacgtgaccttctgaagctaatactgtccaataaggtaatggcacattaacctttgaggttatcatttcttttggggagaaaattaacatgtaacttcacagagtctaagactttaattaatagtaaatagcaaagtcaaacacaaatacattcccttaggtaattaaataatccttttgtgagcctgtcaaacagtccctagtgtatattaaaagaacatgccacctacttttttattttttgcctaatttccaagttttgcataatttttcatagcagtgctaacagataaaaataatagatgtcatctttaaaatattcatgttaaaattagttttccaaagcctacataaacaataagtttgactactgagtagattatacttgtcatctagttcatctcccaacaggttaaatggctttaccaagaatctacagcaagttatagggagaagagctgaaagataaatgaggtgagatgagcctggaaaatacccagttttatgttatttcttttttctgtactttaattgctctttagcctgtttctcctgatctcctagggcacaaaatgtatgggtatgtatgcatacagagcattcctggaacttaaacctaaggataactgtgttgaaactgctgacaggataaaaacctcatgtaattaaaactgccaatcacaatcaggacatatattaatgctgttttttttaaagtggttccatgtcatctgttgatgaatttgcaaaacaattatgattacattgacagtgaagaggtatgtatatgaatcagtgtctagaatctagatgcttatttccgtctttgctgaattgaatattttagatggaattaaaagggagctataaattttgcaaagttactgccaaaatatagttacaaattttacaaaaagcatttcttgaaaagcatattctagattattttgtttagcaatttacattttagagttttggaaaaacattatattcaatataattaattcttcttttcttttgaactgtcatagaacttcactctgtaatcttatgtttttagtaaatacagacttaagactttttaatttatttttcttagtttttatttctttccatattgttattaatgttgtctacacaatatgggacaaaaccttttgaatttaaagttataatacagaaaatatttttatgtatcctgaattttctgaccaaataatttagtagtttttttgttggcaccacatctattgtgtactaaatacactggaaaaaaacaaaatatatataatttaaaattccgctcttaatttttttaatccaatgatcatctatcgaaatggactttgagtcactaaataaattattttgaaagagaatctttttatgagattttagtttattccaaccccttaactgggacatgatttctaaaggaaacatatttcaaatttacgtagtggatttcaaaattaattaaaaatttaagtttaaaagatgactacaatgagaagttatgctggtaaatcctttctgataatattgttaagaagttatattcatctgaaggatgtgtttctacttagtttttcacaatgcgtgcctttataactaaaatgtcatttttttaaatgacatgtttgcttttttgctttttttcttgtccaatttactgtccacgaaaatactacttataagttaataagaaaaacgaaaaagtagcaggcaaaaaaaaagttctaaaatattaccataaggataatacatcaaagaaattttaatggaattttcatcacttcatgttgctggacatgtgtaactactgcacatatattaaagtggtccctaccctttaggaaaatgcataggaaagtgttgcatagtagcacatgagatggataaccttgacaattgtaaaaggcaagtgatgttcatgaccaacatactttacacatgactgtatatgagcatttgatttgtatctgttgatattgtgtgagaagaagtttaaatttctgatggtttagtttgacgctggcaaaaggcaatgcagagaaaatatcacctttactcttctaacctctattttaaagtgatcggagctatgccatacagagtttctttaactttaataagtatatccactgtccctaataattttctccatttacactaacatctacaggggttgatgcaattttgtgcaactgaaagcttgtcaaatttggaagccccactttaggaaaaataattcataattttggatatacctttaggacaaaaattaatatttgtgtagaatgagaaaataagtcacagcaaattacggaatttaaattttaacaaataacatagttatcatgaaaacccaggaaaatagcataatatttgtgttcattatctttctgataatctctataatctttttctctcacatttttgtatttttgctttttgatcacctaatcatatgatgagacttttctaatattttctagagtgagaatagtttttgctttagcctggaataataaaagtgtattttttatttttgatgttataggatagtttcctttagctttacaactcattattggtgtgtgatttaaatttatagtattgtcattccatttggaaacacttcccatcaaatttcttacatacatactgtaaggtttggatttgttttcattagctaactaatggctctgtgcatttgaagccttgttgctcttttactaccaagaattgtgtagtgctgggcatgttggaaagtttcttcttgggatatgacctctggcccttcattttcctgtccttacacctggtggatgtttggaagcctttcctacaccagagcggcttgctgaacaatctactggatccagttttagtatgggttcttaaaagttttactacatagttaggtaatagtcaaaattaacacaaatgcaattatcaaacaaacccagtcaaccaggattgaaagtgtcaaacagtgcaacaatcaaggccattctttgtcatgatcaagagcacagagcctggagtcagactgacaaaggtttgagattgatgaaagattgtcaggtgactttttggtctctcctacatagtctggaaatcagaatttggagctttaaactttaacatgggtaggatgccaactatgctttaaagttattttctttgatgcagaaagacataatttttagtatatcataacattaattcacaccattaatctttttttctctgcatattgaatcataggaacttcttttcacaacaatttttgttgttataatgttattttaatgttactaattagccctgcagaacccctatgacatcctttggcatcgtctcccatcgtctctctctctctttctctctctctctcattttaataataactgttgtataaaaattgcatgaggaataagttcccaactcccgtgatctgcttataatagctgtactttcttcatatagtcttaagaggcatgtctagtttaagtaccttccagagaaggtgtgtatttatgcaaaacttttcaggggcttgttaaaagtgaagcttttgcatgatttgtataagaaagtaattaggatatctatctaaatgataataagaattcaatgagtacagattggcaattccactttgaagattatggaaagatagagattttatattttaaaacaatttgttaggaatatcaaagcagaaaatattctagatttggatgaacaaccatatattttgtttaaaaagcaagaaattgccccagattacttcttgcattagcaatgtatatatcaaagactccggaaaaggaatttttttttttttaaccactaaccactccttgcaaaaataaggagcattaggactttcctccctaccctttacttttttaattctactaattgttcacacaattataaaatatgtagaagattgttttattatgtttttatctgtttgttcagtgatagtgttatatagtaaaagaacactggtttgggattaagcttaacggtgttttagtctgagcctcaagagactttattcatactctttaacctctataaacctctgcttcctgcactccaaaatgggactaactatactaccttgcctacttctaagtttgctgtgagtatcaaatgacaaaatgtgtatgaaaatgacaagccaatgtgtcatccttgcaattaccatagttggttagaaagatattaagcaacggttaaacttttaaatcctgttttacttgtttttattatgatagagttctttcttctattatttatagagttatatatatgtatcatccgtatccaaactaatattaatgttatggcaacttgtgctttttgagtctttccaaagatttcaacatgattttcataaagcatatcaatttttttcactcacattgtgtgacatcaggttaaaaagttactaacttaaatttcttagaaatattgactagaagaatatataacaatataaaatgtagagacgagtatgaaatatatttaaaactcattaacgaatactttaggttcatttgcttatttgtacaaaggaagctcaagtaatttcagtacctatggcaagatttatacattctgtaattagatatcttttaaaaacctacggtgataattttcttaaaaattggtcttaaagtaacattgttaacacattggtaataagaggtattcattgcctttgttttcttttcccctcattttatatacaattttgttaatgactgtagatttagtggtatatgtggtagctcatgtaatgctctagtatgctcagtttaattatagatttttttaaaaggataattgccaagcttatttgtcctgcacaacatcattgggaatactttaaaaagttttcagggaatcagagaaaaccaaactaaagataatggcctcagaacccaaattatttttactctgtcatgaattttgctaacaaaatcaaaataatgagtactaactgacaaggaccatttaataatctacccagctaaggttagcagtcaatattttacatgatatttcactgataacttatttatcatattttacatgataacttaagattctgtgggtcttaagttatgcatattctcttttattactttaataaatattaaaccacaacatgatgtaattttagcttattactaagtattataagagcacttagaatataactttttacaattacaaaaattttttaatgtcttatcaacatgaaatacttagtcatttatttagaaagtataagtttattagtggatttactgtgtcctgatttaggtcagttaccttaaaaatacgttcatttgtctgtttttattaatgctacatgccaaactaatgacatttaaaatcataggaaaaagagatttggcatttgatttatatttcatggcaaaatgcacaggtttgggtaatctcaggttcttaaattctttccacattaaatagtgagctaattctaacttttttactgtacttcttcgtgttactgcattaggtttttgaatctgcttggatgactcccgaagagcagtttagtctttgagaaaaccagatctccattgcttccatgaagatcttattaatatttagataatggagagtaacgaaaagaatttggacattgaatatgtctttgtcttctagctatcattctccccaacttaatctgtgaccctgagaaagttacttcatttctcttgagtcctcaacaaatttttcttacacagtatatgccatcttaattatcttaagtatgtacttgatcatctctagaggttcctttctagtcttaggttgtaatagtctttgtcatactggaaaaacatttttaaaaaccatcaaaatgtattctttttttctacactggaattgacatatggcactataaagatcttgtgatggtagaagtcatacatttgaacatgagaatattaatgacagcttgtaaccacagtatttcttatcctattctaagaaataattttagttattaagctggttttttttggtatgtcttgagtttatttgaacgattgaagtatttggaattgcgtcatgtaatagttcactgcaaaattaaagtaatttgtatgaatgagaaatggaatcagtatggtaaactcatttcattgtgcaaaatatcttttgcatggaaggcttagttctattaataattcaaggaaatttttaaaataattcattatacattaaaaaaactactaagtgtgctaacatcttgggatagactacggggtaagaaagaaaagagaatatggactctccatttaattatatgttattatctaataaaacgaatatatgcctttatctaataaaagaggtatagtgatattactcccattttccaggtatcaaaatggagacatagagtgattatgaaacattacacagctgacgagtggcagagccaggattcaactcagcgtagctccgaaatcccctcattattgtgttacactgactcccacctaaaactagatttggggcataagcttataggctgttaaaaatagtgagtttttgaacataggaccatgtcttctttaattctttctttccaaagtgaatgttcttataaatcaaacaagagagtatcttagagaagggagtcaattctctcagttattgggagaagaatagactcacatatgtcctgcaataggcatttctggataaaatgtctcaggatgtgtattatatttaatctactatgatgcaatgacattgtttaacttagataccatgtggatactccttatgttcactaagggtacgtatagtcttttgttacctaggtcataacagagaagcctttgtgtaccataatctgactctctagctataattatgtatcacttttatttctttcacacaactctttatatatacaacttaaacatatatgtctatcacaggacactattcaacagaagacacctataatataggagtgtgctgttgagaggatcaggagactctgatttctgatttgaaagaggaactatgagaaaactagaaatagttttcttgcccagggtgttcacaaaccttttctatagtaaatgttttagtctttgagccacatggtatctctgaactcaactgtgacattgtagtatgaaagtagccatacacaataagtaaatgaatgggtattactggttttcaataaacctatacttatagcatagacattggctgtctatggaaccataatttattaacccttgctctgttaagtaaaagcctttacaatggatagaaataagacagacataactcacacaaaaaggcacttcttgtctacttcttttctttacaagaagcctaaggtatgagcacctaattgcaaaccataccacgttcacaaatgagatcatgatgtaaataatggaagaaccaaatatggtgcttaaaataaaaatggtacccaaaaatataagtccttgggaatatagtgcaagaagaaacaccaatcattctcccttctgctgcagtttgggattttgttgacattggtatttcatgtttattacatggattgaaggcaactgaattcatgttagttacattatatttacaaaagttcaatttaatttctattcaaatacttaatattatgagtgcctgactacatttcagatatttccaaaaggatggaagtaagagaataggcaaactgaaacaatcttttttgaaaatatttttgtaacaggtttctataagaaggtgtgggtacaagtgtttacattttgtgtggttagatccaccacaagattatgagtatcttaagaacaggtcccatgccttattcatttttgtgtcattcccattccccataacaatacttgggaaaaaggagttaaatgtttttgaagatgaaatagtaattaaagttcacatgtatattgatatgtcttttctgcaatagtaaactaatcccattaagatatatatttaagacagatttttgtaggcaagtatgcagtagtcttacatgaccatatatttatggaattcaatatatgcacacacaaactttaatggagtaagttttgaccaaaatctaagagtatgatagataatgccaaatacagaaaatattcatatatatatatagtagttggtggtggagacagataaaatacatagtattttccggccaaaaatattatggtgattcattgaactttttcactcatgagcatgaattttttagctcaaaaaaaaaccatgaagcataattttctatttttcacattcattttagagggaagaatgatacagttatttctagaaatagttgtctaagaacaatgaatttcttctctttatgatagggtccattttaaattatgttcatttatgtccaattcttgaagaaataaggccaagctttgaatttatagtccgcaaattttcttttttaaaaacaaactagttcctaaggaatgcagatttttttaaaaggcaaccaaaacctaaaaaacttctctccttttttgtcctcttattgcttaaaaaagtacatgaacatactgtttttaaatttaggcttttaaaaaattgtcctcatgctgagttcttgtttgccaagtttcagcttggagagaatttttatagcttttataaaaccctgaaaatagaaaattttaaatggaaatgcttacacacccttagtgacagccacaaatcttgccactttttgagaatgaaggtaattttttagtatttagggatggtagcaacacgttgatgcgatagtttctaaaggacagagcttttgtttagtcgtatgttagatatgttacattggtttatcatattaagattcatattaagatttagctgtatgttcatacatttcgtatgtgatataaaagttttaaattttagagtgcatttgtcctctaccacatatagtttatatgtagaaatatgtcttatccatctttttgatatgtcacctattatttaacttgactagcaatttaacttgcaagcgattcaccctagaagttagatttattgtagttgaataaactgttgtcctctcacttttatcatataaaccaaagggtcagttgccctttggggaaacccagaatatgtcagatctttgtcaggtcgctgtgggtctttgtcaggtcccaactctgtcacagggattttaggcaactagaaccacaggtgtcacttccaaaattgatagcttgttatactgcaaccagagtcaattttagattggagaagagaaagaaaaagataggaaatgattgaagctgtgggcaccaagaaagggcagtgctggaaagagaatgaatgacatagacacccaataacagggagcgttggtcatttttgcatggaccaaaacaaaattgaagaagtactgctgatcaaaggccaatacaatgcacacatatcattctggttaggttgtctcctgagaaaaatatttctcagcagcagtatgatttattttgaacaatatctgattgaacagcattctagtaatgtagaaaatttatagacatctactaaattttattctagcagataatccacattaaaagagacaaaagtccatgttttacctagaacctctctgtggctccttttctccaccagaaagacaataatttcatatctggcagaagttaatgctttttaagttcttgacgtgtatactctgtggaagaagtgacctaaaaggaaaaccaaatagtttgataaaggataactgtaaagaacaaaaaaagtaaaacaaactactataagactaatagtccttgagacaagcgcatgaattagtgatgaagtattgctttactacatcctgaaaattctttacatttatttcttcagttgaatgaagctttctaatatctgtgtctggaactaattctgataaccttggcattcaaaatggagataaaggatagatagccttccacaaaacgcttcagtatggcaagaagaatcatctaatattgacaaataaagcaacgtgacatctgtgttgaattccaaattgacttgttgagctgtgcaaaaaagtaaaagaaggtgcttattttcaggatgtgaaatacattgggaaaagccaaggtcaaagatgaaacatgactcaatgccaaagattttcaatcttaatgaaaatctctttcaataagaaattgacgattgagaaacagtgtcattgttagaagttcgatgttcttttgggggtctaacagacgaagccccagagaactgacttttattaatagatagcttaagatttatagcttaggaagaacagattaatagtttttggagtaaagcctgaattatagaaggatgacctgagccctggcatgagtgatcaatcagttcagtgtctgcaactgcacaattttaagaactcttaaaaggctctttggccactgaaaatgcattataaaggataagtccataaccagccaagtctggaatatatgtttatatggctatacagatccagtgtttctttaaaaataaagcaaagggtatgacacaggttggtttgctgttacttaggatatgtacgattgaattgagcctaagataagtgggatgtactgggtaaaatgtggatgctggaggaggatgcacagaggctaatttgaatccaggagatttttccatttaggaaatagaattggagtcagggaagtaaaaatcttgaatacaaagctaagaaattgaattttccttgttaatcagggttcaaccattgatgtttacaaatgagaaaaatgtttcatgcaggttaatcctactgcaatattggcaggaaaggtggaggtcagcgggaagagacctctggaaacctgttgaagaatgagtacttccagggtaaagctacagcaggcaggacagcagagtggtggcctaggcattggagataaaggcaaagataaaacacagatggaaggaaaattcctaaggcaccatgagacactggatattgagtgagagagaatccaaagaacgaagaatcactcacgtcgagctcagcctactaggacgtcaatgggttccttatttgttttctgtaactctcttctcaaaatggatcaacttctttcaaacttccctagtgcaaattctggtttggttacttttcttttctgtaaaatgataagaacattaattagtcttgaaggaaccatttactgcattgcagatgattagaaaattgacaataccaacaaaaattgaattggattctttaggtttaatatttggcctaaactaacatatttcacctgccatgtgccacactcactgattattcctgagatattcaccaaacccttccccacacttggcagtgagttcattaatgacaggtatttattttttatctgtctccatagcctcaacacttaattccattcctagcacttaacagatgttccataaatgatgattaaatgaataaatagaagcctagtgtgattcccagctttgcctggaataggtcctgctccaataggaactcttatacctctttaaagagataaggagttcggcttcagggaaaacaccttgtagactccatttatcattacttttctaggttgttgtcatacaggaaaaaagaaatgatctgacacatttctttccagccttacacactaatacagtataaggagccacagagaggaattttaagattttttttaagggagagtatttgattggccaagatgtttgtttaattcaagagaaggaaagccccaaatgctgcctaaacataaactcacaattcaaaacattttagaaattatctggcaactttacatagagtccaaatgtttccagggtatgcagaaagatgccccaaagtcttaagtacccccagggaaagtagatcaaagtttagagaccatttagactcacttccaaaaggatctggcctcagagttttgcagtagtgagcaaaaattctagaaaggtctaggttcagaaaccatagcaaagttacaagagaaaggttttctagcttctgtttcttatgccattcaacaagatttagaaggaaatgcagccaaatttaatggtcgttacctgatgaaaaacagacatcctttggattatcctcaagcagaactgaacagaactaaatgcaattagaagactccacggaggccaagatgatcagatgatcgaggaaagcaaactgatataaaatataagctcaccatgttaggtaactcatgtgtttccaacatggtgctattagaggagcattagagaaatttactgtatcatgaagtgcacattcgtttcctcggctgaggacagtactacgacaatatttgacaggaaatgtagagaatttttatttcagtcaactctaaaaagaatggcgaaattcttgaagctgtgtatgatgattctctattaatattctttgttcaatctttaaaatggcgtttatttctcaaaggaaagttcgtgccatcaatattgattccattatatttgtgatatacatcaagttttatcttcagagtgaaaagttctttgtatatctttgtagtaaacacagattttgttctcattttgaacatgcactaatttctacatgaactaaatttctacatgaactgggcacattggcttaatttaaataaacatgttaaggtggtcattactattcaagagtcaccaatgttctgattttttattttatgttctgcttttttattttagacaggcaagttgttagcatttttttcaaggaacaaagaacaaaaattatcttgataagaacttgtttctgaaaagctagattagctcttctctgcacaccaatcatgcaatgacagtacaatttagtgacttaagcagtacattaggattctcagcctaggcagaagcttcaccctcgggccagacctatataatagttgtaagaaaatgatttatgtgttgtaataaatgttacttctcaatctgtttgcttgttcaatggttgaggtcccaaaagaaaaggtctatctcaaattaggactggcatgtattatctgtcaactttatatagtactgtaaaagtcattcagctgacagtaatattagcggaatgttttatagatttttgtactgtgtgaagctttgtatgggtgacgagagactttgggtctgtggtgctctgtggtccgggataaagttgcgtgtagatgagtcgtttctgtgcttctctgtaaatgaacatctggctcacatattgattccatgtgtgaaaatgagatcagcccatataatgaccagaatcaatcaggcttcagccgaggagtaacatacactggtcttgatttgttagacaaccagaattggcagcaccttgcataatttggcaccaattgacaaagattaggctgtttggggaccctgaatggttattaatttgaaaaccccttatatattttgcagagtaaaatcagctgtaacttatttgttccagcccccttcttctcgtacgagccctaattgttttagacaaacgaacgagcttgcagcctgttcactttacacaggaagacatgaattctttgatccatacagtattctttagctcaaccttggagctatttactgaggagatttatttgcagacagacagtagaacagttctttgtgaatagaaatgagtacagcttctatgtgttttcagctcaagtttctgctacttactgtaagggagataaaactaagccatctttatttttaacccaaatcattcttttttaaaatatagttttaaaaactgaaaatgaattagactcttgacctttttactttttcctcacaagttatatttactagagcacagattgaactcagagaatgaccaaataccatttcttattttgtgaattgtgttaatcatgaagaaaaacttgtgagattttaaaatgggacaggcgttgattgtgaacattttacaaatgtgtctcactccttaattccaggcacaaataaaactacctgtgttgtatgaacactagttagttcaagaaaagcaataaaaatctacttttaaaaattattactgccaagtagttttaaagatacagactcatttactttgaatttaactagtaatatttaggtaagtatctaaaccaatatttaattttttcaccaattaaatgagagttattggaacagtctctctaaatgctttatatatatgagccaggcaatgtaatagtaacaataacaagatagtttcataactaagcctttctataatgccataagatatgaactccattaggactgtttgatttctacttgacacagaagagaaaaaaaaatgatgagtttgattaacaaaatcagttctagaagtgaatttcaattctcaattatatttgacaataaattactcaaccgtagtcatctcagagcttaatttgctgagcctcttgataaccagtatatgaaaagtcacccccatgtttttttttcctgcatgtttttttaccccattttttcccctacaaatttgtaggtcattaacattattcatgaaattatttcctttatatttcttttaacttaattttaccaataacttttagaaacctgtgagtagcgtcatataaatctttgtagttcattaacaagataaataactttcactgcaaataaatatattttgactccaaaagaaataatggtaattaaatgttttattttctaatatacatttttaagtcatagattaatattgacagattttcaaagccattatagttttgaagtttttccccttctacccatatacaactttccaaattaggagatacaacttttagaggaaagcatttcaaacacttaaacatacacatttaaaaaaatttgtaagcttttcagtgtaaacatgcattcaatctatatgtcctacgttttcacagtctttcaaattgcctccagaagtcttaagacctgacttggtaaacaaaaagctcatgagtttgtgccaaatgctttacacgatcattttgcaaaaattgtgagtagagtcattggaaccaaatgcattcttctagtgggtagataggttatttgttatttgtaaaaattaaaagggttagaagaaaatttcagataaagaatgctatatataagtagaaattggtaaaccagaaggctttataatttcagatcattcaatgacaaagtcacacgtaacacctgttacagaagatacactatcaaggtgtcatgtgacatcttaaaaaactggtgaagtgtgtggttgtctcaaacatgaaaaaattttagcgcataggttttcccatgtcattactagccacaggtaagaattcttgtatattaaaaatattaccactgtgatttcaaaagtgaggccaagtactcttattggaatgtgtgacaatttactgtcttgtctgcactgtaggtaaactgtgttaacagagacaatacttaaccatggattttgttatatttcaaacatggtgtagacagctttatatttcacaagctacttctttgtcttttctgtacatttgtttatttggtataattctttcattgaaataataaatcctaattgataatgacaacattcagagaattctacagaattctacagatgtcttggaaagggctgtcttttatttatttcactcttatttatatgagtgtttgtttgatgtgatatatttttaccaggatgacagatgatgtggttctctatatgaatatgaagatatatatgctgtgccttataaaaatgccagccaaagccctttccacagctgctgtgcattaaaataaaatgttatcctgtgatggtgttacagtcagatattttcttacacctaaacaagagttttcattttgttttctttatgacataatcttaatatattttaactagctagttacagaatgaatcgttgttgtaaaaggtcatatattttcaaaagcaacaatcttttgtggatttcagaataaatatgcctaacattataatttcatggaaagtgactcagtgctatcagtataactcataatcatatggcctgacttatgctaggaaaactatttcccttaacaagactattgaacctgcctattctaccacttacaaaaaaacaaccaaccaaacacacatacacaactgtgtttaaaggtagggcaagggccaattctcagttgggtgcattaggttgtgtgcatgagggcactgaattatattaatttaaaaaatagttcaagttttaattgcagaggagttgtgaatactctgaaataatctgaactttattttgtagggagtaagaatcacagctcctggtctttgttccacccatgtatcattctataattgatttgcaaatatagaatttgcaaccatttgtggacaatggttgtttttatagtagtcccccaaacactctagagtttctggactcattgtgcctagttctcattccccttggccttggacatctacaagacaggctaaaaacacactaaatatatttttaaatagtctaagtaagatgtaatacatttctgaagttggagtgttgtagtggaattgaagccaaagcacttggtaaccaattggatgccagtaggaaatgagaaggtttagggaataaaacaagaatacaaggaagttaacctgccttcccaagactgtaagcaagttgtatgggaagtatgtagaattcagttgagcaatctaatgaaacacacatttggggatttcacgtgtgcccttggaaaaatatgtaagttattgtctataataataagagtgcataattttcgttcacagtcacaatgataccaaataaggggataacatggttttcaatgaagtaacaatttgatggtttgaattataccattaccatattaagaaaggactgttcattcttttctatcagctcataaataactccaggatcaatcaagatgatgacaaaatgtgtattgcatactggtttgcatctttgttaatacatgaatacatgttgctgtctttcaaagttatttttaaactcttagttttgtaaacattcattataatttttccaaagtcaagggaacttcatgaaatctggcctagccttctaattttttagataaaacagaattttattgtatattcaatttggagattaggctctaacctaccctatatttggctctgtttcaggatatttaaatttctttcattgtaatttttgttcctgtatttttaataattctggtatttttcttaaaatgtagaaaacaaatcaagatagccttacccaatttatgcctagtcttaaactttttctttttactattggtaaaaagtgtttttgtttttattttttgacagctagccctggacagtggttcaattttatggtaattcgcgtacattggtgtggcatctttaagtagtatcattcttttttttttttttttgagacagagtcttgctctgtctcccgggctggggctggaatgcagtggtgcgatctcggctcactgcaagctctgcctcctgggttcatgccattctcctgcctcagcctcccaagtagctggaactacaagcgcccgccaccacgcccagctaattttttgtagaagtggggtttcatcgtgttagccaggatggtctcgatctcctgacctggagatctgcctgcctcagcctcccaaagtgctgggattacaggcgtgagccaccacacgcagcctaagtgtgattcttaaaagtattttacctacagagagagaaacaccatcaagtagggcttatcagtaggttgtgtaccaagaaagtttgactctttctgggtctttgtattgaaaatttattataaaaataatttgtcaaaaaattcccactgtgcctggtaatgaatattccctttattaaatattaaatacatgagatgccatttcaaaataatgtgtatgcatgtatgtgtgtatgtgtataaatagtctaagcatgatgaattggctggctatttttaacagtttcaccgccaccacttcctgattgtccctagctggctctttggcactcacacaattcacatactgcttgttaagtacctactgtgggccaaataccgtgtatcatttctagataatcttatttcagctttggattttggtgtttgcatggatactttgtaagctgtcatagccgatagcctttaggtgttttgaaacctacagtcttacaaatgtccacatttctgtactggtagcttctcttttcataaccctatgtttgcctggatcctgcatcaaagaaataaggggagggaattgataattggaggtaataagcctttcagtattctagtgtttgaagttaaggcttattagggctcaagtattcaaggttttctcatctgttttaagcaattggattctattatttgttggccttctctatctttgatgcctgtacttaagaaaaccaaaactgtaactcagagaagagtgtcatgacttaattgatcttgccctgatcttgtgactgtattttgttctgttaagaaaaaaaggcgattcaaatctgcagcatatcaaggttgtgcctgtaatcttcctgatgattcatttttagctcacttttaaaccatataggatgatgtgtttcccacatatttaagtatgtgttgactgtataatgctaaaaaggtagacttgataaactttgttgatggtgaatcatggaaaatgtcaagcaggagggcaaggtcagatgtgcattttaggagttgtatcctgctggcaatgaagatggactggaatgggcagcaaccagtgtccagatatgaggagatcagttataaatcaattgaagaccttaataaaagcaatagactggatttagagaagtaggataggggtgggtttcatagaaatttaggaggtcaagttacccagagttggtgaagataagataccagatgtgacaaacaaaaatgattttctattttggctctggctgacagtatgaaaagctgtactatttacaaagatagagaaataagaagtaactgggttttttgtttggttttggttagaggactctgtatagtgataatgattttatttttcgtgagcactttgaacttcacatatttgggatccaggctttaatactgtcagctggtgaaaatatgggtgtagaagatatttttgtatgaacataaaaatttggaaattgagagtttttaaatattagttgaaaagtggacatacttgaaattccttaggttttaaagttaacactcgtttgtagataactagattgttgccattatactataccatcatttttacttgcatgcttatctccctactagcaggtatacaccttgaggacagaattgtctacctttttttcaggttctctaccacctaacatagtagctggaacatgttcactgggcctgctcagctaggtgtttagtgaatgaataaataagtgaatacgtagtagaccaaacaagaatgtagaatgagaaggaagaaatcctggggaaaatatgatttgagattctagtattatttctgaagagtggtcagacaactttgatgagaaccagaaaagagtagtggggaccactgaaaacaagggaggatagagtcgcacaatcaggagttactgctcagttcatttagctccctcccccgaaaccaagatgaataaattacctatagaaagatctacatacacatgggaagaatgtctggttcatttaggatgaaatttgagattccttatcattgtcaagaatagatgccatcgctggactatattgtcattaaaaccaagttcaggtcgggcgcggtggctcctgcctataatcctagcactttgggaggccgaggcgggcagattacaaggtcaggagatcgagaccatctggctaacacggtgaaaccctgtctctactaaaaacacacacaaaaaaattagccaggcatggtggcaggcgcctgtagtcccagctactcgggaggctgaggcaagagaatggcgtgaacccgggaggcggagcttgcagtgagctgagatcacaccacagtactccagcctgggtgactgaaaacctattccatgttcttcacacatcaagtgataaactggcaacaatgtttaaaaatattgtttctatgtctttagaaattttctgaaggtacagttgttcagggtgaagatttttacagaattcagtaaggatggattataatatgctgaacatttggttgcttttgtaataatagaggtggacagctgagacaaatctagacaaaatcttacactgactgttttgtaacgacatacgaatgaccctgaactttttaagtaacttaagaaataggccgggcacggtgcctcacacctgtaatcccagcactttgggaggccaaggcgggtagatcacaaggtcaggagttcgagaccagcctggccaacgtggtgaaaccccatctctactaaaattacaaaaattggccgggcgtggtgctgcgtgcctataatcccagctacttgggaggctgaggcaggaggattgcttaaacctgggaggcaaaggttccagtgagttgagatcatgccactgcacaacagcctaggtgatagagcgagatcgcgtcttggaaaaaaggaaagaaaagaaaagttagctgaccactcttcagaaataatactagaaaagaaaagaaaagaaaagaaaagaaaagaaagaaagaaagaaagaaagaaagaaagaaagaaagaaagaaatttagcacttttccagatgtcatcatgccttaacctagtactacaaatcaattcacattgtatcctagctccccatattcctttagttgtactgtctaattagatatattgcttagacacagcaaacaaatccagtaattcctcttaatctctgtttattaattttttaaacctacaagaacactaaagcagcatttcttctgcaccaaggaaatagaatggaaacacattagacagaccaattccattactagagacatctgcgagtttcaggagtcaatccctagcttgtggttctgattagggctctaatgttcttgttgatttaaactgtttttcttgttgtttagaggtaaaatctgatctgtaaaagatcccaatttgaaaatctttattagctttttaaaaagaagattttgtcttcaccagctacagcaagggccctctcgatggtaggatgttcatgagaaagagaaaggaaggaaagaggagcccagtaaagacacacaagaaggatattggccactggcagtattatttttatgtagcattatgaaaacaacgaaaaattgttttattttctaaagaagcacaatattttgattcatccataatgtgcatatatcattaatgtaacacattacactttctgggaatttttgctcaagaatcataaaatactttataagcagacaagaataattttaacaagcagtttaggaaataaccaagacgtctatgccctctgaacctacataatcattgttggaaagtagctcttcatctgctctttagtatactcttttaataaataaaaatggagataatagttataagttctgcttgagacataaaaatattgttaaatgccaaaaatagtatctgatttctgagaaattttgtatttttttatttaaaagtacttcattttccaaaagatttaataagcagattaaaaggatcaatgaacctttccattttaggaagtctattctgaagtctaccatacctcccaggaggtagctgccctgtgatagaaacaggttacattattacaacttcagttaacaacccggattaactcacttctgtctggggttatatttgttttcttttaatgacaaaagtgtatttataacacatcatgtttccatcaaccagggcatttcttcaaagaaatatgcaggatgaagttcctttagtgttttcaggcaaagtttgtttttctttactttgtgtgacactaactttttctttcaaatacattaaattttgtagctacaggattcaaatatatatgcatggcttctactacattacatcgtttttctggcttattagtttccatataagtaaattttacaaattctgaagttactctccaagattaaaactgaaaatgacaacaacaaacttgtgtgtttttgttggaaatattcctatagttgaagccactgaatcaactatatatatatatatatatatatatatatatatatagagagagagagagagagagagagagagagagagagagagagacaggctctcactttgttgcccaggctggagtgcagtggcatgatctcagctcactgcagcatagactttagaggctcaggcgatgctcccacctcagcctcccagtagctggaactacaggtgcacaccactttgcccggctaattttttgtgttttttgtagagatgggggttttgtcatgtttgcccagctggtctcaaactcctgggctcaagtgatccaccagcttggcctcccaaagtgctgggatgacaggcgtgagccaccacacccagcctataatttcttttgtaactttattggtatggtaaggcagtagtgcccattgttctgcctatattacacctgtccattgtttttcgagttcttttgttggcctcttacagttttctaatcttcctcgtcatttgactaatatttctccattcctgatgttgttaaatgaccttacctactcctctcctttttggatgcctctaatctgctgaggacttcaaaaccagaaattttaatatcacaagaatgcacctgattggtatatgcccacaatcaaaacccaggcatatgaacaatgccctttacaaaggcttattgatgtaacataattttaatctctgctatttttgtgtcatatataatgtcaaaaattgggcaagtagagggtctgccctttgaaactgagcagcatgaatcagaaaagctactcagatcacaaggatgttccctaaacaaaactggtagaattatccctttccactttcaatcatgtctctatttttcttttgtgtaatttcctgtttttcagaagaattagaacttgagcacctggagcccatttctggacttgatataagccccaaatatgataagggagtggaggaaatagatgtttcccaaggctggggtcccaaacccccaagccatggacccgtaccagtctgtggcctgttaggaactgggccacacagcaggtgagaggctgttgagggagcatgatggcccgagctccgcctcctatcagatcagcaactgccttagattcgcataggagagtaaaccctattgtgaacttcgcatgaaaaggatctaggttgcacgctccttattagaatctaactaatgcctgatgatctgaggaggaacagtttcatccccaaaccatacccctcatctgtggaaaaattgtcttccacaaaacctgtccctggtgccaaacagagtggggaccgctgtcctaaggcacatatgagaactgtgtaaaggtactgtgttcactcagaggaatagtcccatgagcaaagtgaacatatttgattcccatattttttaaccttcattttctggtattagtttttcctcttactttggacatatgaaaacattacttgaaataaaaggtacatttgagttttaaatttggtaatttttagcatcataactttaagctgcaaaacttggggtaggatgtgtgtataagagtaaaaatagttttaaatatacacataaatgtatattaaaactttttctaaaatggagatacaaatgtagaaaactgctaactgttgtaataaatattaatcaggacttcacggtatagactactagttattttgaaaaagtcagaattcagtgagttttttgttgttgtggttgtgaaattggcattatcctttcttcataacatttagaaattcacactaccttacatttttcataagaattgaaataaccagtaaattagtttaatttactaatttttttctcccctggcactttataataaatgatagcctttatgtttcagaatgaaaaaacaaagtacttgcatcttttttaaatagacaaactcgttataggatattcatcacatatgccttctttctgcctagaatgatttatttttctgtctttttatattgatatagttaaacagttacctgtttgcaaaggaaaccttatccagatgtaggctcttcttttctgtatttaacaattgattgttacagttaaagagtacattgcttatttccataacacaatggtctttattttgaaagacaacccattggttgaaaagagcttagactttggagaccaaagagatgggttcaaattgtgtttctgccaattagtaccgggttctattgatagtttcttaggctttgtaaattataattttgttttcaacctgggataaataacacctattattgcataattattttaaggattggatgtaatggatttttagaaacagcacaggatttgacatgttgtagttagttgctcaactaagtgtagctacacgtttattttttgagccatgagaagcagagggggaattgagggggttctagtggtagaacgaggactcaaatcattcgctttaatataaagtgacaattggaaatgatcatccaggaagaagactaagggactccagatacaccctttttgaagatgtctaataattcaagcatcaccctgctcaattgaactaaaaatttggattgtgtagaatttcatttgaacagtagaattttgtttgaacagtatgataagctcattaaaatctatcacttgtgtgtaacctgatcctctggttaattccatgtgttttcctatggccttttagttctgcaaaagactgggcttgtaaagactttgatttcatttttttttttaacagatgatagcaaaagatatttagtacctagaaaggtaaactaatcctattttcatgtgcagtcaccctctagtgtaaataagtagttttcagtcttcaaatggaaaacattccaatgtcaaattctttaggaataggaataggaaaaaggattctgatgcagtgagtggctaatttatatatgatataaatttatatataatttaaatatatatatatatatttttttcctcctttctgccataatttggcttctccttttctgacataagatctatcagactatagtacaggtttcagcacagaagtaaataacagcatgtttccttgggagcaattgaacaacagaatgaaacagtgcttactgttttttgaaagttgtgtcagattgtcatggtaatacagagttgcatcatgttgtcatagtaaccagaattataaaacgaatttaaagaggatgaagagataccttgtgattcctttagctttaaagattttgttctaccgctacttctgtttattttgcttcctttttgcaaaatgtgtcacactgctatttttttaaaagtagccatggtacatcctctgcatggctagagggaatgatggaaatctttacttcttcccaaatgaagagttgaagcatcaaagtttaagtcatcccattctctttgagccaggtaaaattcagggtcaggagcacatcagatacactgctgtgtcaaaacatgccaactctgagcagggaggaagttccactccgagtgggatgaaaaggtatttcacctttcttaatgatgattcatagcttttctttcaagcgaaaaacatcctaatcttactttgaaggaaaagcagtattaagctttgggagccgattcatcgaactgtatcagaattggggtaatattgttttttctctttaattagaatgatttaggtcattataattcatcaagaggttaaaatgtgacccttgaggtgaaaaactaatttcaaggctaaaccatttctattattccatgagagagaaagagagaaaaaaataggcttacaagtaagttgagactttcgttgctggagcgcatccaataactaattctacaaataataatgactgaagaaaaataaatttgtcaactttgaagtcttgctaaaatcaattgttttaaatattctttctcttagctcctaccctcttggcgtaagcaatttgctttcgttctttttgttgctacattgcctcctctcgacttgctttttaacaaacgctttaagagccatgcaagttgcagcaagtttcaggcattaatagtggccaggtagtataatactatttttaatgaatgcctgttttctattctttactgtgctttctttggaaagaggcccacgaaacaaagtattaagaaaacacaccgctgccctggaatgtgtgtattagctgcagattatttcctattagcagattagctgcaaggctattggctcagaaaggtctttgagagtattttgttttgtaactgattcaagccatgggagaaaattgccaccatgattggaaagaagaattagctactgttgccatggacactggagttcacagtcccattgttaaatctagggcttcagaatgagatgtcccagcaggagttcaagttttgttaatgaaatgatcgaatatatttttttcagagttgtgacagaaccttgtgaaagatatgtggaatatattttttatggaatttagagtttcctttataaatcagtgttttctttccagtaaaataaaataattccatgctatagccctctatgaaaactaatgtacgcatctatttaaatatttaattacctccctattacatttacatttatagcatatcttttaaaattatatgtagattacataaaaactaacataaaattgcaaatctttaagtcaaattattataatatccatgccagtatggtttctaacaatataaattgatgatagtaatgcatgttggatgtaccttttaaaaaatgctttataggcggggcgtggtggctcacgtctgtaatcctagcactttgggaggctgaggcgggtggatcacttgaggtcaggagttcgggaccagcctgaccaacatggagaaacaccatctctactaaaaatacaaaattagctgggcgtcatggcgcacatgtgtaatcctagccacttgggaggctgaggcaggagaaacacttgaatccgggaggcagaagtcgcagtgagccaagatcattgcacctcagcctgggcaacaggagccaaactgtgtctcaaataaataaatgcttcatagaatagaaacaggatagaatagtatattaatgctagcaatatgttttaaaggctatatgccatgtgacatacagtagattctagtctttaaaactggaaataattcatggaagttaaaagctagtggcttattatggtgataggctaaaaacctgtaagttcaaagatggatcacaaaatgttttcactagcagactcttgctaatagtccagggggtggatattcaggtgcaggctagaagccaggcctaatgcgcttcaagaagaacttacagacttgaccagtcttttaaaaaagtatcttacccctcctattaatcaaaaatccctttgtctgggccaggcaaggtggctcacacctgtaatcccagcactttgggagaccaaggtgaacagatcacttgaggtcaagtgttcaaaaccagcctggccaagatggtgaaaccccatctctacaataaaatacaaaaattagctgggtgtggtggcacactactgtagtctcagctactcgggaggctgaggcatgaaaattgcttggacctgggaggtggtggttgcagtgagccgagatcttgccactgcactccagcctgggtgacagagtgagactctgtctcaaacagaaacaaaaaacactttgtctcattatcctactaacaatactgttttgttcacttacttttcagagaaacgtagagtccattcatacttttgccactaactgatcatgtgactttgggtcatttaattatctgtccctcagtttcctcatctataaactagaatgacaatagcacccaccccatagagttatttttgtcgattgaattaaacccatacacacacacacgaacacgcacgcacacacacacacacacacacacagtgcttggcacccaataaataacaattgacaattgttgtattcagtaacttttggtggctccctatttctgacaaaatgtttagatattctaacactggaaccctgtctgttcctgcaaaattatctgcctctctaattaactcctgaaaacatatctagttgttgcctggacacacgccaaacacatttcctgaacattcttacctctgagtccttgtttagcaaagcttccaaccaagagcactgtcacccctctgattctgcctaaggtcagtattttctaagacccatactctttgaagtatttcctgactaaccaaacgtcacccctctggattttttgtttctcatctcaatagaatttttttcttttcaaaattttaaacatgtattagaagccaagtgagagttagtttgaaattaaaagacccttaacctttcataatcatcaagtcctcctgggtatatttcatttatgaaaatgttattacaaaaagaaaagccatatccctaggatatttgctttccacaaatttcatttatcataaaaatttatattaactcgtttgtatttggattcattcaaatacagattgaatgaatctgaacctgtcattggtttggttaacttattatctagatacttatcattgtgtaatgattccagtggccttgttgctaacaggttctcagcaacaggcggttgagggtgggcagcagtatcaggcttgcttgcttgcttgctttctctctctctctttctttctttcattcttcctttctttctttcttctttctttcttcctttctttctttcctttctttcctttcttttctaccaggtctcgctcatggctcactgcatcctggaaatcctgggcttaagtaatctcaaacaatcctccctcttctcttcgacctcctgagtagtggggactacaggcatacgccagcacactccactaagtttaccatgattccttctggtagcactgatgggaagactctcaggtttaagccaaagctaaaaagacaaaaaagcaagccaattacacttcaggatggaatgggtaatgatctaatgcgctaacaccctgtacatattgccacttctctttccattggaatatcttggaatttaaatcccatgtaaataaatgcaaaaactcccttatttggagttttatctggcaacatcagctacctgtgatattctgaaagaggaaaagacaaagacaaaggtctcctcaaacgtaatagtgaataacaaagctacaaaagagggaaattggaatcgtctttaacaaagtctaattattacaaggtaaagggtttagatgtctcctttgtttgtctcccagttagcacctcagaaggggagtagagaattgttaccataaactgacatcctgagtacaaaattgaagaattttctgaaaaatcacaattcagaatatatgtccctcccagtattttgttgttgatgttgtttggtccttcatcccgtgtgtttcgataattgtagaaatagaatattataaatgcagagaatcttttgagttgtgtattcaaagagctgtcatctctcctggatttaatctgaataaaggagtgatcgctttcaaatttataaaataataaaccagcctccaaaattctgggaaaacatttttctagtccttgatattaacttaaaggtaagattcttaagaagataatcactgtttcaaatttcaagagatgaattctgtggtctaagacaatcgaattctttgggctgatacacctgtgaatgttagcaataacaataacagacaaaaggaatgacagcagaaaggtagacgattactgagacacaatataaaagatcgaaatgtattggttattgtactaagtttatagctgcttctagtgtaattatgaatttataatatagaattccaaattattagaacattattcattagccctattaagaaaaagttatttttgcaagcatgcaaaattacatgtattacatgcatatgtgtgtatatagtagattgtgtatggattgtaaggtgtggattataattttcaaagaactttaatacatataatggcataattaactatatatctttatccccttataataaaggtattttaaaatatcctcacattaaagaaaaattggaatgcaaagagttatttcacggttttactttcttgcttactaccatttctggattttatgagaattcagacatttaagaattccttgtaaaacttggtcttgccctagtaaaacttccttgtcttggtaagataaaaagtttgtttgacagaacccttgtgtgtgccttgcactgatatctattataaaaatacaattgtaaaacaaaatggaataaaatgtagagataaccatcagccagataccacaaacattatttcatttgtgttttcttctactcttacatttagctaaaaaagagacattgaggatcagtaacttttaatggaaacaaacaacacaatacatttttatgtatggcataaaaattggcatgttaaaagtattaagtttaagatggattgagaaacccatatttgaatattgcaattttaccgtttaaaaatggtaagatattatttacctgttctttaaatatctttataaaaatgatttgaatgtctttcagaaagccttaattttaaaggagctcttttaaaaagccaaattcatgctaatagggaccaataaagtatatttctaataatatttaccatgctctacaaaatgtcatgtgtgcatttttttcatcctgccaaaagccactctttgctttgaaattcaaacataatgtggcctcagagcattataattcatgatcttttgatacaaataaatgaaaacaaaatgtacactctttaattaatgtttaaaaatccaactctttattagtaaaccaagaaatatgtgattgctgaaccaaattctgccagacaatggtatgctataaaatttttaactgggaaagatttcatactgcacgaaaaattctgtggtttttttctgcaaagcagagtaaaaaaagaaaacagtaacaacactatttttccttaaaagcttgttgttttttaagattgggattcagtcccagtctttgttttggtttggtataatgggagtaactggacaatgtggctacacaaaaatgaaataagacaatatgttcccatatgcagtgataaagcaagctgacattttattggtgtctcatatagtgtatgtttctaagtgaaagtgtatataccatgtaattcacttgagatcaggtatgtattccattttgcataagaatgggggcaggatgtggaggatgagaaggccaaattaagtcatatagattatttttcagtagacaaaaaggtgttattataatggagtgggagtttaaaagtcataagagctatactacttattagacaaaatttttttaaaatagaagtaactgcagcctgctaaaatgttacatactttttatgagaacgttttgaaagtattgaactatattaatacataacctcatttataatgtcactgtttatatgagctgattattttaactctaaattatccaagtgtctattttatccttatatatctgttttctgccttttagtatgaattctccaatattatcttgagtgagaagggaaaatgtggtctctaaaagattctagagaagctctttgaaaaatgtctggtttgttttttttgttttttggtttttgtttttgacggaatctcactctgttgcgaggctggagtgcagtggtgcgatctcagctcactgcaacctccacctcctggattcaagtaattctcctgcctcagccttttgagtagctgggactacaggcgtacatcaccacgcccagctaattttttggggggtttcaccatgttggccaggatggtctcgatctcttgacctcatgatccacccgctttggcctcccaaagggctgggattacaggcgtgagccacctcacctggccggtagtcttatttatatcacacaggcataccttggagataactgtgggcttggttccacaccactgcaataaaatgagtatcaaaagaaaacaaatcccatgaatattttggcttctcagtgcatataaaagttatgtttacattatactgtagtgtactaagtatacaatagcattatgtcttaagaaagagtgtgcatatcttaatttaaaaataccttattgctaaaaatgtttaatgattatctaagcctctaaggagtcatagtcatttgtctggtggaggattttgccttgatgttgatggctgctgactgatcagggtggtgtctgctgaaggtgagggtggctgtggcagtttcttgaaataagacaacagtgaagtctgatgcatcaattgactcttcttttcgtgaaagatttcctgtagtatgcaatgctattcaataacattttacccacagtagaacttcattcaaaattggagtcaaccctctcaaaccctacctcttctttgtcaactacgttgatgtaatattcttaatcctttgttcatttcaacaacattcacagcatatttactaggactagatttcttcttagaaaccactttttttgctcatccataagaagcaactccttattggttcaaatgttatcatgagattacagcaatcagttacatcttcaggctcaacttgtaattctagttatcttgctatttccaccaaatctatagttacttactccacgtgaagtcttaaaatcctcaaagtcattcttgaggattggaatcaacttcttacaaactcctgttagtgttaatattttaacctcctcccacgaattacgaatgttcttaatgccatctagagtggtgaatccttttttgaaggttttcaattgactttgcccagatccatcagagcagtcactatctatggccgcttcagccttataaaatgtatttcttgaataataagacttgaaaagtcctaattactcctggggtccacaggctgcaggataaatactgtctttgcaggaatgaaaaaaaacactgatctctttgtacatatccatcagagctctggggtaaccaggtgcattgtcaatgagcagtgatcttttgaaaggaatcttttttttttttctgagaagtaggtctcaacaatgggcttcaaatattcagtaaaccatgctgtaacagatgtgctgtcatccaggctttgctgtcccattacagaaaacaggcagagtacatttagcataaatcttaagggctccaggtattttagaatgataaatgagcactggcttgaatttcaagtcagcagctgtattagcccttaaaaagagactcagcctgtcctttgaagctttgagtccaggcattgaattttcttctctagctatgatagccctagatggcaccttttaccagtagaaaactgtcttatctccattgaaaatctattgtttattgcagctatcttcatcaatcacctttcctacagcttcgggataacttggagtttctccttcagcacttgcttcttaaccttatacttttatatggagatggcttctttccttcaacctcatgaaccaacctctgctagattaagatttttcttctgcagcttcctcacctctctcagacttcatggaattgaagagaattagggccttgctttgggttagactttggcttaagggaatattgtggctggtttgaacttcaatcccgaccattaaaactttcttcatattagcaatgaggtaattttgctattttatcatttgtatattcacgtgactagcacttttaatttcttgcaagaactttgcctttgcattcacaattcactgttgagctcaagaggcctagctttcggcctgtctcagtttttggtgtgctttcctcactaagcttaatcatttctgttttttcctttaaagtgagacagctcttcctttcacttgaacacttaaaggctactgtagggatattagttggcctaagttcaatattgtcatatctcagggattagggagacccttggagagggagagagatgagggaatggctggtcagtggagcagtcagaacacacgcagcacttattaagtacgctaccttatgagtgtggttcgtagcacactgaaacaattacaatagtaacatcaaagatcacagatcacacatcaccataaaagatactatagtaataatgaaaaagttcggaatattgtgagaattaccaaaatgtgacactgtgacatgaagtgagcacgtgctgttgggaaaatggctcctttagacttgcaggatgcagggttgccacaaactgacattttgttaaaaatgcagtatttgtgaagcacaataaagcaaagcctaataagacaaagtatgcctgtcactatgtaatgaaggagcataattttatggagttttccttcaaatgtgacatgactaatttcttctttttatttccactgctcatcagaagcctcttttcttctctcctgatttattgcctactacctggtcttcctgttctctgaatttcctctctcctgaccatcctgcagttcctgctaagatcagcttcccaaattatatcatctctttgttcaaaatcatctgatgactcagattgtaacttgggttttcaaagaaccgtttcctatatctgtgccttttcgcctcagcttctcagtaaactggcatagatcgtggtgaagttttttttttaacattccctcacggagtgactatatatagtattgatgatatatataggcaacatatatagtaactacattgtttggatatggtatgactcagcaagcatggggtacactgtaaaactaaagaggcgtatgttctattgctgtgtgtaacaaattactacaaatgtagcagcttaaaatactgcaaattaattatctcacagttttttgtagggcaggagactgggcacagcatgactggatgttctgttcagggtctcactacgctgaaattgagatgtcagctgggccgtggttctcatctgggctcagagtacttttccaagctctctggttgttgggagaattcatttccttgcatccatagaactgaggtccccattttccttgtagctgttggccggagaccactgtcaagcccctatgggcagttcccatgtggccctcatagatgtgtgctttctttcaggccaggtgatgcacgtctctctgacttcctcttctgagaccagccaaacaaaactcagggcttgtgtgtgtatatcaagcccaattggataacctcctgttgtaaggtcaactatttgggacctaaatttcatctgtcaaagcccttcagaacaggtcctagatcagtgttattgaataactgagagaaagtgtatgtacaggaggacccaggaatcttggaggtcatcttacagttctgcctactacaaggagctgcagtatccataactgcaaaaagaaatgtagttttagagctaatgcctcaggacaactgattctccaagactggtggtggaagaacattgtgttcttcattcaagaactacttctggaaaatttcctgaagtgcatcaagcactattgtagcagtttttaaatgttcagtcaatgagataaaattggaaaattagtatggcatcttacccctactgtcagattttgaaaatagcattgtaggacatcacattaattggtgtgatttccaggaaaaaagtcatttttgaagctcttttagatgaagctgaccttctcagaaagaatacttttataataacattgctaaacagataacaaaccctaaatatcaaagcaagaaactaaagaagtgaaaggaagcaggacaaaggacaactgactttgtgtccttatttgcctcttgaaggatgtgttagagaagtcttcagcatctaagtactatagctattacttctatcatggggacatgatatttgacttgcctctctcagataaaatttggaaatatgaaatattaaagatttaaacttttttgaatctttaatattagattctgaaattgaatatatattagtcatattatgatattgtgtttacctgtattttgtctaacagatttttttttaagctttagctaatgaagacacatggcattgttaacagtggtaaagatgggaggaatgtttagattttctagtttggatgtagtatgccttgttttgagatacattgatgttggtttattttaatggcaaaagtgctttcattattctaaactatttgatttatcatgacctcatcccattctgtaacaagaagaagattgttatatttttctccagaattaacattacaatgattaataagagaaatcatatattttacaaagccactatgagtcaaatacacatttttctgtgaaagcatttttggagctgggaaatatcctctcctgttctctgtagtatcctgtctggagaaaatccagtttgtatcttttatatgcttttcaaaaattactcatctttagaggctactgggagctgattgtggtgtaatttctttgctgtgttcaattctgcggatcaaatttgcaatctgatatgcatacatacctctagctggcttagaatagatggagatagcaccttttcatacatgcctgcagtgtcagtgtctatccacaaatgtttgggaattagaccagaatgttaatattgaccttgccacttccttgctgtgagcttgggcaagttacttaaccacttggagcttaaatctcatctgtaaaatggagatgattatttatcataggatgatacttacaattaatttttttttttttttttttgagacaaggtctcactctgtcacccaggctggagtgcagtagcatgattacagctcactgaagccttgacctccaggctcaggtgatcctcccacatcagcctcccaagttagctgagaacacaggtgcatgccaccatgcctggttaatttttgtatttttttatagagatggggtctcaccatgttgcccaggccggtcttacactcctggactcaagcgatccacctgcccaacctcccaaagtgctgggattataagcatgagacaccgtgctcagcctagaattaaattaaaaaggcataagcaaagaatctaaggtgatgcctagaacattctaatcaccaataagtatagttttttacttcctctctcactttatccattcagcagaaagtgactgagtgtttattctgtgctagtatctgttcagttaggttctggaaacatgaggataaataaggtatgatgtctgctcctcaaaaggacaagacctacttatatggaatgacaatgtttatgcatttacagttcaaggcagttaaataaaactcatatgtaaaaggcaaattgctactgcttattactaaagatagtaagttatacaaccagttatattgatcacatggaaataattacattaattttctttgtgggttttcccatggctttctgtgcattttggtttcagttaaggtggggttcttttatctaaaatgcccacaggatatggatcctcattattgaggttgtattcttgtttcttttgttgctgtaaccatgttgatggtcaactgaagctattttcatacactctctagatttgatctttgatgaaaagaaccaaaaagaaatcaaagagttaccttgccttagggacttccttcttctattaaattgatgtatcccaactttgttggggtttaaggaacactaaaaggcctatgtttattcagttaaacttgaaagtattgggacagaatgtgctctcctagtattgtgatgtttgccagagaagatgtagtcattgttaatgattgtaatgaattgtttattttttactttaagtattttagatattcgtagtaattgaaataaggaaaactactttgtaatgtaaaaaaaaattaatttacttacttataactgtaagactttgtacagccaaaattgacctatatgtttagttaggattcagtgaaatccatttgcatatgtaggttaaatttcaccttatacatcaccaaactgcagcaagctaggactttaaacaactaaacatacacatattaattcttatttgaaatgatttgtttttgccctcattgaatgaatggttagttgctattaaaagatattattcaaagagcaaagctaatgacctgattttaaagaatggttcaccaaaatagatcaacttgcagtcctgactgagtccccagtttatactcaatctgggatcacttcccccaacatccacgttatctcaaggattcttttcctcctctgtacttccttagcattttgcaagggacaggtggaagccatgtcctattctgccctgtattctgttcatttgtaccattatactgtcttcctaaacttaccgaaattttccaagaactgttttccttcactacattcttcactgtgcctttgcattaccttatctcacagggtactcagtagaaatcttcataatcgaaggctgaagccaaaagtttggtatttgagttataccaagatattttagaaaaactcagaggggggaaaaacagatgactgtctcagcagatatacttatccaggtttccactgtgttcctgaaagcagttctaaacatagtcaatctctgtttctcaaatagttatcctctttatttgagatgagcagacaggagcttcttcaaacactgaaagtagttgctcagatttcagaatgaatagaattctcataatagtttttatgccctagttttttgatgatctggtacagttagatgaggctctctagtgtttgaatcatgaaacaatatcacttcacttccatcatattctaagcccttgtgatagttaaggacaagtaaaaaatataattactctgtatgggttttgttgcagaagagtgggggggggttgatttttatagtaaagtgagggatctataagccaagttataacctctgtttgttagcactacaaaagttttgagacagtttgaaatttaaactcaatgcatttgatgaatagtacttggctagtttgcgtttgcttcttaatttcattaatttttggtggcaaccagcctttacaacagctatttataaacctgaaatatctgatctgtaaacgggcaaacaagtcaaatctgtgtatatcttatttgccaaaccgttacatttttctgcatatttcatcacttttacttgaaaatgggcttgtagaaagataaacagcatatttacaggaaagaaaaggcaaataacaaattctaaaatataaatgcaacctaatactttctctctataatggtaaaaagaagggcatttaatattttctcctaaagtatatttaaatattttctagtcaacctactttctaaccaatgctaataattctgtcgacttattttaatggctgacatgcacgtaaatttagtgttcatattgaatcaaatcattagcatgaaaaattacacaacagcaagtcctgttaactaattatgctagattggcacttcagaagaggttcatcaattcaagtattatcatttgtagaaagaaaccttttaaaagaagctttctattttaaaacttgttaatgaaagggcttaaaaatagagatatatgtatgccgaaaaatggccctgaatataatatatgcattctttgcatgcatgcatttttcgagaggttacacattaagagatttgatatagccttccagatatatttctgacctatggtagcttaaaatgaggacaataaaaatcaatctttacccagataaaaattccacatacctaagaaggcatcaggtttctcatgccttattaacatttattcttctgtgcataaattagtccatttcatagcataaattacaactgacattatctcctgtaaactctataataaaagagtacagaaactctgccagccagccattttaatgttgatttctttacttatatttaaacttctaaataataataactaccattactgggtgcttcatttatgttggacactctgctaggtgttttgtatggtatttcatttcatctccctgttgaaagctatagattaggcagagaagctcagagaggtaaagtgaatttctgagaacacaaacttctaaatggaattgggatttgtgcttaattttaatctgtctgactttcacagtcatcttcagtatgaacagaagaaaatccctgaacacctttgaaatttaaagcaaattaaagcaaatactatgccattagagtatatacatatgaatatgattcactccctgtgaactctgctgtattctcccacctctaatgtgcctcgcctctgcttcattgggaagtaaaaaaccattttactacctgggaattgtgaagctatctggtcctttttaaaaatataacactcttctgaggactttctgatgctgtgatcaaatgatgtggagagaatcttctaagaaatatatttgaggtttacgtcatgttgtcattgatcattctggctttatttattaaaagcaaaaccttttacacattattgctttctgtttaagaactttcctttgctacttatttattctgttgatgtattattaatgtcctagctgtctgttaaatatagactgttatgttattaatgctgttaaatatagacatattcgtatgaaaaggggaatatttagatacaaaattttataaaatacccaaatgccttaagaaattatcagacaaatctttgttttgttttgttttgctttgttttgtttggtgggtgagggacttgttttttcccactgatcagccccattcttgggattaagttatagggaaaataagttttgtttcattttattttattttttcactgtgcaaaccactatatattgcttgtatctatcagcttctggtcagatacattttgtctatggaaactttccaactcaaagtaatctttaactcacttaataatttttcacttgaattgtagttaatgtctttcctgttgttgcctcctgtaccagactacaagttacgtaagagcatgataaatgtttaattcaatcatagttttgacgaagtgttcaattaatatttgtttaactgacaattgttattttaataacaaatttattgactgtgtaaagtgttgtacttattgtttaatgattttttaaggtaactggaaaacataaaggcatgccaggaaattatgcctgatttattatttttccccccaaaatactcgtggcttgtgcatagtatatgttcaaaactgtttattaagttagctgaataatatgtaaatacatatatacatatatatacatatatacacatatatacatgtatacatttatatacatatatacacatatatacatatatacatttatatacatatatacacatacatatatacacatctacacatatatacacatatatacatatatacatttatatacatatatacatatatatatactttttttttttgagatcaagtctcactctcgcccaagctggagtgcagtggcgtgatctcggctcactgcaggcttctcctcccaggttcaagcaattcttctgcttcagccacccaagtagctgggattacaggcacctgccaccacacctggctaatttttgtatttttaggacagatggggtttcaccatgttggccgggctggtctcaaactcctgacctcaagtgatccacctgcctcgacctcccaaagtgctgggattacaggcatgagccactgtgcccggccttgaataatatttttaaagtagaattttctaacgtatcctttgtgctcatgttgaaaatttaactgctccacccacaagcaagcatggggaaatcaaacaatgttaaaaggctagtaatacttataggttttatgattcaatttactatgtgtttaaaattgttttttgaaaaaattgagttatgtcactaaaactgagtcaatacagctcaaaaatgaagaaatacgtatctccgataagcatattatgtgaatttcaacatcactattgagaaaaggaatataaatttgaatgaaaatgaaactctatctttctatatcacattgcataggtgtaggctagtgagtactttgatgtaaattgctgtatcttttgaggcatctatttggcaatatagatcagaattttaaatcagcatactttgtttgccagaaatctatcaggaccacttgtagtaattttgttaaaaggaatatcaaacacttggatgttcatcacagtattgattgtattagaggaaggaaagggagaaagggaggagaatggaagagagaaagggagggaggaagattggaagcaattgagatatgtgatagcatgggatttgctgaacacactataatataccatggcatggaaaagcatgcacacttaaaaaaggacaatgtggatggatctagctattgacatgagatgaaattaaatgaaaaaaaaaaagaatgtagattgaagaaacagtctgtattttaagatcctgttgtctttttgagtgtttcctatgtgatgtagccaactaaggatacagagatgaacacaagagcctttgtactaatggaacttactactatggagctgatagaggttattttacacctcaaagacatgacctggttctaacattatgagtctaagctggagaaggtttagtgtattgaccatactgaactgtgttggaaattggaaattcacctctgtgctggagtttccaatttgctcttctgttggagtttctaatcagctgtgaagaaatcatgggataatagtttagaaattcctacaagatgctgtggtagaaggtaaagatacaggagcacttctagacacttgagagcctctaccagttgtgaaggaaccctgctagtccagagctaatggtgcatgtatccttaaatattacaataggacattggtactactggcacacctataattgttttatgctgaaaaaatacatttcttatgctcttgtcactttctgtctatgacatatttgtttattataaatgtattattcttccaagtgtcatgttctctcatattatattactttttttctaattccatatctagaagtgataacacacaggtatttctgtgtcacatttctcacttaattcattcaaatgtttcaaatttttttattcccacttttttaaatgataggatgtggatgaagaggatactgtgccaaccaacctcgtgttattaactgtgtttctgtaatgaaggctataaaattgaagtgtaatttatgatatgatttttagataatggctataattattgttgtttttgagaaatgcagacatacgaaggagatagagaataagtaattatatatgagtgttaagtgcattttcagaattggagggcgatattctttattccttgttaagcctttggaaatcaaaagcatggttgtatcagttgtggctctgaatatttttatggttctgtcttttgcttgatcatgttggtccttttgagattcaaacatttataaaaattcataattttgtgcaaatattgaggacctaaaattgcaaagtctatataaaccaagagctgcttgctggttaggcagaaaccaaatttcctcctagctctgccttgcattttcaatcagaattacttgtttgttacaatatgattttcttcaaaaatagatgctctgaggcaaaaggcgagccacaggctatatgttgaatagaaggttgattagttggccgaacttcaggagtgggagcctgaagccatgcttcctagggaaataactccctctctgatagtttgttttgctaattactagtcccaatttgagctcaatattaccaacaattgctttatagttacttatgagtcaggttcaacattttatgctgattttacttgcacttaaacaaatagaaagtatattttctgaacacctctttttggtaaagcatgttgtatatttgataatttacaatttagtttgctgttttcttttgttctttgttgcttactttctgtgcttcaagtttattgaacttcaagtttattgagctagaacttatcacagatggtaaatgtggaaaatgtgatggatgtagaactcctcccacataggagtgaaatgggagactacttttgttttgtaattgatagtatgaagccttacatggactatcttcaatatgcattcattacatgatacattcctggtattaaattgtaatcgtcgagatagcactgctaaacgagatagcactgctaaagtttatgtctgtggtttactatttagtataattattcttagcttaataagctttctgtactattaaatgaaataatggaatctcagattaacatttctttaaaaaaattgtattcagcatattaccatacatttactgagactgaactgctttcttttcaattttcgtgaaacttaaatggcttccgtttttctgtgcagtaaattaaaggtgcttacacagttatgatagtttccaagaagaatttcaaattggcatcaactaattgcagtagcaagtgatccaggttttacaaggaaggaaaatgtgaaagaagcatgtctgagtataattttgttcctgataacaaatatatatatatatataactgtgattcaaaaatatatagtaaaattaccttccatcatccctagaagttattcaccttcattataactttataaccagtacataactagatgtgtgttttatggcaagaaaagtttataaaataatgacttttgctatggcattcttttaaaataacactaatgcattttatgaacctggtttttcacttaatcctctgttttatgcacttagagcttaaaagtcctgcagtaaatattatcatccttagctttccatatttttgttcaggaagaaagaaagttcattctacacttaattttaatgtcttcttgattctgggaacccataatttttttctcttttcttactgatgggagaagcctgcaccatcatggtttgctacttttataacttgtgagcaaacagaatatttatctctagtctcttaagtagagttttaaatccacttgcacagcttttaaaatattcccacctgccctctccaatttgtttttacttctttacattttgtacatttgaaaccgaaatttgccttatattccatgtgtaaataacagaaataatttttttctgaatattttaataagtgtaattcaattctggttagtttgcaacaccattgaacataatattactcacttctgcccacttttaaatacagacactttcactactcttacagaacagtaatctgttctctcatctcactgacagtggaacaagaaaaaaatttaagctacaatatgagagaagtaaagtgcataacccagttctataatagtatcattgctagaaagagcttgcaaagtgctgtgaattttttttctctagaaagttttccatttacccttttattttatccatccatccatccatccatcccagagaattttctcatggtctcagtgaattttttttatagtcctaaacaaagttaaataacaaaacttctgaggttctaacactatgatcttgacaatccaagtgaacaattatcagtaaatataacagaaaactctgccatttacagcacttcacattatcagattattaaaatgatctaaaattattcatttaaatgctagcagggaaataaatgactctaaattccctgcattactcacaaatactacaaaaaggaatgttccctggtttctgtggttagaaaatgtatagagcagagtatttcatctaaacctagagtcttctttttttatttggatttgccacttataacatgaatgattttgaaattcccatagcagaaagcttttcatcattgtctcactaagaaagacttgattctagtgccgaaaactgaagaactccttagggcataaagtcagagaacagcagcttattccagaccactcctctaaatattaatgaaacttacataaatcatacataacatatactatccctttgtgctggaaaatgccatgtttttatggttgtggttgtacagctaggataataggaaccaaagacataaaacagtaattaatatatttcagaagtgaagtgttttattggatagatgctaattaagactgatagatggcagtgattgaaataagcataagccatttggtcaacacaagtgaaagatcagctatcatcttgaatgctttaattaaggatgctttgctttttgtttcttcttccctactcttctgaatatatgaaaaaacatggagaaaaaataataataactgctttttgacagggaaactgatgtgtagtgcatgcctgatatggtttggctgtgtcctcactcaaatctcatctaaaattgcagttcccataatccccaagtctcatgggagggacctggtgggaggtaattgaatcataggagtggttaccctcatgctgctgttctcatgatagtgagtgaattctcatgagatctgatagttttataaggggcatttccctctttgcttggcacttctccttcccgccatcatgcgaagaagaacatgttttcttccccttccaccaggattataagtttcccaaggccttcccagccatgtggaactatgagtcaattaatcccctttcctttataaattgcccagtcttgggcagttctttataacaatatgagaatggactaatacagtaaattggtaccagtagagtggggcactgctgtaaagacaccgaaaaatgtggaagaaactttggaactgggtaacaggcagaggttggaacagtttggaaggctcagaagacaggaagatgtgggaaactttggaacttcctagagacttgttgaatggctttgagtaacatgctgatagtgatatggacaatgaagtccaggcttagctgatctcagatggagatgaggaacttgttgggaattggaataagggtgactcttgctgtgttttagcaaagagactggtggcatttgccccagccctagagatctgtggaactttgaccttgagagagatgatttagggtatctggtggaagaaatttctaagcagcaaagcattcaagaggtgacttgggtgttgttaaaagcattcagttttatgtagtcacaaagacatggtttggaattggcacttatgtttaaaagggaagagagcataaaagttcagaaaatttgcagcctgacaatgcaatacaaaaggaaaaccaattttctgaggggaaattcaagcctcctgcagaaatttgcataagtaacaaggaggcaaattttaattgctgagacaatggggaaaatgtctccagggtatgtcagaggccttcacagcagcccctccatcacaggcccagaggcctaggaagaaaaaatggtttcctgggctggacccagggccttgctgctttgtgcagtctcaagacttgctgacctgtgtttcagctgtggcttaaaggggccaacttagagctcaggctgttgcttcagagggtgcaagccccaagacttggtggcttccacgtggtgttgggcctgaaggttcacagaagtcaagaattgaggtttgggaacattggcctagattacagaggatgtgtggaaatgcatggatgttcaggcacatgttttctgcagtggttgagccctcattgagaacctctgctagggcaatgcagaagggaaatgtgcggtaggagcccccccacaaagagttccccaatgaggctgcctagtggagctgtgagaaaaaggccatcgtcctctagaccccagaatggtagatccactgacagcttgcaccagttgcctagaaaaactgcagacactcagtgccagaccatgaaggcagctgggagcagagctgtaccctgcaaaccacaggggtggagctgcccaaggccatgggagcccacctcttgcatcagcatgacctacttgtgacacatggagtcaaaagagatcatttcagagcattgatatttggctgccctagtggatttcggacttgcatggggcctgtaattttgttttggccaatttcttccattttgaacacgtgtatatacccaatggctacacctccattgtatctaggaagtaactagcttgcttttgattttacaggcttgtaggcagaagggacttgccttgtttcagatgagactttggacttggacttttgggttaatgctggataagacattggggaactgttgggaagtcatgattgtgttttgaaatgtgagggcatgagatttgggaggggtcagggcagaatgatatggtatggctatatccctgcccaaatctcattttgaattatacttcccataatcttcacatgtcctgggagggacccagtgggaggtaattgaatcatgggggcggttaccccaatgctgctgttctcatgatagtaagtgagttctcacaagatatctgatggctttataagcggcttttccctctttgcttgtcacttctccttcctggcatcatgtgaagaaggatatgttcgcttccccttcttccacaattgtaagtttcttgaggcctccccagccctgtgaaactttgagtcaattaaacctctgatctttataaattacccaatctcaggcgcttctgtatagcagcacaagaatggactaatacaataccctacagcctgaggaggaggtagataggtgctgaaaagttggattgacctgattccccatgaaattgcatcacactctgcaaacaaatacattagtgcctttgagggctctagaccctggctcacatcagctccatctttacgtgatatttgcgttaatcacagaagcagaacactatgttgtacagataagtgctacccacagttaaagactctatgcctagaaataaactctgaaaagttagaaactaaatatcaactccatctaaagaaatgcttattgtctctaaaatcatcttaaatgcaatcttaaaggaatgtccccagaatacagagtagtaaaaactaatgtttttttcatgtcttgtggcatagagaatatgaatcattgatatgttagtttctaactttaattttgcagccccctttatccatttggttacatttgtttaccttttgttgttcttaaatattatatactgctacaggtatattttatagaaagattcttccatttctgcggctaagattaaaataccttaaatgattagcctttaataaaactgtattgaccagatgaaacaaaaggacttattttttaaaccaaactaatgtctgattctaatgatacacaagtacttgttattcctgttatatacataacattcacaaataaggcaacaataaggtaagataggcaatgatcttttatgaaattatatgctaatatatataattatgttcttaatatgtaaaaacatgcaccaaatgttttaaataaatggaatacaaggataagcaaacagcatttcatattttcaaattctgatagctatcagatcttgcatagaattattttgattgtgcattgcattatttcttatttcaatgtcttagtcaaagactagaaaggacattaagtataaagcaagtatgattgaagtcctctgattcacagaatgttctaccctgagagtagaaaggctaataattctgctaaaacaataaaaaaggcaaatgcatcaaagagaagtgcttaggaagttcttgaagttagtattccttgtggctagagaagcaaagagtaaaaagacattgtcctttaaaaccctgtccttgttgcccaatcatagagatagtcaagctgtcaaagaccaaagcatatccaaggctggacatggaaatattcatgctgatttcagtaatagccttttatgaaattaattgagagatttacttttccagacactttcaaacaagctggactgtagtcaatgggtagcattgatatggcatagtggttggttttaaaaaaacaaaccaggctgggcacggtggctcacccttgtaatcccagcactttgggaggctaaagtgggcagatcacctgagttcaggagttcaagaccagcctggccaacatggtgaaaccccgtctctactaaaaatacaaaaattagccaggtttggtggcggaagcctgatttagggtatctggtggaagctacttgggagcttccagctacttgggaggctgaggcaggagaatcacttgaacccgggaggtggaagttgcagtgagctgggatcgcgccactgcactcgagcctgggtgacagagccagactccatctcaaaaaaaacaaaaacaaaaaaacctgactgtagcccattgaatgttctttgagaagaagcaattatatgattgtggctcattcattgtggcattatggcaaagccatagctcaaaaaaaaattccttatttacccatttactaaagataacaccaggttctgtcttcttagcaccagttaatgatgttctagttaatttgtaacttgcacagtatctgttcatgctattgctgccaaacatattgcagatcaaggagcctgttatgcaactgtgaataagaatcttaggccacttcacactgtttcatcttgtcaattgggagttttgtttggttcagcatgtgtgtgtgtatgtttttgtttttgtttttgttttgagacagggtcttactctgtctcccagactggaatgcagtgacaagataatggcttactgcagcctcaacctcccaggctcaagcaatcctctggttgagcctacgaagtagctggtaccacaggtgtgtaccaccatgcctggatatttttaaattagttttgtagagacaggggtttatctatgttgcccagactggtctcaaactcctggcctcatatgatctcttgtcctcagttccccaaagtgtggggattacaggagtgagccaccatgcctggccttaaattctgatggcttttaggcaaacaagtaatgtactatgtatatccctttttcaaaatgtattatgagttctgtagcttataattgcttcctgtgtgcatatatgctttgtggaggattggagaaaacatcagtataacaagcagttcacttgtttctcgaaatgctgtgctggtgaattagtcactctgttctactcttcaggttttttgtgtgtgtgtctgccattgaggagtataaaacttttttcaaagtcgtttacatttggctttggcaagggttttaattgttcattggagagtatctgtaacctgaaaattcttgagacacggtaaccacagagttaatatgtgactcacaaaaggctggaaactgcctactttttccatcctgtccctctcatcagttttgcttccactttattctgggagttaatttttatcaaccttcacacagaagtactatttgtttgttcatatatgcaagggaaattatttttattcctaaagcatttctccctcttaaaatcctggattagattaagcaaatatcccgtttatgtaaataaatcatttaattaagcagaataggtaaggatgtcagaaataataaaacagatgatttgtcagaaataaactgtagggcatatgatcctttgaagataattgaaaattcactatttaaaaatatgaattaaaaaatatatagaacttgatgagttacagttacatacattactatgctattcgtatttcggaaattgaaactcagaaacaaaagcagtgctctagtttgtcattccttatcagtgaagtgtggaatagtggaatcttcatggggaatttctgtaggcacgaaaaatctagaaaacaaaggctgtggaggaggctgcctcagtcattctaattgatgtcgtacagcaggactactcttgggtaacatctctgttgtgcccaaggttatggagattttcttgcagtcataggaagaagctcaggttatgatcaacctggggagaaatgattatactccttccttagatagcagagaagtttgaggtgtactagaagtgtggggttatttacacagtgagctaagagtagtgataagaaattttatgttcaggactgctttcttatcctattgaacgtcagtctcatcccccttagtgactttatagcttgctagctatcacattccatgttattccccttatgtctgttaatgtcatttccagtgctatccttctagcctatccctttttaaaaaatgtgtcttattctctgtcctggctcctggacactcatatcgcaatataggaaagcctaataggtagaaattcaaatcacagaaaagttcagaataaatgagctttatttgggtacaaaaggcaaaatagagatactgactttttttttttttttaacaaaaggtcaaattgcttcctttaaagagcatcctccattcacacctcagtaccactgatttctttccaacacagtgttcctggagcatttttaaatcattgagtgggttttgccataaagcttacatttgccacttgccttccacaggccagagctgcttttttaagcaggaaaggaaaaggacactgccacttcatatgacagaatcaagtaacttgtaaattggaatgcattttttttttggttcgcaatttccccaaattttaaataaatcagtgtgctccttccctttacataaatgatttttgtgagaaacaagaagctgttctaagaataacattcaaaatttctttaagaaaattcaaaccttgcttccaaaacaggcctatggtgagatcgtaccaaccattacaggataagattacaaagagaaaattatttttattccattctgaggggatgtctattaaagtagcgcataatttccagagcagttctcttgagattaactttttttttttaatggcaaaatgaagcaatgtaacataatgcaaatcacactaccattacaaaaaggaaattaaagttgggagaatctgtcaaaatattatgaaagttgaggagttaaagtttattgctttatttttagaatttgcaaaggtgttccactgcagaaatgcctctgggcatttgtaaaatgggagggacatgaaaagagcagtccctactcaaatggctgtgtgttaattgagctctttgccccgccccccttctcttttatcctgctccctccttaccctgaaatccctagtatttctagatccacagccagtttgtgtcttaatgggctttgtgatttcagaagtttccttcgacataagctcttcggcatactaattgtttctcatggagaaactatactgtgtttcattccaagcccttcttcactttactgtagagtttgcattaaagtttcagaaatacaatcaagctctctctacatttagggaaaggaaataaagcacttgcctcaattacatttgtcaacaatttccttttctgaatatgctatgacagagtttatgatattatagaattatgtttcccctttaacctttcagtcaaactgttgataccagtttctttaaaaaatatataattagtgctatcatccagttttttgtttgcttcgcctatggcatcagagaggaatgagttaatccatttgaaaaaattgttttaagttaagctgaagtttttttagccaccactttccttctctcccatgttgattactgaagccggattataattgatacattaaatgtaaaatattgaggcgataatatatagaacgtttatggttttagcagttggaggtttctggattgaatttgaatgcacaagcagagtttgagctaccgtgaccttgttactacctgcatttgtacaggaatccttcatgatctagattgacaagcagtgaatctctactttcaagttcaataagcctctcttttattgttttttaaaatacatatttaattttaaattttcctatagataacagagactccaattaattttacaagttattgctgctttctgagattataatagatgtgagctgttataagctaaaatgagccctcatatttaagtggattttgtaaatgagagcccagcatttctgtcatattcagttcttatggataaaatgaaagatcatacttttgcacagaaattaggtctgctctaggataatagtgcagtgattcagttccttctcaagtgttcagacttaataatattacctaggacagtatatgtatcttttcaatggatagaccaatgggtgtatttaagagaattttataggtcaatgaacgtacataagagaatacaacagacttacttattttttatataaatttaaggcctgggaacttcaagtacttaaaattcaaagctctgtccctagtgttttggaatttctctttactacctaaaatgttgcctttgatgtttcctgttggccaaggcagagagtgaaatgtaatataaagctttatatgaaaaattgtaataatatgtttaaggacacatttttgatgctagaactatgtggaattgatttctaaaagcattgggaatttcttcctaaaactcggagtaatgctttttgaaatattaccctgattcaccaacaaaacagcaattataatagaatacattgtaaagatttttaattttccgtttgtgttctcgtgtcctttggtggttaagtatttaaaatcccaactctgaagtgaaattgaaatgttcttaagaaatctgttgttacaaagtctagggtgggagagaataattacacatagctttttgataaacaatctaaattgtgcttcaaaggacagatgtggctttaataatctgaagcatttgcattttcagattaaactttgcttgattgcgttgtacttgatatgtatacttaaatctatatgttaaatgttatactttgatatagcacatcttgtttgactttgttcctatgatctgacaagcttcattatataataacctagtttaaataaatcttaaagacataaaagtgttcctgacagtaagaaaaaatttaaggcacacaaatgatgtatcggttagatgttccagagagagtcgaagttttttcattcaaatctttgaacatgtgttttgaataaagctgtaaggcattttccagtaaccagtgttgtattacaaaaatgagtaaagtaaaacaaaaggaaaacatgtttcaacattttattcagttttgtcacatattgttgcacatttcctactggaagtaaatgtgacatttgtaatgctaagttttcaaacctaaccttttctatgatataaaaaatgacatagaatattgtgcccttgtgagacaagcacaaataatgaactacactctcagacttcagacagtttcctaaatagtttgagtgcaatagtttgatgtaagtccatcattatagtttctgaattttctctactgaattctatccaggaataagcaacgataaacaggtcacagaacacttgatccaatggcctaccattgtataaaatcaaacagggaaataatatcactctagttatactgattgccagggtggacaaagcagttggataaaataatatttcagtgcaatgaaaagcaagaaatttacttaaaagtaggaaaatctgtgctctattactaggctttcactgttttatttattggaaattaattagctgactttgaaatgcaaaaaaaaatcaagacagctatttggtgattttgtttttttataataaacaacagctaagtactaactactaagaggtaagaatgtgaagcactgagcatgtgcaagcaatttcaatatttaaagtgggaattggggagagagatatttcacattaagctataaactactttgtaggaagatggatgtaatttatttcagtgttatattagttattttatattatatattttattaaaatactagctttgaaacaaatctaaaacatgtactttataagctgtggttaacactacatttctactaaggaaaggtgtgccctctgaaataaggaaaactgaaatttcatatgcaagctgggagcattctctttcaaaatattaatttattaaattatttttaaatttaaatttgttttaaaattaaaaattgttgaatacttgagagctgaaatcaatgaaatacttgaaataacctgctcctttagcaaagtagttatttcttcaatgagggtttccatgttgaccggtcatggatggatatttggtttcatacactcactgagtgtggtcagcagctgggcagactcccatgcaccactccatgaggtccccaaatctgacctctcaggttaggtatatttacatgaattctgtcattgttgtgtctaggaatttagacagacagaatttatgaggagagtggcaaaagacattgcattttatttcattctttctctgaggataaaataaatatctcagaaaagggtgaacatttcttttcttcagttttcaaattgcttatactaaatttaatttttatgtacaggctttgtttttaggagagcttatgttcagtacacctaagaggaatcgtagtcacggaataagtttccacctaagctctgtgacgtgattcatgattcattccctaccttgatagatttatgaatacttctaagtgaacctatctcagcagccaaatggaagtgttaatatcatgaatgcatttattcaaacactttttcagctctcacaaagttttgttataaagacgattttatttcctctcacagcaacatacagaaggagcagctgttattgcccttagtttacagatgagaaagttgagacttaaagccattaagaattttgtggtagcaaagaaggatcctgtatttggtaaatttgggtgtaattatgagtttaatgtatgcctttttggcagtatcctttctggcttcatcatgctatatccccattgtccacaacattgactggtgcttagtaaggtgctcaaggacgcatcaaatgaatgaacaaagactagagacagagttgcctggccttattctttaaatacccacactataggactgcaacaaaatacagagccctagtgattagaagacttcaaaagtgtgttttctttttccaggtgcatgcctttgatttcttgagatgatgaaaaaaaaaaaaaaaagagagagagagagagaaaagaaaaacaacaaaaacctctttattttgtaaagttttgtttgtggacctagaattgaataaaagccaacatttgtcctgcactcatgtgtcggatgtcctctaagcatcttacattcatgaatttgcttaatttgcaccattcaatgaggtagataccattgtcatctccattttatacattagaaagctaatatatgggggaggttaactggattgcccagggtcacaaaacagcaagagtggatccaagtaactactgcattagactgcccttcgctacactataaattctcagtctgttggtttaagctatcgtatgaagatgactagtcacaatgatttttctgccccagtaactgatagattgtctgcaaagatctcttcaccatctttcctgggcactggagttgcttgggagctatcttgttccttgagagccagttgttatcacccagggtattgttgagactttgagagtaagatcatatttcctcagaataccttcattatgaatttcattcatttctggccataagccttgctctgttgacacaagaatgatatacgttaaattttggttagtagctacctgttggaaagtagaaagatgaaaggtgttgaagataggtaaacaggaagcttccactcattggttctgggtttggtttgtttgtacttgtgttgtttgttctttttttaaggttggaatttgttagattttactttcgttatattatttttatttgtcttcaaaataattcccaattttaaaaatttaaggaaagtaaaatagaactggatgtataggcaatcaaagacagcctttaatcttagcttgaaacaaaaatagtctgatttttactcctagatgaggtttttagaaattagtttctcaatgtagaactcagaaagaaaacttcataatatgtttcaacttaaaaggcctttagaaaccaactaaattgaagaaatctgaggcacagaaatattaattgacttaagagatgccacaaacatagttagttcaggtgttcattagttcaagaaacctttatggaatgcctaccatggggaaggaaatttagttgttgctggggacacatgggtgaataagacagtttccacaagggattcagtgtctttagagggaaggcatctaagtaaacagataattataatgcaaactattgattgcttcaacaaaagaggtaattgatggtctatctatctatcatttgtctattacctctgtcaaatatctacctacttgtgtgggtatgtatgtatgtatgtatgtatgtatgtatgtatgtatgtatctgtctatctatctatctatctatctatccttgtctatttatctttccatctgtcatctatctacccttaaaacatacaaagcagttagcacagtgcctggtacacagagagttcttaataaataacatttgtatgatgactattattacctacaattcccagatttttcattatattgtatgacatgcagaggtgattctgccagactacttgttaaccttatcactgtcatgtttgtgagactgtgaaaccttgcgtgaagctctcaggcaaaactgttagtgactatgctattgtggggccttgtaaatacttctgtagctatagttacttggccatattttaattatttgtaacatagttgagcttgaactgtgagataaattcattctaatatgaggcattgtttcttattcatgagtatgcccaaagattagaatatagtatgtgatcaatacatggttggctgttgcttgaatgaatgcatgctacaaaggttttggcaaggaggaaagtttggttagtcgtccaaactacttcttagacgtttgattaaagaaaagcagttctgagtcttaattgaatcgcatggtcttggttataaggcttcactctaagaaaaaaacagttaagtttctagatcatgtcagtgactgcttttatgatttcacttcagatctgatgccactgtaatctagttgcaaaattttgccctaaaattattttattatttttgtaagtataattttcaatacatttattatctgaaaataaaaataaaatatttatctattattcaggggttttataaatcccaagattatataggaaaaaaaccctgattttttgttttaactccagagaaacttgatgttaggattcaaatatcaatcttaatctgatatatgggcttttcattaaactttaaataagctatcagatttttaatgtggggtgtgtgtgtgtgtgtgacttgatgtactgggtaaactaaaatactaacatttcagaaaaagaaaactttttcagtctgcaatctgggtaataaattttactgagcaggtgattgtgttacaggatggattatttgaaactcatttattaatatactgaacatttattgaacactatgtgtaagtcactattttggcacttgagatatatcagtaacaaaaaagagagagattcctccctaagcaatgtctttctggtaacttaatagtaagcctgaaaacaattaatctttaatgagcagttaatattgtccttgacaagaattcactagtgtgttatcgaagtatattattatatatgtattacatacataatttcatattacatatgtatcattttaaacaatgttattatgtgttgggccaaccttttggacaattttcctttactccactggtctacaaaaaagacttagatatccatttgtataactcaacattctggcaaaatccaagcttgagagacatgtggataacttcagtggtctgaatttgattatgttctacatatgggaaacaatcagagtaatgtatagggatttcatagtgtaactaactacattaaaagaaatgagaactctgcacacctaagcacatgttcacaatttaaaaattcaggcaggcagttccacttaaaagatcactaaatcagcagtctaatagtctttagggatcatcgttttattatctcactaactttctcatttaactttgtcattctacaaacctgaaaattactcaattttctcagcctcatgtgattctggtgatatccttcctgtttcaagagtggctcaaaacttaggtaaatgaggagctatcttagaaatatcaacaattggaacttcagaaaatgtaagatagtgcactgcaagctgtctttaaatatgacttggttaaaaaagaaaaggtaacatcattattattattattattattattattattatttgagacagagtcttgctctgttgcctgggctggagtgcagtggcgcgatctctgctcactgcaagctccgcctcccgggttcacaccattcttctgtagctgggatttacaggcacctgcctccatgccaagctaatttttttgtatttttagtagagacggggtttcaccgtgttagccaggatggtcttgatctcctgacctcgtgatctgcctgccttggcctcccaaagtgctgggattacaggcatgagccaccacgcctggctaagaaaaggtaacttttacaacctccaagacgtgaacaaaatttattttttttagttaaaagttattgtggatagttattttggaaagacaaaatagctatttaatcatatatgcaatgagtgattttttgaagtcttgatcttaagaatttcaaaatgtactgcagaatattaacttggatgcaaataaatgaaagctaattacaacaaatattttcagttttgttttcctattgaagcagaaagacacagaagaacacaattctgagccttctctatgaacacggcatgccccagtggtttattcatggaatacagtagcctgccatgctgattctgtgttctgtgttaatacatttccctggtgctggacgccatactagcaggtgctgcctacatgtttggtaaacaaatcattacacttgttctcagtcacatctgcttgattttcttaaaaggggattgttacatttaaagtatagcaaaattattcacagaatcatagcccattgagactaaaagggccatcagtaggatgcatccaaacctgtctttttacaaatgagacccacagaagtcgccctgaatgacaccacagctgctcgcaggacctggactttgtccatttgatttaattggtcacttcaaattgttattaattatatgattcagtatgtttatgtctattaagatgattaaaaggatggcatgtcctttaaacttgactaaatactcacttaagagagatttagattcatatataccataccccatttacaaaacagtttttctgagcagctcaatggtgcctctattttgggaacaccataaacaatctaagaacacaacctcctgtgagtcattctgttatctaccaaatcgtatccctcgggaatcccatctttgactgcccgcttccatttcctcacatgcagtcattggaagtcaggattgaaaaggaacttaaaagtcatatgcaagtgtcaaaatttctcttgaattcgacccccctccctcattttggccttttcattgtccctgcttagtcatcagaacctcatagacttcttaaagggactgcaatttttacttctccaatttatattccacacttcctgcagatgtctacacctaacacacagacagaatatccaactcaaaactcattaatttctctcctcacttaaagcagttaataccagctttcttgctgtgccagtcagcacacctgcccacccacctaggtgcccatcttactgttcctccagctctgccaatcactaaattcatcttgtcaccatttccacctttgtaaatgttgaattgggtccagcgttagtggtcgtttaggattttgtttttgttttgcttttttaacctttaaagtaaagctacctatattttttaatttattattttttattgtggtgaaatacacatcacataaaatgtaccattttaattttgaagtgtacaactcagtggtatgaaatacattcctaatgttgtgcaaccatcaccaccatccatctccagaactctgatcttctaaaactgaaactctgaacccattaaacaataactccccattccctcctcccttcagcacctgaaaaccacccttcttctctatctctatgattttgactactctaactacctcatataagtggaatcctatatacttgtctttctgtgactgccttatttcacttaacataatgatgtcctcaaggttcatccatgttgtagcgtatgttggatattttttcatttttaaggctgtataatattctattgtatgtatataccatattttgcttattcatctttggacagacaacgcttcctatactttttctaatcagtctaaattaaccacttctttttatcaaaactgtttttggtgcacaccacactttctttcgttgtggctctgataggataattatattttatgcattcttttttctaaaccacatcatttgaatggagcattttgtacctcacttgactataaacaaaaaatgttgtctaatttgttccctgccctgtccttagctcataggccctcaggaagcagttattaaatgagcaaattagttttctcattagtggaagctggattgcacagatttgaacaacacaattcttgaaaatatatatttctatatattttataattaggattttgctaagtcattctctttagcaaatttcttaataaattttgaaccccagatggtctaaaatggtgaggattttatcatatcaaaaaaagaagaagcatgcctatacatgttcctttatgtttttgggggggagtaaaatagaaaagccatatattttcttagtatttctttatgtatttctttatggtttgcttgtacataaatatactgagaaatagtccagaaatttttccaatgtacaagtcttaaggtgatctttgccaaagtgagtagttggtacaagatgttaaattcacttaatttctaaagtatatttattctgttacttaatccttgggtcctataatagtaacattatatcatgtaaaatcgatattatatatagaagatatatcttaaaagttagcaatattttatatgttaattttttagtgtacaattcaggttgcaggtcagagtaagaattgaggaaaaaaagcaatgtcaaatctgaatcatcaagaaagaaaggggctaaaaattccaaagcagtagggaacacccagagaatttaaagcaaataattcagggtcacgtaacatagaataggatgtatacagaggttcttgacacgttgcgtaatttacctaatttttacttctccactttatattccacacttcgttgcacaggatacctaatagaaaaaaactgcaattatttataaaaatactttatctatattttgtatgttgtataagaaagtattttcttcttttagaaagaagccatggccaggcaccgtggctcacacctatcacacctgtaatcccagcactttgggaggcctaggcgggcggatcatgaggtcaggagatcgagaccatcctggctaacacggtgaaaccctgtctctactaaaaatacaaaaaattagctgggcatagtggcgggcgcctgtagtcccagctacttgggaggctgaggcaggagaatggtgtgaacccaggaggtggagcttgcagtgagctgagatcacaccactgcactccagcctgggcgacagagcaagactccacaagactctgtctcaaaaaaaaaaaaaaaaagaaagaaagaaagaaagaaaaagaaaaaagccatatggcatagaaaaaaaaaattctgtctttggaggaaaaaggaaaaaagtcccaggtttgaagccagttgtggcctcttactaggtatattattgagtctttcagctctgtttcaaaatctagaaaatgagttcagtattacctgtttaaatttgtgaataacgcattgatgtacaccctggattccctaaaactgtcttaactgcgtgagtccagtggactcagtgcatgagtctaaatccttagacttctatcagaccttctcccctagcagtttcatttgctctttaaatacaaacattggacactcatgcagaaccacagaaatcatgtagacaaactagaaattatcgtgcactcacaaattatagcttccattattaggtaatacatgctaaaccctagcaaacattaagtacgtgaactcctattactaaatagtaatcactcaagtaaactggacaaaatgtcttacggaggtacacatctcatgtgaaattaaaccatgttgcaggcagtgctacaacctgagattttacacagttatttacatttcttttgcctttgtggcaatatgtgcctgttaagataggctattagagaactgagcaatgagaacacttacaccttaaagtacaaggaaggtaatgtgacaatatcagcagatattttgcattatttagttagtaatgaatcctcaaactctttgaaaacacaaaggaacttgggcagcaagtgagggtgtttaatttaatcagaatatcacagaagtttataaaaagaaaaacaaaatccacatggtatctggaagcctaaggcttacagagacctcacatatatctctgtcaacaatctagtaatgaattactatgaaaaatttgaggaatgggaatacattttaaaagtttacagagttttaaaatgaaacctttgtaccatgaaaaatttacatttcatgcattgtaacaatttttggaaagcaggatcttttaatgtacttatattctgttatatagagctctttgttgaaagagctctatatttcaaaataattctatgaatttcatgaaaatgacataataaaatttaactcagcaggcttccaaccaatagagtgttataggatttacaaataattcaatccatcatatatagtgataataatatcactgttggctacatcagattgagattaatcaagcatcagtatctttggctcagaggaaaaaaattaagtaatagagcattctatcattgcagtagtgtgaatgctgatgaaagaaatagtggttcaaattctcttgtggaattaaatatgtcaaaacaacttatacatagtggagcttattttgcttaaaagccaaaaaacttgaaaagctttaaaagacaaacaatcatagcatggaagtacagtagtacaagtaggataattcaaaacattaccagaaaactatttgaattttcttaggctagcctatttgaatggctgtatccagggtgatactcaaaatacggtattgaatagccagcatggaggacactgatggccccaacaagacatactgtgaggtatgtctcaggctagcataaatgtgcacatacactgtaaaattgtggggtgtagggaggttaaaaagtagataagtagaccccactaccctataatttccagggcaccatcatagagttgccgacctggggatgaaactcaggcatttatctactttttgaaagcagccaagtggagactaataaataggagtgtggagaccactagattaaacaacctatttcagcttcactgaagttgaatgaccacatgaatacatttccttacaagtaaagttttctctcatccaaaggcttcaagtgtgtcaccgtgggcaagaccaaatgtatacaccacaacaaaattttatctgtgtcaacagcaatttgtacattttatatactctaattcatccaaatcaattgcctgattacagtttgggtactttagaagtggatagtcttataactggtgctgcagtagatgcatgactctttgaaggtgtttcggaaaccatgttcattttcatgagtttctctagtagttattgctgatagatttaagtggctttcccaggatgtcaagacaacaatgtgtttcacattttgagcttgttttcatctttatctgagacatgtgatgaactgtctgaaggcaggtggagaacaggtacactgagatatctacacatacatatgcaaacacacacatactcacatgtacacactcgtgcaaatgcatacacttctgttagcacattgagacatggattcactattgtggacagaattttgtttgcatgattgtgtacatatgtttgtcagtaaacgctcagctgactctatccaactttaggtttaaaaatattggagatgggctgggcgcggtggctcacacctgtaatcccagcactttgggaggccgaggagggcagatcacaaggtcagaagttcaagaccagcccggccaagatggtgaaaccccgtctctactaaaaatacaaaaggtagctggatgtggtggtgggcatctgtaatcccagctactctggaggctgaggcagagaattgcttgaacccaggaggcggaggttgcagtgagccgagatcgcgccactgtactccatcctgggcaacagagtgagaacccatctcaaaaaaaaaaaaattgaaagtggaggacaagcaaaattattttattactatactgtttcacaaatgctcactgagcttttttgattttgctctgtttgatattagcctaggttagttaaaaatctgtttccacattgatatatctagagcgttattaatggtgatgcgacattttatatgtcaggctcttgaaatgatttaggtaaaagagacattcgttttctcagtttcaactaaaatgataaattcttatgttacatctgtgctcgaggaaacaccactaatgtcatctcatttatataaatacttgtcaggtgactgcctaattttacaggcatctgagtcttatccaagcatcccaaggctgcggtacttggaagttcctttgtatttcagttaatggcatcaaacaagcctttgccccgctctacaacaaagcagtttgaacgttatcacatcaaagagaaagatgccattgtctgcaaactgtcttatatctgtcagaataaatcaattatgggacagaattaatttgacataccatttctttcaaacaagagacccccccatttccttctcagaaatgtaaatatataatacataatatatttttttttgtttggtgaaaagataccagtaaaatgataacatctggctgtagcaaaacgctgccagctaaggaatggtttcctctctgcgggtctgaccagagtctgatgttgtgcagatgtgcagccaggcttgactgtaaaagttataaacattgtcataacattgttcgacttctctagtatttcctgtcttctgcttagcactttattactaagtctggccagccgccaagtgaaatgcagggagttagggcctctggcttgaaatttaaaacaagtccagaattcattgggtttaatttgatatgcgaactctgataactcacacttgttaaaataaagccgcttaccattcaagttagatttacacagctttgagagaacataggagaagaaggggaaaacacatttttcaaaactttaatattggcctttagcgcttaagttttagaagtgggggttggggagggagtaggagtcggagtggggaacagctgattcagaagctggacagcttacagcaaacttgtgttcatttcctgtattagatgcaattccctgggcagagaatgggcctttctttcaacacttctgagcacgttctttctcttggctcattttcagattaggaaggccacatgaggctcattgcctatacatcataacaaaatggtgaggtgaaaacaaacgaacgataccccaccaggctgatttttctgcaaagggtatcttgtgccagggttgaacagaacgtcattgaagcaccagcataaagacatgttaacccaatttttcctgtaatgtatacatgattgattggcaatttttggaccacaggctgtggttaggattacatcaatcaggaagcagtaactcttgagggacttcccttaaatgatctagtgtttattggcgaaaggggttgcattttttgcagtctgtttctttcatgtgttcatcagttccattcctgtttgaaatttggtatcagtgcatgagataagtcacttttcttccttttatatccccttctgtcatttaaaatgcaagatgatgaacctagcacaatgtctggtacgtagaaaatactcattgaaaaaaaaaagagagaatgaatgttgaatgaatgaggaatgagtagtgaataagaatacatttgtgtgtatatagccacatttggattttccgatattcagaagtggtaggaacacagcatgccacacatttagctatagggcgccattcttttaagtagagcactgcacatctaatatagcaatcaacatgaatatacaggttttaccttctttgcattattatattatgtcacgtcatctttgtaaataacattaaaagtaaagatgtgaagaagaataggcaaggggaagaatttgccgaatgctaggagtccttgttcactctaaccacccttttgtacacttttggggtaacaggaaaaattttatctgtaatatgtgtaatatgtcatcagaattctgatggctctctttgttgttctgtgggttttcgtaatggtctcaaacatatataacttgttatgttcccaaaaggatgcattatggatctatgaaatttttgtaaggtgtgaacactaaaacgctgtcccaaggctctgctgttaatttgtttttattgaggaagaggcaagaatgaggcacatgtgtgtggaaccacttttcactgctggggtttttttcatgtatatgtggtgttcagggatgtatgggtgtcacatgagttacagttcctaaatctggggaagaaagaagttcctgacgcagaccttcccaggccacaagattctaaatttataaaaaggagaggtagaaaagaaaaccatgtggactgttactcccagttcagggttaaaagttttttttttttaaaaaaagagtcagcgcattagctagtgatttcgtttaagtggtcctcacaaaatcattggcgctttattgtattatctaatttttggaaatggaatgtaaggcatttgaaagttaaatagcgtgaagaatgaaaagcatgttcaaagcatttaagatggtcggtgaggcctgtgccattcagagcagctcctgcggacacagaaggactctgagtacggaccgtctaatctcattgggtttggaattcactttctggctccatatcacgatcagaacagatgtttcccaggctgcataggtgggtgcaagaaataaatttcagaaataacttacttaaatttttaatcaggtttttgtaagaaaactctggaatagtacttctcctaattctccgttacacacagcctcatggctctgcacaggatgtgactgtgtgtagttgcatcacgttcctatatactctaatttgtttatgcaagaaattccctcacttttttcctcttccaagtattttcctctgtgtgtgtatgtctgtgtgtgtgtgtgtgtgtgtgtgtgtgtgtgtgtgtgttaaatcacatattactttggcatctccaagagaaggcaacatgcattttaaagtgttatgtgtgaagctcaaagtatttcctgttatttgggaatgcttctgaccattatttctcttccagcagtctgatgggaacccagcattaattatgtatgccattattggactgatcaggttaaatagctagttggtgtttaccaatctcatttgaatattaaacaggcagataagaaaacctcaccttaatattatgctcttcatctctgtagattgttacaaaaggaatatgttgcagagaatatggagaagaaatcatgaaattttggtgtggggccaacagacctctagctagctgctggattagtaagaaagcagctttctgctgtcagaatcaacattactcagacagttgcagaagctctgaagcctttggatttgtttgcaatgagagatttgttgtggatttttaacaaggctcctgtgtgtgtgccatgcttagtaaatattggccttcagggtatttttcagtcacgctgaatggactgttagtttccccaaactgcaaagtgcagaaaatccatttccctgattttgttgccattgagattgcatcataggttttgcacagcaaaagcaaaataaaatctagcaaaaatctttttttttagagaactggaaaagtgatcaggaaaaagaaagatatctgtgattgcatatacaaatggacctagaatagagaagttcttaatagttaagttgtaacttaaaattatttcagctaaagtaactgaaatattttcctttctttataacagaggaaattagtcatattgtaataattgtgactaatataatcaaataatgaccttttcaaatattataataggttagatccttcttttaaatcaacaaatattatttttaaaaaggaaattcattagaaagtagaatatatgtggttccaagtgtttttcctacagcaaaggggtctgtattgacagttacgttgaatcaggattgcttgacattattaacaattaatatttaaaactcactttcaaaagatgatcgacgaagttttatatttggcctctaagaaggagtttcaggagacattatgattttgtcaagggcaaactaataacatcaaatatccaggagtcagagttttgttatagttgtttaatggtgatggtccgaaaaataaagttgtctagtagaattagtatgcttatactttttaagttattttagaaaatggtcagttcctatagaacatacttgaaatgagtgaccagcctctcaaagttgtgataaagtgagagatgaatgcatttcaagtgcattgtctatctcggaattagagacacctatttgaggatggagtttgggaacccttctgtggcctgcgtttttgaccaaaggcctaaagcatgaaagaatagccggaaagagagctcttttccatatgttgtccatttggctgtcagcactcgttctgacagaaaagaacagagtcttgagtgactgctagtctctcttaaagtatggtaatgaggctaattaggagagatgagagctgaactacatttgtgaaggcaattatccatatagcttttgtgccatgctgtatctttgtaagattcctcttctcgaattttgtcatttctcaaacatcacaagaataatgaaaatgtctaaaacaatacgagcaatgtggtcagtagaaaagaataaattactaatgaaattctgtgaacctgatgtctgtttgcagtcttcctgaacaaagatttggaggatggctaagataatactcacaagtgttgttgttgttgtttagtttacaaaaatgaaaattatttgcactttattatattgaatctatatatcttctttggtatgtgaacaggattttgcatggtccttttatgttagtcatcatggcaagtcagtaatttagtataattgaaaggaaaagacatcagaggcttactaagcaagcataaaatgtattctcttttatgtgatttagaaagttgagacattttcatttctattttcaaaggtttaatgcactttaactttcacaacagttatgaaagtaaaagaatggacctagatctctgtacagtgatttcatagtaggtgacactgaacataagttttgggtttttttaagtatttaatcacaaaagttaacagttaaaatacttgtattttttaatctgctgaattatttttgaatggtattgctgacatttcatattatatatatataaaaatatgacattctaaaagcatcaaactctttctaaagtgtaactgaagttttttcctccaaaaagaaactaggctgatttaattcaataggaataccaactggatttggttggtaattgtttgtactcacatttacatctggacataatgttttattgtttttaagtctattataacttttatatcttatatcttttgctcaaaagctcattagcctataagcttctaaaacacataaaggagataatttttatttttgttttgtaggattaaagaaaaaatcaaattaagtgacacataggtggaaaatctgtctgaattgcttaacagtgttcttacatatgaaattttattacttttaaatacattcagtagcaaatttgagcaactccgctttgtctcttgtttcaatcacatgactaagctcctttggagcaaggatagggcaaaggtatagtcagtagctttgataaagaagatgtagcagaacccagaaggccatagtacagctggagctaaaagactggaagtgactctcaaacttgagcatgtctgagactcactacaggagaccctgctaaaaatggctaaaaatacaggttcctggaacttataactatagtgattctgattcaccgggtcttggagtagggcaaaagaaacatatttgtaaacaagtactcctgggttattctgatgagggtggcatatgggtcaccctcacctttgaaaaacagtattgtagaccaggaaatgtgtcatcccaaatatcatcatattagaacaaggctaagcactgaaaactgctaaggagactcaactagaaacataaaaagacgtcagaatagagcagaaaggaagtctgaattggtgactccaattgaataatgcccaatgtataagtcagtctgtcagattttgtaatccccataacttttctgggttcatgattgttatctataaattctttagctctaacattcgaggattctagaatagccatggatagagcgagaatgcatggtagactgtaatcaggaagatgtgcctatcagggatggaaaaatacaagtgatcagaaaccaggccaagagtggagaactaagaattttagaggaacaacaagcaggaaactaaattgatgcaagattcttgctcctaactgaagcagccttctgcctcaggcccaggtcacttttggtggttgttttgaaacaggaaccaatctcaatactagacaaggtcctgcaggtggaagcaggtaattggaagcagctggtgcaggtgaaaagtgtgagatcaggggaagaaacagtttttgggttggttttttttttttttgtctgacaggaaaaaaaaatatttttttgatggtggaagcgaagagtaataaatagaagtaatacatacacagcacattcctttttatgtagatgatgtttcaaaaagcttgaaaacacttatctgagtgttttaaatgtttctgctggaaacatccttacattttgaatgaactctacaaagaaacactttgcaaagtcaaaacaaacagcagtccatatagccgtacctgccttatcatgaaatctaaatgtgtgcaagccaaaatggtgcatttcacagtccttttatccaaactcagacttaaaaagtgatcagtgttcgaaagggggaaaaaagagttatacaggaaagaattgaatttactgggaaaaaaacttcataataaatatattcatcatatatttaagtatacttctataaatgtgtcctgcagaaattttgacgggcgtgttacattttatgttaaaacccttatgcattgatatttataggtaagtttttttacattgctgtgacagtacaacaataaggtattaccttagtaatttttcgttgcctactctatctcaccttctgcgattttagccttttattaaagccatgtcttgaaagaaaatgaaagaaaattgtcttcaagttagtgtgcctgtttttcttaaatttatatattgagtcatttaattcttctcattttgttagtgaacaaagtttttttaggcaattaagagtcatagtttcctgcctctccgaatttgcgatctcatacagtaacaaacacttgttttacctcattgactcttttgtttcctcaagtgaaagaggaattggggtataatttagttttaacatctctggaccaacttaaaaaggaatgtaactcaagatgtatggtaagaatagtgaaattcttcaacagaactcactaaagaaaggttttggggatgttgcagaaaatgataagtaggaagacagcataaaaggtttagctgacgaggtaggcttggaaagcatagtagacataaagcaagttgcctgaagcttcttaagaagaagccctggaaacaaaattgtagcatataaagtttcatggaacgtggagtcttgagctgagctgtgaagtttacacaggtttctgacagttgagaggaggggagagaagaatgtatgaagtgcactgagctgggagtgtatgaggtctgtttgagggaacttagaataaactagtttgactgggagggttcagagaagggtgatgggtaattgaggaatctaggttatgaagagccttatgaatgtggcacaaaggattttggaatttatccactgagttgtgaaaagatgaaagttataaacgaagacatgatataattaaggttgtcttcagaaatttaacctagaaatgatatcattggtggattggaaaacaaagacacaagtgcaaggagctatcccctcatagaaggaaaacctcaatactagaaacaatctacaggacttggtgactaattggatatggtggaggaagttggtgccaatttcaggatggtggagtcacactgaatgatgaaaaggggaagaaaatcatctttgttggaaaataccatttaaaaaaattgttgagttttgagatgatgagacacaattcattttattaattgaggactgatgatttgaaagacatactggggagactcccccaaaaaagggtgctctttgccctctagaagctcataggttagtgggagatatagtcaagtttataaacattgtagaaaaaggtatactttgaaaatgttagaactaccaataaaatgaaatgaacagattgaagacagacagagatatcttgaggagctaaaagaagtactttgacctggacctaaaaagatggataggaagaacgtacatcagttggattcactcttcatttatttatttaacgaaaatgtattgagcacctgttctattgtatgtaccatgttggacaccagacatgatggtaagaaatcacattccttatcagagcacctgttctattgtatgtaccatgttggacaccagacatgatggtaagaaatcacattccttatcagagcacctgttctattgtatgtaccatgttggacaccagacatgatggtaagaaatcacattccttataaaaactggcaagtacacagtctttgtagctggcatgtgatcccatgtagagggatcaaaggggtaaggatgggggaccttagtggaagataagatgctaatgataaactacatggcgaaggagtgagagccctaggttgcttttctctaaataatggggatctttaaatgtttggggagaggtgagatcttcattttagatctatattgaatacattgtaaatctatgtttttagaaaggtgacaaaatactcaagttgaagtatttgtttatagatatattagacactgagatacattttatatgctcatccaaatgttggtgtcagccagtcacaggaggtgtgggattgctgagtttgagtttgaggaaaggatggatttctgaaatggaacgatcataaccaatatttattgagtacttaatgttatccaatcactgaattaattcctttagtcctcaccccagcctgctaggtggatgtcattattatatgcttatacagatgaagacattgcattgaggagagtctaatcaacctgcccaaggtcacatggctagttagtgtcataggcaggatttgaacccagaccagcaggctccactacctccagactaccaaggcagtaaagacagaaaggcttaggataattaatatcaaaggacttgaaggttattttagcaaaattaatgctgatgagaaccgagcagattgtgcaaatgtcaaggccaagaggtttgtggagtgaggaatacaccttctaaaggaggcagtcacaggcacctcagctatgtcttgccatgtgagaaaatgaacctagtaatatgagacattataactgtcaacaaaacctagaaagtatagatttttatgtcaaatcacccacttcttttcttttcaaggagacagtctcactctgtcacccaggctggagtgcagtggcatgatgtcagctcactgcagcctttgccttctgggttcaagcgattgtcctgcctcagcctcccaagtagctgggactacaggaatatgccaccacgtccagctatttttttttcctttttctttttttttgagatggagtctcgctctgtcacacaggctggagtgcagtggcaagatctcggctcgctgcaagctccgcctcccaagttcacgccattctcctgcctcagcctctctggcagctgggactacaggcgcccgccaccacgtccggctaattttttttgtattttttttagtagagatgggttttcaccgtgttagccaggatgatctcgatctcctgacgtcgtgatccacccgccccagtctcccaaagtgctgggattaccggcgtgagccaccgcgcctggccttttttttttagtagagacagggtttcaccatgttggtcaggctggtctcaaactcctgacttcaaatgatccgcccgcctcagcatcccaaagtgctggaattacaggcgtgagcccctgcgcccagtcaaatcacccaatttttaaatgttgataacttaaattctcattttgcactatgctgtgtaaccccttccttcccccaaacacacacatgcacacacacatacacacacacacacacacacacacacacacgcaccatacttggatgcttgctacccagatatggacctctgttcgccagcaagaagaaagtatgtatgtacattatatatgtattagtgcagccccctatttattgccatagacagaattagagaattttccaaagtagtatcaacctcactgcagtttccaattttaggtgacaattcatgcttacctttcttccatattcctgcaagcaaaaatagaaaattaaatgtattttttccttcagaaaatcagtgggtaaaagtgtttgttgtggcccacactgtgtcatgtacttagagaagttggctgtttctataataccagcgaatctatatatgacattcaaagtccattctccaaggactcctaaatatctacatgcactacatcatgtagactaaataatgaactttacaacaataatttttactcagttttacccagaaaagctaaagtatcagggatccaacattcttaagctttgtgaaccatggtgagaaacccctgtatttgtgaagaagttttgtaataataaaaaactataaagttatgctggtgcttcaaagggaataacatcaaaaacttgtggagaaaagccagaggctaccatcccacctccaacctgcacacacacacacacacacacacacacacactctctctctctctctctctctctctctcactctcaattgggagacctatcatggtagaataaagtctggttcaccaaaaaagagggataatgaggccatttttcattattttcccagtggattctaaaatagttacctcataaaataaatagtttaagtttccacattactttttgcctttaatctgtgcctgcgatgcaaataaatgagtggagatttttatactcccaaaggtttatgtagaggcaaatatattacaaaatgaacacctaaactaagcatgatttcttactaaaacagcatcttacagaatgctgtggttgacggaagggagacactttaggaaaaggaatctacaaaaagatttaattttatactcattgttcaagtatatgctactcttcccgatcttgtcttctctagattaaatttaaatggaaaactttcagaactgaactgagcctagccaagtacagaaatatgtatttcgtatgtgagctcctatggaaaggatgcaccaaaactgtttttgatgtgagtagagtaaggtgttaagagcgccgtaagttttataaaattaaaaacccatgtgctaaaactagaaatagtttattgtccttgtttaagaggcaactgaattaacctagttatctggctaataaacataaatagtccaccttagtgaagctctaattacagcctctgaacctttcggtgtatttacaacttaaaacatctgagtgattctgccttttgaaagctatgtgaagttagaaaggcggcctaattaaaacaaatcttgaataaaccacttcatggagatagaagtttgatggttggatatatcaaaaattgttaccagatgttgttcagaggccttaacagtttaaagatcatgaggtttttttttagcaaagcaaaaatattctaattgaagttgtcagcaggagtgagactaatatgcctgtatttgattaaataatagtttatttaacattcagtgtggcccaaaattggccaaaagtcggaaaacattttagccagcagacttcaaaagaaaaacgcaacaaaatgacagtactatctaggtaactttcaggcattgtggtttgataatgtcagttttcatcctgcttcccattcttcatgtcttactgtatatactctgcaaatgcctttgaatctttattctgtaatgtattttgtattttataaaaagaaaggagagcaacacaaacttattataagacttattgctgaaaccttggcaaggaaacaccaggacattttccattatagaaatgtaaacatctatatttttaggagttagatattttacagaggctgctgtcctttcactgggacatgaggatattagctgtatcaaaaagaagaatgtaagacccacatggtcctgttacaacttacaggcaccttttcctgatgacatgagaggagcacataactacttccttcccattcagtgtacagctgtgtgctgctctcagatgaaatgcaagaattccctttgaagaacagggaggcttgtctcagccagtcggtcttcctattggcgtgagcctctctctccttacattttctacttctcaggcatgcacctagccattaactcccgaatgatgtggcaataccttggttcttccagaataagtttttcagacttttcttggacttggtgtacgtaaaaatttaagaaatcgcccacatagatgactaggaaataaatgcattttaaaaaatgaattttcatcattgtgaccaattcccaagctagcgtttgctttccgtagtacacagaggtctggatttttaaactaaattgcagcaaactctgtggcaattatgagaggacaactgcactagagggccattaatcatttaaacattcaaataaaactcaatgtttctttttagatctaaagtgcagcccataacacaattgaaataacattaatagaagaagggaatgaaaagacagaaaacagctgttgctgtctctgcaatgtgccatgggctctaatcagagagtgagacactgtatacagtaaaggagaggattcttgttgattcaattcattttctaccatcctgagctttctcggtttaaaggaagttagggtgatgttcttgcatgtcataacactgcatttctggatattcagcagaagggacaaacggctggaaggtttagttttacagctgttccagaacagtatttaaaagttgcttgttagctgcaaagtgctaataataatgtaaacagggtacaaaatgtcccctgtggctaatgaggaaaaactgtgctctttaaatgtaactttttcactattaaaataaattttagttttaccagtgatttactttaaaaataaactttgtaaaaacctgaagaacattacatagttaaccacatttgtcctagaggatagtatggaaaataacttacagcctggttgaaaaactaatgacttcataatgactttgctttatttgtctctgccatgtccactagctcaatgtctgtccatgtaatcctcttttaaatcccttgactttgtaacatgatttttacttccatgtcagtttcacaagctctaactgttatccttttagcatcactgtaaacgacagtgcagagatcataccgccccttttctaaagcaggtgtaaataaatgaaagaaagaatcaattagcttgttctagtcaaaaaatagtcccaggtaggaccacactagagtgtaggtctctaaactcccagccccactgcacttctcactgtgctatgccaggaagtgaaaatcacagcaaatcactatcttgtaagaattaccgccactaccccatgtcccagggatagaacaggtgagtagactccacactggtttatagaaaaatgcatgactgaagccagcaaggtcctcgtcatctatgatcctcaggtgctttattttcgcagcctagcaaaaggaataaatctaatgcttgctttactgtgaatttacaattttccttagaatttcagtgtatagtgactggaacttaggcagtctgtaaatgataaatggaaaaagaatgaaacaaagcagaaaaggggaatggaacaagggagggagagggagaaggaaggcaggaggggcagggagagggagggaggcagaaaatgtaaatctcaaagccgatgaggttactatagaccatctggagaaagatgaattattctttaaatcctagatctagaagagatattagagatcatttgttgtttatgctctctgatttccccctccctgtatctaaatatataaagaaagaaggaggaaactaggttactgaacaccaaccatgtgactggcagaggtagaggcattctatgtgcttcatattcatgacccttcatcatgattgaccagttgctcttcttttattttcctctgaagcagaacctagaaaatgactttattagagcacctatcaggtctttgcttatgtggcttccctgataattgctgagcaacttgagaccttgggtcatgtcttttaccattgtgtgcctagttatgccttttacaggtagagcatccaacatggtgctgggcccagggcagatactcaatgaatggcatttaaaatgaatgaaagaatacatgaattacaggtaaatatcacagggttgtctcatttagtgtgccatggccttgatgcttatgcagtcctgtgcctataaaactatatggtactaggtttacatgctttagggagtaagtgaaccttgcagtttcctatttttttaaatttgactcttgtgtatgtgttgatggtattgacttgctttcatttaaatgtagaaaaaaaatgccatgttttggtattttagccttaataacctcataaaacacatatgagattcgcttgctagattataagatgcctttggtttatagaggaaaataaaactcctggcttttcttttctggagaaagaatatagaaagtagtctcacgatctctatgactccgacctgtatcccagacaaaccaaaacaggagtacaccaactccttaaggatgtgaagacagcaagagttgacattaatagtaaatttaatatttacaataaatatgagatagggctagacatagtactggaaatggtacctttcccctgcccccccaatcctatttagctacttcatataaaagatggcaaaaacttccttcttgttcgtgtagacattcagcctttctagaagacaaggatgacacttttgtcaattatttattttttgacgtatgtgccaatgggaacaattattagcctattaaatactttttgatatttgacccaggatagtaaatacatgcattcagaaaagaatccaatgctacctttgtcatcattgtgacaactgaagagctctagtggcctttcaagtacagataaactttcaggaggattctcctatgagctggccacaagggcttttattgtgaaccttccagcatatcctgtatgctcattgtgaactaaggaaatggcagtgatggcatctcaaatagtggaccatggcacccgtcatgggggtatccctgctttttgtgcccattaaaggtttgccaagttcttctaaacagactcttcagcagtatagtgaccattatactacttcctcatagtgtggcttttgtaaaaaactaaaagaaaatgtcctggattgattttgtcaaaacagttacatgagaagtgtagataatgatggactctttcaaggattattcaaaccaaagtaaatactagatggcacggatggactactcaaatgtggtcagcagtactatccaatgctctacttataaaagactcctcttttggacagataacttgtagaagactgaaaagaaatatgtatacgtctgtatctatgaaatgtattgactttttttttattttttactgctttacttctggtaccattcctttattttgtcttaagaatctacaccccttcatttttagttcatctagttcaggtgaagctgattttgccctagattcaaagccaaattgtgtgccttacattcttgttactcaaactgggagcttactagacatgccagatctgagatcctatcccagatcaataaataaaaatctgcattttgacaagatcccagggtaatttgtaacacagatgagagtttgagaaacttagccaagtgcagtggtacacgcccatagtccagctactcaggaagctgaggcaggaggatctcttgagaccaggagttcaaggctagcctgggcagcacagaagactcctgtctctaaaacaataataataagttttagaaactgctgtacaccagagccagtgtgggaattctattcacctggccatggtggggcagggacatgacccaagtttgcccaacaagaccctatttgaggacattggtttgacctctcaagaaagtgcacttagtattttccacgtgacttgtttaaaagagcataaaatactagatatgtggccattttaccatccgggcctgtctgactgagactggggtctgtgtagaggaagcatactccagaggaagaaaaatggtgctctcagggtatcacttgaatcccggccaaaatatgcctaaagtcagagtttttcccagattttcagttgcatgagtcagaagatttccttcatagtcatacaatgtgagttgtattttctgccacacacaactgaagaaaaataaaagatagagttatgagtaatgattaaaggcttatttgagtctcaccacctatttgcatgggctccttagctgaatgtgtgtgtgtgtgtgtgtgtgtgtgtgtgtgtgtgtgtgtgtgtgatttctcatttgttgtagcatttagaagtataagaatcaaaaaaaatcctagtatcgagacatgtctgctttcttgcatcgttctcttaattgcttcatgtatatttaccttacttcccctcaaaattataaacacttcaaaggcactggacttttcttccatgaggcgataatttaaagtaataagacgtttataaataaacataccagaacttatatcaagtgagtgtagattttcaaaaccaccacctgaggaagctgctaatttattctggttttgctgactttggaaagaacattgtagtaactctctagaataatgatcagcactagtttctaagccctgagatcacaccagtgctttgttagttacatctgatttttacttaaagtgacactacagggaatcaattgaacccagtcagatcacttcaattcccatgaaccagcccaccgtgagtcccctatggatcctgccagccccgagtaccccacctcttccctgaggacctcgtgggaactgctgccatccagcagtaaagggatagcatgtgcctcatggggagtctttagaatcctcttccttcactgcagccagcactggttctgatttcgatcagtcactcatgccatattaatggttatgtatttcattatcacccttgggtgctaccaaggttgttctgccaccttattcatcaacattactctgattaagtttgcctctttccagaaatgcgattgacatccaggaaagtagatcttctattactgtgagaacttcagtagctagctagatagataggtcaataaattgattgatggagaatataataactattttgaatataaaccactgagaagctttagaagtagaaacataagtataaactcggaggccttgtcatctttgtttaatagaaactgattagcacttgtattaaatgctgttaatagatcaataatttataataaataagtaaataagagcacatttcttatgttcttcgatgtgttatagtgatgaaaggttttggattttgtgggaagcagactcttttcctaagagagaagaggaggcagagtttataagtaaggtagtaaatccctaaaggataaaactcttccttattgattaaatatcaggcatttgggttataagtttattcctttcctgtctgctacctttaaaagccaagaacatttcgacaggttataagcattcaaagaaatagaggggcagagaatgctatgcatttgttgctacggaaaatctaaatcaacttagaaggcagctaaaagaaaccaatgtttatggctaggaccaaaatgcattttaactgtaattccaagggcgaatcacaccaatattgccaagttaaaaatgactatttctctaataaaaggaattccaatcatttaaaccatgaactcaattatattttctgaatattgattttaatcaattttatgaaccttaagtgataaaggtaactttttataaaatgtaaggatattgctgttgttacagtaatttggtatgaatgatgctgttagactattaaagtaaaacctctttgctaatattcagggattatgttacaataacatattgcatagcacaataaagttaatagcatggatcaacttccagaagtctctctgttttaaatgaatattgttttcagaatgtatttgttttgaaatatgaatttcagatctataaatataaggccaagtattttaataattgttattatatctcagactaccaatagatgttacattctacgtaaaatatttgtctaacttttgtattaagtcaaaccatttgtaatcacctatgtaaaatacatgtttatgtatatacatacacacaaaggtaagtctgaatggatatccctgggcttaattatcatgcagcgtatgggccttttgcatattcacttattaacagcagtagaaagcttagtgtgatacaataatcatttttaaataatcctaaatctactcagggtgaaaagattctgacagcaggcgctttaaacagctgccctgagcaaaatagacactgctttcttttaaagttgaaaaggagaaaggtaacaattatcccagagacactggaaacaaagttgtctgatttttccccggcaaatgcctccacctcttgtaaaaagaacagtgtatttgagatgttggaaaatggtggacccatcagaagcagtcatcagataaacagataattaatgtattaagagtgtaattgaaattaacaatggctttcatatgtacgtttagtactgtgctacaatttattacttgtctgaagtactttcttgcattataagtcaagaagccttgtggagccaaagtaggataataacaattaaacataactacctctacaagattaaacttgatactgaattgagtagcggtagaaatcatgacttaaacatttgttttctccctttgtacttcatttataaattcagtactgcttttaccattaagagagaattctgaataaaaccataattcagattaaatcaaactaaatattatttagttgcaatactaaatattatctatttatctaaagatatttttaggatatattaaaattcccaatatgcctgcaagtttttgtgttctgtaagaaacttagagaatttttcccttgaaattgactatcttaatcctgatttatgttttttttcaaaagtaaaaacctggaaagggccttactaacaggccgaacattttgcagtttccaatgggtatataatggcatccactctgtgattgggagtttaaaaatcagaacattcaaatattctgatcccgattgctttcccatttgaataatcgtacctctttatattaacaaactttatggtgatattttcaaattctttctatatcacttcttaactggccacaaatgtttgtaatacttgagtgtcttctctgagtttcaaaatgacttgctcagataggaactcacattatttttccatttctgattcctcccttcccccacttttaccaaagaatacacatgcgttagtaaattcagcctattttcatcattaagaaaaaaaaaaagtcaagttcaagaaagaatagcacagctgttcacaatgtcatatcttataaaacaaatctattaggaaggtcaaatcctgaaagaggtcaagttaatgagataagtggagtaatttggtcattttctgaaatttgtaaacttacacaaatctatttttttatcctgcactacatttttatcctgcactagattgactaactaaacctctgctaatggtgattttctacttctttaaaagttattacttttatatagcaggcacacttttctgtacctaaatgtttttaatgtgaattgagttcaatgttagtttgatactaatcagtccattctgtttatttttgaattactgctttcatttggaatgcatttaaaaaataaattttaaaaaatacaaatataaataaaaattatatgtctgtattcacacacacattttgtgtatgtgtgtatatgtacacaagttaattaaataaaattgtggacttttaaataaaattatagatcaaataaattgtagacaattggtggaaagaggatggcctatgtcagatctagccacctaacatttctttcagagagtacaaacattttgaagcatgtagtatctgcacgtgttttaaaattatgcataaattaattcttcgttaaatcctactgctgggtccttaagtgtcattaatttactgattctgccattatatttttatatttattttatttacagaaaaaattatctaagtcagatataactccttatcttgggagagaagtatgacttccatttttttcaagttgacattttaaaagataagagcattagcctctgaattttttaaatatattaaactagaggaccttgaagctactttttttgaaaagctaaggaatatatgtgtatatgcctatacatattataaatgtatgtttgtgtgtgtattaactataaatgcatgcatatatatttataaagtagccaatgttagtcaaattccaaatggaataaaatttatggatataaatgtgcagctaccacccaaaatttgctcaaaattagcaaagtttctatgtctgggtctgtataaacccaagtgagtcaactttatttataatctaggaatcaaatatctatttttatattttgtgcgtgtaatctatgtggctacactatatgaaagaagaaagctacctgcagctagaaataagtaataaaacatgcatgagggaatgtgatctacaatgtgttcctttatgttctagaaaggaccctgatttccttcctcaaatttcaacttagtttgtgtgtgagaaatatgtatctttaaaatggaggaagtcaccaccagagttatgtaatgtaatccttaaagatcttttagaatgcagtcaaaaggagagaataggaaagaaagagaggagagatgtattcatatatttttaaatgtgtcattgatgtaataaactctttaaaagacagtttcttatataagggagttttagggtcaccattaatacattttctcatgttgtaaaaataaatatgaggcgctttgtataagttttgtgcatatgcacattaacatagatattgagttatacacttgtatataagtgccaaaagtgtattcagttttcaatatctttaaaatctaatgtctattgaattattcaatctcttctgaaattaagagagaaagaaaaaatttaatgatctctgaatgcctcatatatgtcaaacatgacattccatagtctcacatacatcattatgtttatgttaactgagtatgtatgtgaattgagagaactccaacatagtaataaaaataagttggcaataaaaattaatcataagttatcagtgtcttattttcctcctactaaagtaaataattataaggctgacatttacagcattctcctaggtactctattgcttcatttttttttcagttttttaatataaaattaacatataaccaattatatttattctccactatgtaagaaactcatggaatttcttgacaacattgttggtgttttaatcccacttataaaatatgatattgctttaatgaaaataaagacaactagtgatgtctcactacatggtagtgctgaaaatgattccattcatttacgtgagtgtatgtatgtatatatgtttgtatgtacatgtatatacataaccaacgtatgccatttctacacattttgcaaattgctcattagctcagacaagcagggactgttcctttcctctcctctcctgggcctaaacatggcccagaatttattaattttcttttgcatttcacaaaagtgaaactgttttcaatctaagttctagtttctgtaacaatggctgtccttcatatttcatgaataaaggtatgcttaaagcataatgcttgtatgtgtacacacacacacacacacacactccaaagtggcagtagcatctcttctgctagaggtcaattcaattaagctatcactaattaaatgcccactatatgcaaagcactgataatataaagattaaaggaaaaagtaggtccttcttcaagagcctcctttcccctgtgtgacttgcacatgaaaataattggaatccagcagtctgtctcctatacctatacagagaaagtaggactattttgtgatttaagacaattcaagatatgaaaagccgaggcaaaactaacattcgaatgctccaacagttaagtttgtaccttgtcacaaagttcctcttatgatgaagagtagttttgatacatttggggtaaatttgtaaatgtgaaatagcaaagggtaagtcacaactaagcatttttgtttgcttttcattttttgtatgtgttttaaatttcagctacactatgaatcctttttcaaaatatctttaagagcttggtaatttttttcttttcctttaaaaaatctatattacttcacaatagggagaaatgacatttctttaacacagatcactttaaaaaataattgtgggtaatttcttgctataatttatttacgtcttttgccgagattgtgtgaccaattcagtgtgttcatctagaggaaaaataatgccaacagaaaaagaatataaacataaggcaggggaaaataaagttgttgaaaagttagtgttatattttcagagcccttctcatgaaataaaatctcactcaccaggagttttgtgtctcaagttgggctgccaggtctcggttttggtttcctgatattctgctcgatgtacaaaatgtcaaagtgagaaacagctttaactgttccttttggtacggatgactgaggggcactctccagaatgcttgatgcgatgaggtagttcttactttggtatgcgatatagtgtgattaataaactccagatcacagagagagccgggtgcgagtaaggctcgtatgagtgcagtttcctacccaagacaatgtattaccttgagctaatctggtggtactgaagagagaatttttacgtatgtatacataacaaagacaatcactgctttcttcttgagcagctgcagccagtcccactaatggacgtgcaaaagcaaaaactggcagcataaggtatgtgttcgtttttacagatggtactgcagacaagttggtaattgaaaaggaagtcgtgtacgtgagctatttgacggggcagggagtagggacagcctattataggactttcctgtgtaattgactgggtgagttattgaagaggtagttttcccgtgaaagatttcagttattacaaaattacatcattattgttaaggaaattcataattccacttcgtcttttaaaaatcatgttattaaaactttagaaatcagctcagtttccctgcctgcacagtacctctatcatgaaattatctgctcatggtcggtttcaccaatagtggtcacagagctcttatttaaagacaaatctttcatttgaataatgacataacattaagtgcttgttttaatcattggaaaggtgtccgtaaatacctatgattttacccgtcctgaggacatacaaaattgaattaaatgagagagaatatttttaatgatttatagtgtcaaaaataaatgaaattcaggttcatttttttttagtctcccactgccccattccccgtgtttctaaaagtcagacagaattgcgtggtcccagaggtattcccgagatagtctgtgaagtatttaatccaaattgcatatttggtgtcaggctctttttgtggacacattcatagtttgtcattaactcttttaactgttttgaacctctgtatatttaactcatgtattcccgtatgtttttgttgtttacattaaaataagcagtggttgccatctttctgctgagcagactcaaggctgcgttttaacatctgacttgtactgaatactctcaattggatagcctataaaaaatgtttagagttaggagtatttttgtcattactcttctgtgatgaaatgcaaaagtatatcacatatgagaagtataatagtaagcttcatagatagatgaagaacatgaagttttatatataatagtgggggagtttttaagcagacattatttaaaatatttttatattatctgattcttgaggaatttggtaaaataacctcacctttcagaactgccagtaatttatcttgaataaaaatgataccaaatatcacaaaaggtctctgccttggaacatacacatatataaaagaaatctagtaaattgttacctgaacatgtgtgtttacagagcatgtcaaaaccccagcaccatttttcttgccccaactctagccaagtcttctgcaaaagcaaagagagactttcattcacagctaacctcccatgtagcaggcgctatgagaggctaagtcagtggtgtcaccaacttctgcttttaagcagcggcctgtttcacatactttttttattttttttgacacagcaggatcaaaacacatgtactgcacccctcccccctccccagcactgccccctccatcagccaagtgctctgttcctctggctatgactgtgtctgtcgacctcaaaacagctcgttgccatatctgatgaaggatgactcatttctttctggtacctcaaaacttgcataatttcaatcagctgttattgggtggtttgaagagataagcgttctttaaggccaggatatggtgtaatatttttggtaaaaattccccaatctcctctttagtaataaggcctgaaacatggttcactgtggctttgaagtgagggcaacctgggtttatatcttagccctactattcagcagttgcaaattgcttctaagcctcagttttctcatctataaagtggagggaataataataataatgataataatacttgcctcttaggatcattctgaggatatcagataatgagactaggcctatcgtatgttatcctgcaaacatatgtgcaatgatgattatttaaaaagggacaaagatagtcaaacaagagtattctattaaatagttgattcaaaaattcttttttatttaattaattttctatttatctattttagagacagtgtctcgctctgttgcccaggctggagtacagtgacatgattatagctcactacagtctagaacccctgggctcaaaccatcctctctcctcagcctccagagtagctcagattatagatgcataccaccacacccaactaattttttttttaactttttgtagagacacgttcttgctgtgtttgccttggttgatctcaagctcctagcctcaagcaatcctcccaccttgacctcccaaagcactgggattacaggcatgagctaccacgcctggccaaaaatgctttttagaatatgatcctgtcatattgcctagacttagagaccagaatgtgttctttgatgctagataagtcaaagaactattgtcagttttgtacttcatcaataaaaggagagtaatagtaattagtaattcaccgtaaatctgaactgggataatatgtgttaggagttcttaaccttgggatctggatcagtcggcactcaaatccacaggaaatctttggatacattttgtgagggacatgcttttgaccatgttaaagttatttgtaaatattttacactttatttttttctggagagtgtcatacatttcaccaaaagattgtatgatccccaagagtgtgagaaaccatcgaggaaccactgaattgtatatagctgcctcgagggtggcaacacttcataaaccagttattatgttagatactatgaaaagaattattgattttttttctgttttttcccaaaataaccattatatattataaaggcagccctaaaaaggtgtaatacatgaaatattaataactgtatctgactctctaattaaatgcctagaagctgagacttttggcttttaggacttttctagaaaggtcttcatcgctgatatttttatttttagaatatgaacctatcccagaataaatctgcttattaaatatattatataaataaaatatgcaacaaatttattagaagaatcaactcttgtgctgtcacactgaagtttaagaggtgctaaaattgtttaactgtgcctccaaaaggccttttagtatttttttccttccagtgtcagattttggcactggcatagaagaaagtccccatagagctactttccagccattgttgtagctgaaggaagggtgaaaacacatacaggatggcaaaaatagaagctctgagagacttgagtagttcttttaacaataatgactttcacgtggaatgaaaaaaaagacagtgcagacataaattttcaaccatatttttagctgtccaaatgcatatttgctgtaaaggcagaacattattacagaaacagcgtggttagaactccagaaatctgggtttttccaattctgattctattatgtaatttcattatgacacagggtgtttggtttgctcctttaccaaatacagggttagctaccaaatatggggttagttaaagaagggagatggggtcctcagatctgtgtaataggttttatatctgtgtgataaatttctaaaaccttgagatgtaaagaatctgtatgaataaagagtgggatatacatggggaaatagtgattttctgctctttcactctgagaatcaccagttacatctcagaagagatggagctaatgtgtttagcacagcagcattacctgatatatcgggtagctccctatgtggcgacattgtcagtgggataagtcttaggtgcattcatatctcagtgcaaggtatgattactggagtatgtattgcctcatgtcctggaacaaaaactgttctattgctcttagccagagatgccagtttagtttacactggtctccattatcattgctgatgtgttgaggaagtgaatttaataagcagggtaaacaggttttgtttccaagctctatggtgattataagatgggtgcttggctgaacctgatagagtcccttcagttttttggcaagaaatctgagggcaaagaggactgttttaaagcaggcaaagacatgctgtacagcccatttcaacggattcttcacaattttatttgaaacaaaagttggccaggatattggtaaactattgctttctgttggcagagtgctttccctggtcttgttcaattgttggccagcctgtgctcctggtaagagtctggctattaatctaaaggtgtttattgcaaaccaccatctatttttaagttgttttagctcctgaattcagtatattccatagggtctactggtgtgtagtcaacagctggttaattctattttggaggggaagaggggagggacatggccttcgatgtctcctagtggtgcatgatagagataagaataaaataatattcaacacttattgaattatggaatatcaacaattattgaatatcaactacatatctgacagtcatgaacacattaagtcatgtcaactctattggtaattaatagaacaatgtgattgataggacattattactaatgtgaaaataagcaagtattaatttgtttctgaagtgacttaaactgttacacgtttttacaaaggagcacaggaagtaacccctctgattattaggtaacttttagcctctaaatgagatttatgaatgggcaatactttggtatcttcaggaaagtttccacgtaattcacatgatttcagctgtcaatgttcatgaacaatttctgtttgtgttgctttagctccataattagtatgtttttagaagattccactggaaaatctgcaagattacagaccatgtttgtctcacgctgtgaccctggcttgtagcacagtgccaggcacatggtggacacgcaataattactcccagaacttaattgacttaatttaccactgaaattgtattactgtgaaatcgtaccagaagctttgctcataaccatctatgcatttcgctaacatgaatgttgcaaagactttttgatataatcagataaacacagaaaatatttaaagagttaaaaatatttgaggtatattcatactaacattatataaatcagatttcagattgattcgatttaaaatggctaagatataaaaccataaaaaatgcgagtaaatattctgcctatcagggcttgttatgtaattacatggtttcagtatggttcttattcatagaaaattattgtaaaagatcatttcttcacaaattccttcaccaatggaaacctttaatatcttgaagatgaatatccatgtctgtaaatgttaagccactttaataaatcattcaatcaaatttacttcatattaatcagatgaaatcagttccttttcaaaatttggagatttggaaaccttaaaatttttatatttggctggtcttcaaataataaaataaaataaggaataaaaacagccgacccaatttaaaatttaaaaaaaaatgtcttaagtcatatctgggtttcctaacatgtatgccaaggctcagctatttatcaatgttatatagctgactgaagatttaagtctcccaaaagcaaaacttaaattggaaacttagagaaaatttcaactattgttacccgcatgttggtgttagccgtgaacctaaagacaaaaggtgttgtgttttgtttgtttgtttgtttgttttaaatacttagtcattatacttattggtttactctaaaggggaggaaaaaattacactggatttaaagggtattcatattaaaagttaggtatgtcattttctatatctatttggatgattgttcagatccatcacctacattgctgctgtgaaaatcagtattgtggctataatatttgaaataccgaaagggatcaagtgctcaaaagacaggccagttatcactgaaaagcatttgccaggcaatcactggcttcgaaactccttgcagttaactgtttgtaccattattcatcctttttcacataggaaattaccagccaacggaaatggcctggagacaacacaaatgcaacctaaattgtactgctcaaagcattaaaagaaaagcaaacaatcattttctcgaattgttgattccagaattttttctgtagcaatttttagttgagctgcctcatgtagctttgggttttcagccaatcctccttcactcttgccctctgttcaaaccacgtagatgtggaaggtgaacttagagaagttcaggggcagagattgcagctactctttgcggctttacatgtgtgagtgagcagtcttccctcagtctgagaggagagaaagttttgtgctatatatgcccctcaggaatgccaattggtgttatcggctagctacttattcctatcctttttccctcccagcactgatcttatccatatgacccataattcttccctctcaggcacgaggtgatggaggtacaaattattgtctcttaagacagcttgtgggaaaaggagaaatttattatttaaacataaacagacacagatagaaccatcagcaatttgtgactgtaatgttaaagataaaagagagctgcccccagcacttagcaagtacctggcatcagctccttctcaaaaatacatgtggggctgggtgcggtggctcacacctgtaatcccagcactttgggaggcagaggccggtggatcacctgaggtcaggagttggagaccaggctggtcaacgtggtgaaacccgaccccactaaaaatacaaaaattagccaggcatggtggcgggcgtctgtaatcccagctactctggaagctgagacaagagaatcacttgaacccgggaggcggaggtggcagtgggccgagatcgcgccactgccctccagcctgggcaacagagcaacgctccatctcaaaaaaaaaaaaaaagtgtggaaagtaggagtggacaatgaattttcttgaatgtgtcttctatatcatcaaccatctctgcccaactccagattaatttgtcagcctgaatggacgacatttaaaagggattttaagaaaacaaacactactttttttcctaaaatattttttttttctaaaaataacgatagaaatagcaggcaggattattttcaactttcttaatgtttagcctaacagagcactgtcctaggtgcttattccttagaatgttcagtgacgattaggaaacaggatttctgtccttaataggcttactgcaaaggagagtgacaaagtattttaaaactgccatgcaggataaagtatgaatgaaataagatcgttagtgcttttctttttctttaagttaaagccaagctttgtttttgaaaatagggcacaggaggcttctactctgcgttcctttggtaacaggctgcttccctgtccttgattgggctaaggatgttgataacttcaaaggaaatcccttactgtgtcctgccaggttacattgtacacagtgtgaccaggtcagggctcgcatctgtatggtgttttagaaagatgtggttctgtagtgacacagctcaggacactacccacttctcccaccttctctgctacttccagaaattttaattgcaccaaaaataaggttcgactaggcttaccaaagtactaaatttgtttagatgggaggtaacttcatgtgtgaaagaatttctcacctacctcccactctccacccccatgcaagcttgctcctattgaattctaggtgcgaacacctagatatttcactctgactcaactttccattctcatatttgataagattggtatgaaagaaacacattgaacaatatccaaccatatgctttaagcatctctcaaatattcaataacaagattcaagggctgaaaactaacaaaatatttttctcatacaaaagaaatcacagttgaatcctcttggcaaataggatttgagcacttactacatccctggcaccgttttaattgcatctattaatctacataagaatcacagtagcggggcatggtggcttatgcctgtaatcccagcactttgggaggccgaggcgggcagatcacttgagattgggagtttgagaccagcctgaccaacacagagaaaccccatctctactaaaaaatagaaaattagccggtcatggtggcgcatgcctgtaatcccagctactcgggaggctgaggcaggagaattgcttgaacccgggaggtggaggttgcagtgagccaagatcgtgtgccattgcactccagcctgggtgagtgagactctgtctcaaaaaaaaaaaaaaaagaatcacagtagctcacactgtaaagatcagagaactttaagcattgaaagattaagtgacttgcccagtgttgtacctggcaaatgacagagacaggttttgaatatcagtgttctggcacctaaatctgattattaacctccaagctctactgactctgaataagtgtattcaaagtactcctgatatatttaaaatgtgatatggtttacctaaaatatagcaaactatattggagtctaagtgctccttttaaagcaagctatgcttttggaaactagtgctgtaatttcaggattttccctctaactaatgaaaggcattttctttgcaagagaattaagcaccaaattgtgcaagggttgaaacactcactgaaatcaggattacacccactttggcatggtgtgtcaagcacccagggcataaggaaagaacagcaggctggagtgaatggttacacattcacatttgagcctcagccatatatgtgggttaatttccaaatggacatttacattgcccttgtgtggaccaagttggtgtttatttgcaaacatgttatttagatctaggaaaatgacaggatagccccaggaaagtttcacaattataacttaactaggctcccagcttactttgcacaaagggagtccccaaaatgtttgataaacacaacttctaatagttcattgattttgggggaagcagcagtccacttttgcagtaggccttcactgggacttgcagactgacacccaacatttgctattgcaatgttattgagacttagaaactcatgatacattcctggtccagagtcgggtggggggaagtagaaaaaggggagccagagattatctttggaaatctagtttttattacatcacctaaagtagcacaacctgctacactaatgaaatcgtgttcttggtttaaaagggcaattgttagcctgactttgtgctcactaaaaacattcccccaatcttgttaagttattgctctcatttcagatttttatggctgtgcagcttaccagccctcatttctttacgtttcattcattttccttgtattgatgattaatggaggatgtcgaatgttagagtgagcaggcatcagcaattgcaagatcataattagtttagctgacgagagcctctgatagcacttgcatctggatggaaaaattaccctatagggaactggctgctcaccaggtctttttagtgatacattgtgaaacacccgatgaatcaaatgccctttcaatgccaagaaagtgttccagtcttgaagccaaaattatgtctgcagaaagctttccatttgaaatgtatcagagtacaattataaccattgtattttcttggcagggataccactcttctacagtatggacttgagttaaataaattgcctaaattttatgaatccctgaaattttgacttatggcacatgtaatatttaatttataataaaattaggttccagcaagactttttccactccttatctaacacgcatattttatcattaaaggctttgcttcctagagaaaggagagctgaactgcaattcaggctgtctttttttttctttttttttttcagcaagagaattccatttcctgcctgttagtatttgtgcctacaaacacagcctgacttttgtttaagtgagaagtttaatggaatcattacttgatagcaagaatggaacaagcaatactaattatctagttttaaatattcttaggttatttttaacctgttgattacaaaactcaggccactagaatcaatttgtatttggaaacccttgtgatttccaagtctaagtcaaataaaataaataaatagccattgaagggtctatgttgcctaacttaagtgggcacctcataagggttctcattagtaatactgtacttttaattggctgaagtttctacaaaccctctcacgtttgaggaatagaggaatctttcagattttacaattgcaaacgaaagaccagaattgagtgtcttatattctcgtaatacttacgttacatgaatgacatacaaaaacacacaaatcaagtttaattttaaatgatttacatttattccaaacttgactatattttaaagctcaggtagcatgtgctcctcctttccaaagtgtattaaacatattgccatgttctgtctttttgacgtatgttttgacacttttaaaaggtatattttagggttcagcatttaggagccatcattaaagccataaaacccaaagttcaaaaagttaaagctgtttctgtgaaaagcctttggtgttccacacacctcatccatcactgtaggtttaattataatgaaaatcagtggtgcctattaaacacaattgaacctgacctcattatgggcagtgtggttttatactgtcattgttgctagtttaaagacaaaactcctgggttgatttggtctaactccactgatcatgtgactcacctctgaccttggtttttttcccctgtttcagaggcgtagaggctccggtgttttttgtgccaattgcctgaccacaaagacctctctctggcgaaagaatgcaaatggcggatatgtatgcaacgcgtgtggcctctaccagaagcttcactcggtaagaacttgttccactctttcaggaaaagctttataaagcagtgttggcctggtctgtggtgtgataagtcccattccctggcttgcagtgcctgcccccgcagggttgttttaatacagtcactttgagtgcacatgtgatttatggtgaagggggcttagatgtgatggggagataggtttgaggtcattagtaatgcattatgcttcttttgatataaaagaggaaaatgattgatttctgggaacttcacagcagatagttgaactaatggttatcagaattcaatgaaattattttaggtaaaaaggagaaaatttttagaagtttcagaaatatgcaaaacgttttaaaaaatgaaaaaggactcggtcatgttcagtataaaatataagtcagggaaagaattcgtgttttctagtttaccttcggaattcacaagtgttatcttgaccgctttaggggctggaggggcacattcggaaggacagttctgaactgaattaggatcagagaatatcacatgaatctccccagggccttcagtgggtatttcgatgaggtatctgaagttctgaatagcacacacaccagggtagagtaaggtgcaaagatactttgtcttttaagatctccagctggctttggctcacggaggttctttgaattacttttcctcaaattttagttagaattctgtaataaaattaaaactcacaaatcctccatctgaatatggatttgacttactgaaggatttttttttttagtttagcaagttcatctgctgacaagagctgactttaaaataggcatcccccatttagtaaacaaaaatttatttccctgtgcctttttcatttcgtttggcgttttaccatagctcttagcgcaagccagtgaatacattatggctacagggaatacacttttagacaaaatgttctcatatatggaccattagaagcactctttaaaaaatgcatgctgctaacactactaattggcagtaaactgtaaaaaccttagttattagcatgtagcaagtagaaagattccaccccccaccacataccaacttattttttttaaccttcaccatttaagcatagcaataagtttctatttaatgggaactgacattaatgattttaattgaagtctggccaatcatagggcaaaaattaattaaaatactgctctgccagattatgggaacttaaccactgagatataaactaaagtattttctaaaaattattttaatattcatctctccagaggtaagatgttttcagttttcaggttttttaaaaaaccatacattgaaatacataaaggttatgttcacatttcgtgtcaaaaactgacacaaaagttatgacagtttaaaaaaggaatttatgcaaatttcaggttctttacagtgtatagattaaataatgcatatgtttataatgctaatatgaactctttgtaaacctggatattctgagcaaaagaaatgcacatggcataactaagctatgttgcattttctttcttaaactaacaatgaattgtcaataacaactgtgttatctttcttcacttggaagtatgtttgtaacaacagaaatgttccaaaaaagatttatagttgtacttatttaagatacaagaggtactccctttctttcaagtgtatcacttctaggaataatttacaaattacacttatatttatgtttttttaaatttatattatatttatattattataacatgtttatgaatatttatgtttatatttaaaattttataatttataaaattatacattatatacacataatgtgtaatttataaagttaaatttataaattatatttattgtcatgttttatgtggaaattattttctgatttcagtaatcttttagaaaaatcagactttagcccatttaaagattaccctaaatttttaacctataaatacgcattaatttatcaaactgattcctttgattttatacatcaaagagctccaactgcaagtaaagtttttattatagtcttatccatggatttaagtcatattatataaatacctgttgaacatgtccataaataccaatcatgtaacgtttaagctaaacaaaatacttaagctgaatgaaagttagcacttactttaagtaaagagtagaatgacagatcagatatttaaaccaaagctacacatgaatttagattttcaacacaaaactaatgcttcactattaacaagtaaaatcttagatcacaaatataaaatattattaatgagagagaagtagaaatgagaagaaaaaaaaaatccctctctattgttttgatgacctgatatctttcctcacaattctgtcagtttatctttgattatttatgctctgatattaatattttatatccacatttgcaattatttagaagcacgcatgtatttgttgcttaggtttccataacaaaataccataaactgagcagctttaaacagccgacatttatgttttcacattctgaaggctagaaatctgagatcaggttccagcatagttggattctgaggagggctgtcttccttactaagccaccttctatctgtgccctcacatagtggagagagatctctttctcttcctcttctcataaggccacagccccattggattagggccccacccttaacaacctcatttaactttaatttcctactaaggaccctgtctccagacacagtcacactgtggtttagggcttcaacatataaacttattctgtctgtagcaatgtgtaatttttccactgttaacaatatgtatctcctgtgttactcttatatgctggcattttagtgcacaactcaaaaattgaaaaaaaatttcagaaaaatcacatctcttcaagtgactttctacaccgtttcatcactaaatgatgcaatctcaaaatctgttgcatctggaaaggttattttcaagtagattaaagttttcagtcccccctgcaaagatggacatgatttaattaggctaaaatagtgcactttggttacttcctctgatcctgcttagggcaaaaggaggagatttagtaaatctacagcagaaagcctatccctgctttgaacttaagcatggtttatatttgtgaggaatttttaatgcattttaatgtattttttaatgttttccttttatgtattgtatgtgttctctgcagactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggaccggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatccttttgtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatgttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtaacgactagcattggaaaatacatatcactattcttggaatatttatggtcagtctactttttagtagaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaaagaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcagtgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgtttttttttttttttttttttttttttcccaacatatgaactgcagcatatcactttttctttttgtgcctcaggttcctcagctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacacataacggcgttggtatggtttatatggattcactttcatccttctagcaataggaaatacagatcattgtaatatatatatatatatatatatatatatatatactatatatatatatatatatatacaggctctgctgaattgaaatggtgaaatcaaatcaccattctaaaaaattattacttatattgataaagcctggactctctcaacttgttgtgctttgattttttttcttaaacaaacactctctcactgatatattttgtgtaaaaagatatatactactttctccagagagataacataaaaatgtgtttatttcaaaaacattcattgagtatcaaatattgagtgtcgagtattgggtaatgattatgttacgatgtgtaaaaacacctgcttatgaagtttaactttgaattcggtatactcatgtgaacatgatgcaattcctaatcaatcatctcaaaaagtttaaattaatatatcaaatatcttatttgtttggttaaaatcaaattaatcagggcaagttccctgaaagatgactttgaaagagaaatgaggcagaacagatccagataggaaaggacgttggcaagactcacctgcatgtttttaaccagaaggaaaaatacaaaaagacagaacataaagtatataaataattgattgcttcagaagatttgcttggagagtttaaaataattagtatctcccctcattatacaatcttcatttctcatttttgggagcccaaattaaggaacaaatccttctaattattatttttttttcttttttccctttttctttccatgttttgaaaatagcagagagtctttgaggggctttcataatggcaatgcccttgctttgcagctggaggcaatgttctctagataagagtgtaataataacatttaatgtgatatacttccttaagtagaacttgattcttgtgtcaaggaccacccttcagataaagaatacacatgatctcacccaggactgtcagaaccccattagaggaggaatatgtagccatcagctatttacccttgtttgcggggagagaagtgagtgagtcatcattgtcactctgctctcacctctgggtcttccatctctgtgtggacggagcaggggtccagaaaaggaacatacaaggacacaaaggaataggcaagtagcctccatggatacagccagctgggtagagactttgggaactggagagctcattccacacgtataaaggtagtctttcttcagccctaagcatttgtgaagggagaatgcttaacttccgtttgccagattttcagtttttaataaaaactggacaaagggaattttattgtatgaaatctccctaagttttaaatgttagttacttacttttttgttttaatactgcaagctgaacaaaacacttgctcagaataaattccaccagtagattgccatagtatgacccctggagcttaaacaatagtgaactctgataactagcaaggtggaaattgggcaaatggctgaggttagttgtttttcctctgggttttgtcttgggttgcagtctgtctccagctctaccaggaagcccaacagaatcacggttgtagcagctgtctgattccttcagagccaaatttgctcaagactaagaacattggcacagaagagaaataaatcctattttttcagcataccgcaaattactttgtacttctgttcttcatctttgtaacctcaagtacagttgtgttgtttttaaaacatactgatatgaacaaatttgccctttcatgaacaaagaaatgtcaaaaactatcaaaagtagctggaattaatatttgccaatgcccaagatgcccttatagtcagtcctctccaagtcatattttagagtgacaatgccagggatagaaaactaaatagaacaatagatagaaggaaggagtttttcatgtcagagttgatcatattaatgaa

SEQ ID NO: 12732 - DNA, 36679 bp, Human
gggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggccccccccaggggaattggtcccagccaagggtctctaggaaagaggcacatcaactagatgtggaacacactccggttttggaagtactggttctgttctccagggcatcagaatcctcctttttgtgaccctgctgccttacaggaaagaaacaacagttgaaacactgggaattttccccaatagggagaaggcacagaaaggagaaagctaaagaagagagtgaaagaggcccaaagagaatggaaaagtgagagcaggccatttgccagggctcattcctgccatccagccccagctcctggctgctcagtggacgcttctgccaatgctcacagccccacaggcctgggcccgggagtctctgctgccacccgtggtttctctccctgttccaccatcggaaccccatgccccaggctctctcccttgaggccacctcagaaggagataccaaggggaagacagctctttaagaagtgtagactccatgttaaattgagaccccgcagacagatacggctttgaaacaattgattttctgtggtgtcatagggaaacctgccctcctcaaagttgcgaaaactgtcagggaccctatgaaatggagcgggagtcacaagttttctacccagctctaaaagaggagacaaaactaacactggttcacaatagataacagaacggcttcagcaaagggcaagcaagcgtagagagatgctggagaagaacaaggcactttatccatgtcccccacagcaccctgcctcagcgccggggcaaaagaatctttgtgtgagcccagggagtcggcagggacatgaggggttgatgcggcacttgctcagagcaatcgcagtgctgccgctggaattatctttctcacacagttcccagtagtggttaaaaggctctgaggtcagtccgcctggcccactagctaagggctcttaagcatttaaggactctttcaacatttgtttctgttagtttctaaaacttggaacagagggccattgatttaactggtataacaacgtgtgggtacattgcacttgttaccttggaaatgcctctactcagtctcacctctgagctgagttagtttgggaagatgttgagcctacaggtagtggggagatggtgagattcaccaaggcatgtgttgtttgtgattgattgggttgggaaagtttcctgactgccaaaacctccatcagacactagccggggattctgtaaatctcagaattccaaggggattggattttgaagaaaggagatgttcacgtacaggctactagaattcttgttctttttttttttttttttttaaagaattctgaagaagaaaataagtaagagatctaaaacagaaccatattttgccaggagggcagagcagggctgctttgttcaatttgttaagagggtcagggaagcatcagaaaagataaggagaaaaatcaatcagaaccaagtcactgttgtgagtttcggcagcgtctgaagtagccagaaggtactgagaaatgtattttatcacatatagtcttattttcaccctaccgtattttctgttaacacaaggttcctttaaagtcaagtatgcagccctaaatcttatcgacccattaatatttcatccaaaacaatgtaacatcttaaactgaaacctaaatgtaagctttggacacaagcattcaaagacaggtatgttgtacagctggactatggtgagtcaagtaacattttcatttctttttttcttttagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcaggtaaagtcttcagcaacctcaggcaggttgcttcatttctttaaacctcagtctcttgggactatggaatggatttaataacagaacctcactggtaatgtcattggaggattaagaaagggcaaaggaacgttgtgagtacggagttctcagggcagcacttagcacatctgaaatactcagggccagaaataaataagttgaaggtaaagaatgtaggaagtattaactcttcaattaggttaaatgatgacttgcctaaactgatgtctgcgccatgactgtgggtgatttgatcaattcactgtctcacttttgcctcttatgactcttaatgacttgctgtaacataatctgtgttttaatttaagaagagatttacctaaagcaatatagagatccgtctcctggctctgtatttatatgaataatactggtggcttccagatctttaagaggtgcctttaagcttgcaaaactctgtggatttagtcccacttctttgagtgggaagacatgtaatttgaaagcacagggctcaaatgaaaggatgtagctgttggctgaaaaattaattggatgaaaagagtatacacataaccctgggtgggagacagcctattaagctgtatctcaggagacttaggtcgtactcctagctccacctaaattggccttgggcaactcaagtgacctgcccaagcctctgctttttcacccataaggtgaagaaggggaggggagtgtaacctctaagtgacctccgaatccaacattcagtgggtctccaggcaacatgtgatgttgctgaagctaaaaagaggaagaagatgaggcaggaagcaacagctaggaggcctggattccagcaccatcactgcctctcaccagcagattaaccttaggcagttttcataacctcattcctcagtttccccacttcctaaatggagataagacctaacccttggaattctatttaaagtgatgtgtttaaatctgacgtgttttatcacaagcgttaaagtttagctacaataatattaataatctaatattattatattagacacaatttgctataatgcttgaaccttgagtaaagacttccaaatcctctccccctgcaaacttgtaatttgtaacagttcattctctaaacctcgtgcatttgattgctttaatcatgttccggccctgcacatggagtgtgtggcttcagtgcagctattgtcattgtgattccttgccagggctgtgctgcaaagctttgtgaagcttagagagaagccaaaattgccctgttgtcagaataacccatttacagacgaaacaatcctctttgttcctcacacatggattcctagaacttgacgcggggcgctgtgagctaagggcacgtatgaagaattcccttttatgaatgttgttaagattacacagcgggctggcttgaacaaaggaaagcattcctaatgctgaaagaagaaaagtaagagtgaaaatacaagaggagaaaagacatgtcagggccacagaggaacagagatctctcagataaattcctccaaatgcccgagtagacaaataccgtgaatgatctttgcaaggcaggagtccttccgctgtcaaagggacccactgcctgaggctgtgagcacctgtggtctgagtcagggccaatagactagtttctaaaacatctagatcctaccttgggccaatatgagttttatgtattattacttaattaggaacttgtttgttaagatctgtgagatatgactgtagggaccaaagagtttttgttcctttactttaaaaaaatcatgctttgagtgtgacaggttttttttttttttttttttttggagacagacagagtctcactcagttgcccatgctggagtacaatggcaccattgcaacctctgcctcctgggtttaagcgattctcctgcctcagcctcctgagtagctgggattacaggcacccgccatcatgcccacttaatttttgtagagacaggatttcaccatgttggccaaactggtcttggactcctaacctcaggtgatccacccgcctaggcctcccaaagtgctaggattacagagtgctaggattacaggattcttttgattgatttatgaaaatgtatatagggaacatatctgtatttgatgttcaaatccaaattctgtaattctgatattatggtaggcctgtgctatgtaacatgagatccatttgcagaaaaatttccacttacacttggagagttcttacccagtgtccagcagatgaagtattaatgcaattgtcattataccaattacaaggacagaaaacagttgaccgggctcggtggctcacatctgtaatcccagcattttgggaggctgaggtgggtggatcatgaggtcaggagttcgagaccagcctgaccaacacggtgaaagcccgtctctactaaaaatacaaaaattagctgggcgtggtggcgcacgcctgtaatcccagctcctcaggaggctgaggcaggagaatcgcttgaacttgggaggcagaggttgcactgagctgagatggtgccactgcaagactctgtctcaaaacaaaacaaaaaaacaacagaaaacagtttacaaactataaggcagaggtttattgaaataatatgattttcctcttttaggtgaataggaacatgagagacaatgtgggttgaggggctggaaggggcagaggacagacgtagaaatgagggaaggttacttaacagcagcctctggttgctcagtgtcagggaggaaaaacttttcctctgtcctcttaagttcagtacctgggggcctgcaaattaagctgataaaagacagattaacaggtgggcagggggaccttatttatatgcatataggagcttgaaaaagaagaaactcagtaagtagttaaagctagaaacttatatgcccagcttagtagggaaaagaggcagtgggggaaaaggcctctataggaggaacagatggatttctagaagaacaaatgagagataaagagtttgtgatagtgcttgttcatgcaggcctgagtgatctctgtatctcattcatggccataaaacttccctggagagaggacttacggtaggtttcttgatcatcttcctgggagtaaaagccacccgtaagagggaggtatggcagcctcatttttccagaagtctctgctttttgtcagataaaggaagcaccaagaaggcttctttctgcacctattgaatccccagtggcttcagtttaaaatgagttccataccaactcgggttctaagtgcatccctcacatcagcaattgcactctggtttcgtgagcctaaggtcatcattctgaatttggactttacggttttgcacttttctggtaatatttcatgtttgactagaataagattccttgctatcagatatttaaaaacaaaacagtatatacacaaaaatgcctttctacctgtaaataacgtgaggtacttgagtctgtgtagggttaggatggaaagaaaataacatgagagctcgtgagtcctggcttgactagaggacatttggaagtagattatctcatctggtgccttggaagtttattcctcaacaagcagcaatgggtctcctggaagcttttttagaaatgcagaatctcaggcccctccccatactgactaaatcagcattcgtgttttttagcatggttcccaggtgacttaccactgcaatttaaaagctctaatcttgtatagtgcttctcaatctgggaagcactttaaaactacctggggagctttttaaaacccaaaactacctggggagctttttaaaaccctgatgtcaagactatacttctgtcagaggtgtctgaaccagagcaactccatctcgaataggggctgggtaaaataaagctgagacctactgaaaactggttgcagtaaagaagccagctaaaaccatcaaaaccaagatggcaatgagattgacttctggtcatcctcactgctacactcccatcagcaccatgacagcttataaatgccatagcaatgtcaggaagttaccctatagggcctaaaaaaaggggaggcatgaatgatccaccccttgtttagcatataatcaagaaataaccataaaaatgggcaaccagcagcccttggggctgctctgtctgtggtgtagctattcttttattcctttttgttttattattatactttaagttttagggtacatgtgcacattgtgcaggttagttacatatgtatacatgtgccatgctggtacgctgcacccactaactcatcatctagcattaggtatatctcccagtgctatccctcccccctccccccaccccacaatagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctagaaaggacatgaactcatcattttttatggctgcacagtagtccatggtgtatatgtgccacattttcttaatccagtctatcattgttggacatttgggttggttccaagtctttgcaattgtgaatagtggaggaggagaggtgctctgctttttagagtttccagtttttctgctctgttttttccctatctttgtggttttatctacttttggtctttgatgatggtgatgtacagatgggtttttggtgtggttgtcctttctgtttgttagttttccttctaacagacaggaccctcagctgcaggtctgttggagtttgctagaggtccactccagaccctgtttgcctgggtatctgcagcggtgtttgcagaacagcggtttttcgtgaactgcgaatgctgccatctgatcgttcctctggaagttttgtctcagaggagtacccggccgtgtgaagtgtcagtctgcccctactggggggtgcctcccagttaggctgctcaggggtcaggggtcagagacccacttgaggaggcagtctgcccattctcagatctccagctgcgtgctgggagaaccactgctcttttcaaagctcagatggaaatgcagaaatcacccatcttctgcgtcgctcatgctgggagctgtagactggagctgttcctattcagccatcttggctcctcctattcttttattcctttactttcccaattgatacagtttgactatgtccccacccaaatctcatcttgaattcccatgtgttgtgggagggacctggtgggaggtaattgaatcatgggggcaggtctttccatgctgttgtcgtgacagtgaataagtctcacaagatctgatggttttataaaggggagtttccctgcacaagctctctctttgcctgctgccatccatgtaagacatgacttgctcctccttgccttccaccatgattgtgaggcctcgccagccgtgtggaactgggagtccattaaacctctttcctgtataaattacccagtctcaggtatgtgtttattagcagcatgaaaacaaactaatacactaataaacttgctttcactttactctatggatgcaccctaaattcttggatcttgcgtgagatccaagaaccctctcttggggtttggatcaggaaccctttctagtaacacttccatgcaccatttctatagtttcttaccagagaagtttctctgaacatgtggagcaccggaaaccacgaggaggcggctcagcattcactcctgagcatgaagctggctcttggtggtgcttctctgcaattgccttttgctgctgatgatcactcttctcttcctttgggagagtgaaagggaaaggaagccatctgaagggtcttcatggttattttttaaaaagaaaaatcccaatatctagtactaaacccctgacggaccaaatcagaccctcggggggataggagggacacaggtgtgtgtgatgtaaacccccctccccaggagtgtccagtgtgtgaccaaggtcaagaatcactcaccaaatgaaagaagggtccctttggtaagtgcatcaaaataaggttaccaaaagaaaaaactgaatacccaaatactgcccaaaacatggtttatgaaaaacaataaagccgttaggtggttaaatcacaaatagtaaaggctgtaccatcaagcttgcaaagagaccaggctctccggccattttataaggaagctcactcagaggagatgtttttacctaaacttgaggagaactgatctgcctgtttgcaactggaaagcagacttgaaacaaacaaatgaacaataaatttgcagtgtggggcaggactcggtggctccagtgaaagcacctcattatgaggaagatgtgaaattattactgtgttttgaattggctgctaacctactctgaaagatagaaaaagatgctgctttaaaatgagggctgtgcttttctgaaaatacagcaggtgccttgctgtgaagagtaaggaatcatatggccttatggttaaagggatcttggcaaaccagggctactcaatccatacctataccaggatgtttgcatacctataccaggatgtttgttttgcaggaacttggtgttagaatggaaattagaattgaagacatctacccataggtctggtgatctttctgctcccatacctgtctttctactgtctgagatcatagtaaatgataaaaacagaaaataggttctaaggtatgctggctttagtaataagattctttttctcatctgtaacactactgttacacttctataacaaacactatttgttacctctccaatgtcctttgggctctatcagtgttttctaaaatgagggacatttatgttggtcaggttgtgcactgcacaactataacagatgtcatttgtagtgcagtctctggcttctggagcagtgcagcatgtagcctagatagggggtcgccattatgggaagcaaatagacatggcctcgtgtaacatacaaagcaagtcatttcctgttcatttgtctttcagtccttctgattttataaagagaaagtctctatttggttctggcacgcttttaacacctctcccatgattgtattttaccttataataaagagagaacaggcttctggttagtgcctcacaggcaatagaattactcagtagggatgtaaagttttatcaatagatttatataaataagaaatttaaccaattttgtgaaaataagtaaataaataatacttggattttacagtatatgtcaagaaaaatatgaaggtgattttcacatgattggagtttgggaaacactgggcagtagagaaagatcaccccaagcgctagggcctagcatggggctttaagaacacatttttatagggggatgaggtaaacaaaagacttacacattatgatttaagttgacttgatttaaaacaattctgctctattggaaacatccaatctttttttcttctagttatttccctctttgataataagtacagcctgtttctaaaccattatatggtccttaggaatatttttagaacagtagttacaaggtagaaaaagtaacccccagccctgagttaaggtttattttaaggtcacagaatgccaggcaattgccgtgatttacctctcagaattatggactctgttgtgtttcttcctttttgtctaatttagggaatcttatttgcttggaatgaaaaggatttgccagcaggaagacagccacagatggcagtgcacattctgtaaaatacaaaaacaaaacaaacaccagaaaaaataaatccaagagtctgatcccataaatttctgcactaaggagcaactccaaactgcacaccaagctgctttaaaaggcgtttgtgttaagccttagagtgttttatcacattcgtgatatttgatacagaatacgtcagaccaaaagccacatcctaggatcttctttaaaatatcattaaaatagatgaagcattttaagatgtaaagtttcatttcctaagggatcctctagttgtaaagattgcagctagttgttgttgttattattatttgagatggagtctcgctctgtcactaggctggagtgtagaggcgtgatctcggctcactgcaacctccacctccggggtacaagcaattctactgcctcggcctcctgagtagctgggactacaggcacgcaccaccacacccagctaatttttgtgtttttagtagagacggggtttcaccatgttggccaggatggtctcgatctcttgacctcgtgatccgcccgcctcagcctcccaaagtgctgggattacaggcatgagccactgcgcctggccacagctagttattttaaaggacttctagtaggtccaggctagattctcagcaaagtttgcatggtatgtgatgtgtggtgcatctcaccccagaaaggacctgggagtccttctgtaaattgctagcaggtgaattcacagcatccactgtaaccttaagttatctggttctctgccctaacgctaacctgcatctgacactgggaggtccttgaccaggaattctcacagctcctccaacagggaagtgggtaggagatggaaaattcagaagcaggagtggagggaagggagttaacacccaattctccacctcccccagaaccaaggccaggattgtcaagaatccagggttcagaatcccctgccaagctggtccagtggattcactcaggttggcagagtggctgaaaaccagccctcttaggcacgtgggtcttctcccagatatattaggaactagatggaacttggcacttgggatcactcagtgtaacaaccccatacccccattagacttgagtatacccagcactgagctaggaactcaggcttcccgtcaccacatcggacactttaccactggccacagattggtttctgaagacctcttacctccatcgttatgacttctaagttgatttctgtctatattccaagtttcctttctatcatctggccataaaatatttttatatcttcatgtgcaaagagttatggatataaagaactttttaaaattacatatatcatctattctgttttctacctaactacaagctgatcattggttttctttaccacctgcaagcacttaaaagtaatcattcctgctcttataattacatcttaattatttctgaacagatcccttttctctccttatgctaagactgcatgattaatgcatttttatctctcacactcagtctttttattatgttatttgtctttttccctcttcagtcaccaacacagttcacacttaatcgtgtgaagaaaaactatcatcccttgcttgctaatgtgcattttcctgcaaagatccaaattccacttttcctgcaaaaacaccaagcgcatttatgtatctcaaatcaactatggtattagtcttacctatttttgcctggtcattttagttgtatcccaccttttgtttctacagtgttttcatagaaaatcagtttctacagtgttttcatagaaaatcacattgtatccatgattttgttgagtcaaaggatatgtgtgtttttaattttgatactactacaaaccatcctctaatgatataatccgattgacagtccagcaatctatgaataccttttccccacatcctcaccaaaacagtgcatcatattattcttttaaatgtggctgttctatatgaaaaataaaattttcttgttatagtttgtatttcattaattatgagttgggttaagtatctttgcatatgtttatatatcatttatatttatttttccataaactccctctttatattctttgctccaataattatttatatctttatattctttcctattgatttataagtattcttaatatattaagtaaattagtatttttaatgttttccttgtttcatctcaatttttttgaatttatgggatttttttttccatgtaaaagttactaaattttacatggtgaaatgtaaagtgttttatggcttttgggttttgtgacataccttctccatttagaacttattttttaaattattccatgttttttataataattttgtgttttatttgtaagttctacgtattttcttccctggaaatttatttgggtggaaggtggaaggtaaaaatctcactttattttttcccaaatggcccactgttccagccccattggttgaggctccatcctctccacctttaccatcttctaaattcccttcatttctgagtccctactggactctctggtctattacattgatatgatgccttgtgacatgggagcaaactgcagtacttatcattgagcttttattatcacatttagtggctcatagagctaatttccctttttttctgagttttttttcccagaattttcctgttcatccttgcacatttgcttttcccatgtggatttgagaattttaatcattttattggaattgtttaaaatttttactgggattaaggtttatgtataagttcattacctggtgatgcccagttacaccatgcgtgtcttctccatctctctccaagttgcgaaatgattcagataagtgtcatccagattttaatgtgcttagaatcacctgggggaaattagcaaatgcagattcagctggtcaaacatgggattagagattctgcatttccaacaagctcccaggtgctgctgatgcagcgggtccctggaacacactgggagtggcaaggagataagcagccttgaggcactgcctctggtagatttcataggtttcccctggaaaaccacttgagcccactgcttcttgtgggagcagatctttgacaactctctcaagttattttatgataatctgtctaattagattttctttctcatctaggataatacccgttattttatctttttctagaaattcgtgcatttaacctaggttttcaaactcattactgtggagttgaacagaaacttgttaataatttaatttccattccctttttcgtgttttttatattgaatgtttctgttgaccccccccccttattgattagattatgtggcttttttttttttcttttctcaaagaaccagctcttagatttatttgtcaattctttgttttctttctactgtcgtgtcttctttaaatttatatttgctggcctctaactttctaatttgaatgtttggctctctctcttattttccttcttggtggggtgtgtgtatcatggtcttataagaatgtgaaccgaagtcaacaaatcttaaactccagccatgctctcttctgaccacacctctgctgccccagccccgcctccaggactgcaccctccagatgtaattgacaccaatggcttgcactagactttttgctaagggacctgaaaagaacttagaggctggcgtaagttgccaaagccttcccacatcactgagagaatagacttggcaggcttgtgttttgaaaagcagttgggggtgcgctctgtcaaggctcagccatgatgaagaaataatcaaagagcaaaacgtcacttaagtggctaaacatgactggcagcagggttggattccccttcagcatcgaacacctcacaggccatcctctgtgtagacgggctgctttctagtggctccacaggcctggccgtgtcaggggctgcctttattcaaagacttctgttctgtcttaaccaggatcacttaactctctgaaactccagtgataaaaaagcaaaaccggcacaaacatacagctttggaactatctccaaggtcattgttttttcccctgccgcgaatttctttcattcctaattttcctctacctttctttcccttcatcccctacgatagattttgaaccccagggaggttaggactctgtcccgttcttctccctgggctgtccaccctccgacccccaccccacctggcatggcactcaaaggtgcattttcctggggtctgtgcatggaaatcattgcagctgtcagcctgtgtcacgtggggctggctaagtgcggggcaacgcggttgtacatgttgccatggtgacttctctgttgatggcagaaccactgactccagcaagtcacagtattcatttttgcgtcatgctcgtgctacaggaatgctatgagtagcccatgaaaatggaggcgagttgagctcagtgttatcccttgacttgtgtgtctttccttacccccagcgatcccccattcagatgcttcctactgtaccgcatttttgagtattcttcagtatcatgcttctgttacagcaccatatcactcagctatggaagcactcagaggagcacaacaccctctaaattatccgccatcacttcttttacggcctcatttaaaaagacaattgtcagaattcccaggtgtgaattctcacaggggaatctctgtcagtcaccacctggaaatgttagttccacctctgctggccaatcagcacctcatgtccttgctatgatctctacagttgcagaagcattatcctgatgaggtttttaacacatcaccacatgcttttcagagaaaagtccttttataaataccaataactaaacatgataaattgcttcactcctttgagatctttgtctgattccacgtgctctgcatagactattcagaaattctaaagacggatgcagattcctaattctgctgttgagtttgttcctgagagcaacgctgaaagacttttaaaaaattaaaatcagctttatgttgaaatgtaattgtacataaatagccatatgaatgtggggtacagttattttaaacatagaaaataagatgaattgttttggaaattcccctttaaacatgctaaaatgattttcaatcattgacgggaattttaacttttagaaaactggaaaggatacagacaaaagtagtgataacttaaatttgtaaactattttatttgttgaaatgctttaatgcatgattttgttttatcctggaatggccacatgtggtaggcaaagtggacattatcagccacattttaaagataaggaaaatgcagctcagagaaaataaatgtattcattccctcagcaaacactgactgggtggccacagaagtgcggtgcacaaccctggctgcacatcagtcacctggggagcttttcacaaatcccaatgcctgttccccatcccagaggattcctggtgtgcatcaggattgtgaagcaatggggactgagtttatagcaccttactctaaagtatgcagagactagcattatgaagtggaaaatgcatatatttcagattcagttatttttttcccactattccttcctctcaatgaaaattttggagtaaaacatataattccagttctttattctgaactgtcttactattttctatcaccctttaaatataatgcagaagtctggaaggatatgtaatttgcatacctgttggtgaaatccctgctactaaatacactttgctttttcttgttccacattccccttttcgacagggaataaatcatccccaaggctgctagagccaattaaatattttttcacactccgttgacatgaatgagaagaactgtgacagagccacacggctcatgccaggactttatcacgctatctttataatgatgtgagccaggcaccagggaggaatggtgtggggaaccatcaggaagctttaataaccaaggataatttgtttcatcagtttctccttgatggccatttgccatttcacctgtcaggaagcaaaactagttgtcttgtgagatctcaggttaactcaagaagagaacagctcagacaacaatggaagcatatttagcatggagcttttatactcagttctctgaagtcagccttcttggaagaaaatacattgtcttgggattggaattataaatttcccttgtgctaatgcaaccgaaaagagtatttcaaaaccaagagccgaactgggcattcataaaagacttaaaatatgtgtagaattaatttttaaaagcactttaggtttgcccatgccccccttctaaccgcacagtggagacagaatctggtcagctgtctgtggtctgggtgactccaccatgttctcagcaacgctcctcatctatgtattatactagtttctgaaaacttaagaataaaaaggatcaacctcacattttgatgaaatagcagttacaacacaaacatcccatgcctattggcagaactggtccacagagcgcagaagcacattcatcgtgtaaagctgaaaacagcgtcttctgcaagttgagataccgaggttccagcagaagataaaaagcatttaaaaatatttaattattcactgaactcctttgaaagacacaggatgacaaagcagatcaataatattcagccatttccaaagggtccatccacagccaaagtatggcctttgaatttactagaaatttccacagagggagagtaaaaggaatcccttcatccttgcttgagtcctaaaataacatgcgcctaagtattctcacaaatgatgaagcgcatctcttgagtagacttaaggtgataaaatgttattttcactgagctcccaagccatacatcatggaagtccaaagcccttactgataattgcataatgcccaggggatgtgtttctctgcagaagtctgaagacaatagatccagggtctcctgaagactttcatcttatgaattgtgcgaatccctgaccactgcctaagaggaaaggtgaaatacatcagagaatgtccttaaaaatatccctttttgacttactataattggttgctttcctcttttaactatcataattttctcagccaccctctccctagaaactggggctatttctatgactcagcaaacaaccaattcttgctaatactgctttgctaataaggaaaccacaagttctcttagctgagactcctgtatagcaggtgtgttcacaaaacttggtgagcacccatatctgagacacagcattccataaagccagaggcagtcaccgaggctgtctgacataccataatatgcccgtatggcttcaggctttccaccctgatctggctgtatcccgcattgcacccatgcagcagcagaaccagcagtaagaatgttttgtcaaaaaacaaatccataaacttcaaaaaaatccacggtacagtatttttaaaaatacgtctagccaggcgcagtggcacgtgcctatagtcccagctacatgagtccaggagttcaagatcagcctgagcaacatagcaagaccctgtctctaaaaagaaaattttaaaatgcatctgttctctctcatatatgcctttaaacgcatccatagcatcaagaacctaaatgccaacatcccaatatttttcctccctgataaacttgctttagagattcaacttgtatttttgctttgaaccaggaaaggtatccaaggtcatactaagataaccatttattaaactctttggctgttttttcctaaactgtaataaactccccctctccaacattcaaaataatagtaaataattctctctgaaattaacacagtgttcctattattgctttcacaacactaaaaagaaatagaactaacggagtcgaactgtggggcattctggcaggcaaatcattaaattcacacaaatgattcggccaagggaaaaaggacaaggttctcagaaggaattatttcagctccctctcagacactgctttaaattaaaacacacacacacacgagcagctgaagacctgagtcaccaatggtctacattaaatttctgcaactgaaagtcaggcaggtattcaagcactctgggagcctgttagaaatacagatgcccaggtcccccacccgagaccaactcaggcagaagcagcatttttaccagagctcagggcatccgtatgccccttaatgtttgaaaggtctgaatcagagtgctctcccccaaaggcatctcagactgagatagaaattgaagaaaaagcctaaggaggttcagcaactttttcaaggccgaagaacccaccagttacacaagtgcagagccctttgtccctgacattcagagccctgcatgcataggaagtgacagccccttccggggcaccctgctgccgccacgcgcattctggaaactgtgcagcaggagaaacagcgttttccttcagaccggggtttaaatggcacttcccgaatttatattcccctagatttggggcttcttccttcttgcactcctgttaacatcagcatgaattcataaactccctgcagcggaaaggaaaagaagccgcgacaaacctcaacgaagagccgtacggcactgttaaccaagtgctccagtcctgccccagtgtttacaggaaattggttccaggacccccaaagacacccaaatccacagatcctcaagtttctgatagcaaatagtgtggtaaatacctacatataacctacacacaccctcccatatactttaaattgtctcttgtagattacttgtaatacctaatacaacataaatgctatgtaaagagttgttggccaggcacagtggctcacgcctgtaatccaagcactttgggaggctgaggcaagcagatcacgaggtcaggagttcgagaccagcctaaccaacatggtgaaacccaatctctactaaaaatacaaaaattagccgggcatggtggcgcatgcctgtaatttcagctactcaggaggctgaggcaggagaatcacttgaacccaggaagcagaggttgcagtgagctgagattgtgccactacactccagcctgggcgacagagtgagactccgcctcaaaaaaaaaaaaaagatttgttatgctggattgtttagggaacaatgacaagaaaaaaatatctgtacgtgttcagtacagctgaaactttttttcccgaatatttttgatctgagtttggttgaatccacagttggggaacccgtggatgtggagggccagctggatagctgctcctggcagtgaggctctctgatccagactttcaaggttcaccctgagaactacagtaagatacatgagagagtcctgaatgaggagtcgaaagacctcgtcctcgtagcagcgactctggcacccaccaaccatgtggctttcacctaattatcatccattctgcatttttgcctccttaactgtagagaggttgtggaactacagaatctataaaggccagctgtcacaatcaatactttacaagtgcccacaatattttacaataactttgaccattgatttataaacaattataaccaaacattaggactggaacaatttgcccacctgagaaataacaagacatttatctcacatgaaaatggacaccaaataccttaccttcgtgtttattttatgaaatacaaaatctgagcatatattaataatgagctatttttttcttttttcttttttttttgagatggagtcttgctcttttgcccaggctggagtgcagtggcacaatctcggctcactgcaatctccgcttcccgggttcatgctattctcctgcctcagcctcccgagtagctaggactacaggcacccaccaccacacccagctacttttttgtatttttagtagagacggggtttcaccgtgttaaccaggatggtctcgatctcccgacctcatgatctgtctgcctcagcctcccaaagtgctaggattacaggcgtgagccactgtgcccggcctaatgagctattttcaattaaaatacctctttatcgttaatcagacaaaagagtacaatgtcagcctactctgagagcattaagaaatctttttcctgaaaggcaattgagacaattcagaagttaactaagtaactgatggaaagagggagtacaatggaatcaattgcccactcagtcctttcatataaaagttggtttaaacaatcataacatatagccgatgacgacaaatttgtttattctgtttctcttcactcgacctcttttggtcactggatcttggacaatcatgaaagcagctgccactttctcattcctttaagaagctggaaatgtaaagcttgtttaacttttcaagtcaggagccaaaaagtcacaatcaccttcccctgtttgaaattggaaatgctggctggctactttttttttagaaactaggaagtgaagggtagagagagaaatgtgaaactcaggatcatgtcagtacatgccacataatgctctgcctacggaaaaacctgctgacttagagaaatcgctccctcccaaaaatgtgattagcagggatcctctcttaaaataaaacaatgtcccttatatcttcagcatcttagtcgataaccatttgttttcatatctgtttcagaaatatcaatagtgaatggctaaaaacattatttaagaaaaacaatcattttctgctatataactcagatttgaaaacagaataaaatgtaataaaacaaagaagctaagaacaaaggcagagatacctcatctcgcccggacccactgtaaaaataatgttgcaatttaaattaaattataattaatagcagcagttttgttgaagtgtctcaaattattactttagatgctgaaactccagtggtttccatggagatattttctctaggagatgtcagatatgatctaatttttttgtctctgatatatgacaacctgaagcttccagagcctttcattttggggggttttatgttagatatttcaatttatttttatatgcacttcaatatgttttgtttgcaattggtttctgagcctaaatattttgaaacttagtaaataagaaccacaaccaccaaatttatcttctgtagttaaaaaaaaaaaaaaactttactctctccttattcactaggacagacaaacatacttctccttgggtgaggagcatagtagtgcatatgtgtgtgggcgctaaagccttagccaggatgtttactaagtacgttcctgggagaagactctcccatcatcaattcctccagcaatatgtcctgcctggcctgtgctcggtggaggaggggaggagagctaatctctgagtggtgcaatggaaacatggtctacaaatataggaacacggatgactacacacaagggcacgtgcaagggaaatatgcagaaatatgtgggcttttataagactctaaatcagactggaatggcaccatgctttggtggttaacatggagtgtcatttggggatccgcaagagaagtatgttgaatagagtctgtgcttatttgatgaaagactggtcttgagaatgttatagctagtctgttttaaattaacacgccaaatttggacctactcactgtttcccaaagtataggttccttgatactccaacaccactaaaattgttcagctctcccagcaagctgggtgaggggaacgtggatgttagcagtagaataggtgagctttattatccatgtctcagtcatgtttcttggtctccgtttttctctgtgcgcatttccaagaggatgtttgttcccaggggaaaggtcagtggcaataaaatgtatctatcaaaatagcaattgtgttgatcgccagaataaaatggctttgcctcaagggggtaagcactcacatgcattaggacaaccaggcttacagcataaataaatccaggaaaataggagtgctcacactaaacaaacaaaagattttgcccttgaaatgtataaggattcctgacctgaggattttctacaagttattttctaacaataaccaaagtccagcggactaggagtcactaatatattttctatattcaatatgtccatctcctttgttaggaagaataagaaacctgcctcactgtaaggatttagttgagactaggcatctgactttcaaaattctacctgcatagaaggttttgttatcagaagaagctaccgatgtttacatacctcttaatcaactgattttaattatgccagccaatgaacatccatttagcccttgctactgcattgttagtcactggaactgcaaacatgattaagattggtctctgacttgaagaggatgactgtcatgtaagaagtcacaagaattaagattattcccattgagaaaagggacacacagtctgaggtcgctgaggatactttcaggaaagtggtaagatctgatggacaaagaaaaggatagtaaaccagatgtccagacagagtgccatatggcagagaaaaggtgtgtcaactggaggcatcaggaactcctatgagacgggagagttccctagaccccttcactggacttgcaacagggtacagctcactcaaaccttttgcgggacggcgagcacacaggcaagtgggtgccaccgctggggtgaacgcttttggtctccagccccacagcagcgtctacggggtatgttacaattaatgctgttttaacagttactgtctggggatggctaagtgttaaccagctcattggagacagggtgacagacttttaccccctgccctcttggtacccaggtccttgtctggcatccaggaagaatcaggtcacacagttttattgagtgatggaggtggctctcagtgggatggggagctggaaagggatgaaatgggaagataattctcttcagtcatcctcagcgaaactgctttccaactgtccagttacctcttcaacattcagatgctgcttctcctcttgatgttcagccgcttgttctcttctctcctctgccacactgctctgctcctctgccagtggagcttggggtttttatggttacaggactggggggcatggcaggccaggctggttttggaaaaagcagcatttgggtgggaaaacagggctgtgaatttctcatttagggctgtgggctcaggtttgtgtgtggaacccttgccagggactccaccctcttctacccagtatttccctgcctcctgtccatatcacctatacctagaatgttgagttggaaaagtgaccccaggaaggaaggggcaggagagaaatccagctcaagggagtctttcttccctatgccaaggagttcagatttacacccaaaacaatcgtggaatatttttaaatgttcctccctagctcttgtcattctccttgcgtcatctcaggtaactccttccactatctccgtatgttctgctactgtttttatccgtaacctcaagggaaccagattaccattgtaattttttttttttttttttttttgagacggagtctcgctctgtcgccagggtggagtgcagtggtgcaatctcggctcgctacaacctccgcctcccaggttcaagcggttcaagcaattctcctgcttcagccctcctgagtagctgggactacaggcacgtgccaccatgcacagctaatttttttttttttttttttttttttttttttttgagacagtctcgctctgtcaccaggctggagtgcagtggcacaatctcagctcactgcaacctctgcctcccaggttcaagtgattctcctgcctcagcctcccgagtagctgggactacaggcgcacgccatcatgcccagctaatttttgtatttttagtagagacggggtttcaccatgttggccaggatggtctcgatctcttgacctcatgatccacttgccttggactcaccgtgcctggcctaccattgtaattttttatcactatatttaatatatttcgaaggtacatattatttaaagaaggtcggccgggcgcggtggctcacgcctgtaatcccagcactttaagaggccaagaccggcagatcacgaggtcaggagatcgagaccatcttggataacacggtgaaaccccgtttctactaaaaatacaaaaaattagccgggcatgttggcgggcgcctgtagtcccagctactcgggaggctgaggcaggagaatggcgtgaacccaggaggcagagcttgcagtgagctgagatcgcgccactgcactccaacctgggggacacagcgagactccatctcaaaaaataaagaaagaaagaaataaagaaggtcatgacggggcaggggataagggaagacaaagaaaaaggaggtcaggaaatttctgcgtttatcaaaaggagacaggaaatatcactcactcacaaagtatccaaatatctagtaaatatctccacctgggtgccccattagcacctccaactcaatatgtccaatacaaaactaattaattcctcatcacctaaaagggctcctcctcccatagtcccaacccaagccaaactgtctgcaagctgggacttcctcaacccttcaactccttgtccctttctagccttcaaaaggcagggtagagaagattgttgactttggaacgaaccctacacctgggttctaattttaactagactattcacaagcttagtgactttctagaaggatatggactaaatagtgtccagagaagagtaattataatgtcaaaaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataattgaaaccacatccatgcttcagtatataatctaaagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataattttaggactaatcttatatctgatgataagcctaataaatgaaagatctttgcattcttgggctgacatttgggattgggaatattaatccacactacctaccccagaaaatcctgaagggaaatgggaaagtgagctgatgagaaagtagctgactacactgtactacatgttggctctccccatttccctgcctagctaactggatttaggattggaccaattggccgggcatggtggctcacacctgtaatcccagcactttgaaaggccaaggtgggaggatcgtttgagcccaggaattcaagaccagcttgggcaacatagggaaaccccatctctacaaaaaataaaaaaatttgccaggtgtgatagtgcatggctgtggtcccagctactcaggagtctgaggcaggaggaacacttgagcctgggaggtccaggctgcagtgagccatgattgtgccactgcactccagcctggtcaacacagcaagaccaaatcttaaaaaaaaaaaaaaaaaaaaaaggattgagccagttaaaacaagcaaaaaccatcagtggtctcttttgcatcccccagttaaagacttggggaatatgaaatccttgaatacccaagagttaagttcactttcatttgtagcttgcttagtgtctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcgtggtggcaggtgcctgtaatcccagctacttgggaggctgaggcaggagaatcacctgagcctgcaaggcagcagttgcagcaagccaagatcacaccactgcactcactccagcctggacaacagagtgagaccctttccccacactgcccccgccccacacacacacaaaaaaagaatatcaagtctaaaagagaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgccgacttgcagatggacttcgggatctatttgcctttaccgggcttaaaatttgttttatcttagagaaatacctaaatttaacacaactgattcttacgtttataatagggaaagaaatagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgccaccagttgtgcatggggttaaaagtggatgggaagcagatttcaaccaaatgtaagaaacatattcaaatgcataaactcgtctgtctgtggaactagagcaggccagctcaggtagctctaggattctctaatattgctccaagtgggaagtcgtgtttacctaggccttgtgcaaagagaaacagcaggaacagggatggaggctgttgtgattcttgtgggagacaatggcaagacgggtccatctgaaatggagatttcatttgggaaaacaggaagtgttgaagagttgcatgaagaaataggtatcaaattatttgggatcaatagtatacttgactctgacacttgactctttctttctctacagccagtgcggattttccatataatccaggacaaggccaagctataagaaatggagtcaacagaaactcggctatcattggaggtaggtgatgtctagaggaggcttatatggggctactcaactatggaaagtaatagttgtcaataacatagtagtctaggaaaaaaagttttctaggtttttacattattcattttgctgtttaaagattatgacatatgatgtgaagaaatatagtaaatatagccgggcacagtggctcacctctgttgtcctagcactttgggaggccgaggtgggcagatcacctgaggtcaggaattcgagaccagcctagccaacatggcaaaaccccatatctactaaaaatacaaaaattagctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcagtggcgggcgcctgtagtcccagctactcaggaggctgaggcaggagaatggcgtgaacctgggaggcggagcttgcagtgagccaagattgtgccactgcaatccggcctgggctaaagagcgggactccgtctcaaaaaaaaaaaaaaaaaagaaagaaagaatatagtaaatgtaacctggctactttttaatgctggcttgtaaaaaacaaatagcagtggaaagctggacagactcagaataattaagtaggtagtagtgaccatagccaggacatttctttatccccctcggatatttttcagtcttatcctttcgcatccaaaatggtccaggatagcgtactataaaaaaatgaaaaggaatgctgggtgcagtgacttacgcctgtaatcccagcacttcgggaggccgaggcaggtggatcatttgaggtcaggagttcaagaccagcctggccaacatggtgaaaccccatctctaaaaatacaaaagttagccaggcgtggtggcgcattcctgtaatcccagctactcgggagcctgagacaagagaattgcttgagcctgggaggtagaggttgcagtgagctgagatcacaccactgtactccagtctaggtgacagattgagacctttctcaaaaaaaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagctaaaagatttacacacatggaggtagaaagaaaaacacgtaacagagattgggaaagttgagcaggaggaggaaggagaatgaagagaagtgggttacagggtgcaaacatacagtaagaaagataaaaggaacaagttccgggtttgctagcagggtaggatgactatatctaacaaaaatgtactgtacttggttgatgaacccctaaatactatgacttgaccactattccttatatacgtgtaacaaattttctcatgtaccccgtaaatttgcacaatgaaaataataaaaactaaaaatgtatcagaagatttaacaagctgtagcatctaaaatattccagtgttttcttctcaccatggacagctacataataatttgactctcctcggatagccactgagcctcatgcgtagatcgatattgacatccctgttaccattaagatcccaatcctcactgtcttttgcttttttaaatgaacttaattgaagtataatacgcatctataagtgtaacaagtccgtaacttttatttattattattttttgagacagagtctcactttctgttgcccaggctggagtgcagtggcgtgatctcagttcactgcaatctctgcctcccgggttcaagcgattctcctgcttcagcctcctgagtagctggaactacaggcacgcatcaccatgcctggctaatttttgtatttttagtagagacaggattgtaccatgttggccaggctggtctccaactcctgacctcaagtgatccactcgcctcagcctcccaaagtgctgggattataggtgtgagccaccgtgcccggccccaatcttttttatagtttgtggttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtggcgcacgcctgtaatcccagcactttgagaggccaagacaggttcattagaacatcttaacgatatttagtatttctatctttacatggtgtatctatacgtttatttgtctcatcagtttctctcagcaacgtattgtggttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctagacaagcattttatctgagaataatgagatttttttacttgtttctttccagtctatatccttttgttgtttcattgcaccgggtaggattttcagtacaaaagtgaataaatattgagatttgacaattttgcattgttccctatgttaggggaatgtgtttgatctttcactatgaaataggatattggccgtaggtttccaacagatgtcctttatcagattgagaaagtttcttctactcatagtttactgaaagctgtttgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataatacatgatcttttttacatattgctgggtttgatttgctaaaattctatttaaaagaatattgtggccaggcgtagcagctcacgcctataatcccagcactttgggaggccgaggcaggtggattacctgaggtcaggagttcaggaccagcctagccaacacagtgaaaccccgtctctactaaaaatataaaaatcagctgggcgtactggtgggcgcctgtaagcccagctactcgggaggctgagacaggagaattgcttgaacctgggaggctgaggttacagtaagcccagatcgtgccattgcactccagcctgggcaacaagagtgaaactccgtctcaaaaaaaaaaaaaaaaaaaaatatatatatatatatatatatatatatattgctccatagttttcttgtaacatttttctggttttagtgtcaggataatgctggtctcataaaatgaattgagtagtgttttctcctcctatattttaagaaagatgtgtaggattggtctaatatcattaggtaatgcttgttagtagtattgttcgagtcttttaaatttttgctgattttctgttcaattgttctatcagttactgacagaacagtgttaaaaaatctccaactataattgcaaattggtctaattgtcctaccagttctgcccgtttttgcttcatttattttgtacttaggttagatttatacacattaggaacattatgtcttcctgatgaattcacccttttgtcattatgaaatgttcttcatttctactaacaaccttgtcctttgtctcatattaacgtagctattccagcttatgattattgtttgcatatcttttcccacccttttactgttgacctgtatttaaagttcatgtcttgtagatatcatatagtaggcatcttttttatccactgtctctactttttaattggagtgtttagatcagttatatttacttctgttttatctaatctgtattatttcatccagtatttttttctttttccattttttttttttagacagagtccccccccccctcacacaagctggagtgcagtggcacgatcttggctcactgcagcctccgcctcccaggttcaagcgattctcacgcctcagcatcttggctagctgggatcacaggagcgtgccaccatgcctggctgatttttgtacttttagtataaaagaccgggtttcaccatgttgcccaggctggtcttaaactcctgacctcaagtaatccgcccgcctcagcctcccaaagtgctgggattacaggcgcgagccactgctcatttcagacattgtgtgtttcacctctacaagttccacgttgtctcattttttttcccctcattttgatcatgttttcctttaaacccctgtgcaggtttctaatagctattgtactgtcctcatctgctcattccatgctctgtcctttctgtttctaatagctattgtactgtcctcatctgctcattccatgctctgtcctttctggctctccttctaattgactgatgtttcttctggtcaagtgacattttgctacattttttttctctgaattatttttctctgcagcttgacgttatttagatgtgttttaaagctttttcaggacagagctagagtagtctttattctaggcctattttagcaaacaccttcagcatgaccattctatcaactgtattaaatgctctgattgttcaatgaggtctcttcagtgtggttgttggactataaacatctcccagccctccgtgagctctggttttttgcctggcctgtggacttttattctgtacatgcacatgttagtattattcggccacaaattcagagagacttatgtgcagattattagggttctttctatacatagctctctcgcgcgcccactctatctcccctctccattcagggaaaccactgtgctttcttgtgctgcccctccctacactgctgtccaaaaatcgctgccagccagaaaactaggaaaaatgtaggattcctcctttttgtttctctgttctcagacatcatggttcctttccgcctgttttctaatgtctgtagactgtcatttcatagactgtgtccagtattttagttacttttggctggaagacaagttactcctgtttttcctgttactccttcatggacaaaaacagacatcttacttcatttttgttatctttgttgttttggaggttgtgttttatatgggagagggctgtgtctgacggagctgtagtgaagtggggacagtgttggagggactcccaagccctgtctaacctctcgtgcttctcctttctccgtcaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaaacctttttaatatttctttatagctgagttttcccttctgtatcaaaacaaaataatacaaaaaatgcttttagagtttaagcaatggttgaaatttgtaggtaatatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaaaacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggcggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtc

SEQ ID NO: 12733 - DNA, 178883 bp, Human
catttaaagtcgatgcctgtaatccctactgctgacttcaagtatcaagtttatagttgctgcccccatccccttcgtttttactcccttagccgccttctttttttttttttttttttgagacggagtctcactctgttgcccaggctagagtgcagtggcacgatctcagctcactgccagctctgcctcccaggttcacgccattctcctgccttagcctcccaagtagctgggactacaggcgcccgccaccacgcccggctaattttttgtatttttagtagagacagggtttcaccgtgttagccaggatgatctcaatctcctgacctcatgatgtgcccacctcggcctcccaaagtgctgggattacaggcatgagccaccatgcgcagcctcccttagccttcttttatccatcttgtgcctcggccctaggggtccttgctatgatcttccctttatccagctttccatgtcccccccaggagccaggcattctaagccacagagctgaccctggaacctgtcaccacttaccttctaggctcccatggcctatgaaactcgcagtacccttgcctaaggcatgcagtgcccgtccctagctggccccctggaggagtcctgtttcccacccatcgtcttttccactctccatccatccgttttctctaccttgttaaagaaaaaaactaatcagattctcgttaaagatggcagggaagccaggcggggtggctcaggtctacaatcccagcactttgggaggcccaggtgggaggacagcttgaggccaggagttcgagacctgcctgggcaacacagtgtagtcccagctgctcgggaggctgaggtgggaggatcagtttagcaggggtgttcgaggctgcagtgagctatgactgcaccattgcactccagcctgggcagcatagagagatccttgtcttttttttttgagacggagtttcttaatgtaggccggccagggtgatcacataccaagcgtggagatattcttgacagcaggattctggctaaaactggactaagaaggccaaggacagagcccaaggtcggggcctggtcagaaagaggtctcggaggagcctgactcaagtgtgatcaagggaagtcttggtcacccgctggcaacttggctttttcttgtctcccagcctcaattcaagctcatcccccttccctgctccatcaaaatctccttgatttccaaggccagcttcagtgtctcctctcaaacttttctgagccttccctccacgggaatccatttttcctgcctgggcctggggagagaagtccatttctccttcccaaacccagagaccattgaggcaggaaagctccctggctgccccatagggcagggcagggtaggcggggtttagtgactccccggcgccgacgctgacccgcacccctgaggaaggggtctccggggacggccgctgttgtcgctgtcgcctccagtccccgccccttcccccctcagtgaaggggacctagagtgagaactggtggtcacgtcctacgcctaggagggcccctgggtgttcacccacccccccgggggccccatcctgggccagggtccgcttcctcgagggaaggggcgaattcctggaaggtctccttccgggcgcagttgcaatggattgccttgggggtgctgaaccctgctgggggtacagagacgtttccgaaactcagcggctcggtcgcccccaaaggccaggcggaacacacgcccacaccgcggctcccttcccgaagtaagaccgccgggccacggccgcccccaggaagccccgcgccccgcaccccacacccggggacacaaacaggcgccgggtagccgcgagggccggcgcggcgcctttaagaggcggcgggcggcgctgccccctggcggccgccccgccgcttcctcgccgccgcgggctcaagcggggcggccgggccagcgcggggcggcggcgggcaggggcggcgagtgcgcgggcgctcgccgccgcccttctcggcgggcagcgcgcgaggaccaggccgaggaggaagtggcggcggcggcggcgggtgaggatctctggccgggccgagtggccgcgtgcgccccgccggggtccaagcgcgcccaggggttacggcccggctgggaacatcagagggcgaggacccgggcgggaggaggagggaggaagggctcggaggccgcgcttctgccgccgcctgagggcgtgtggctcgggcccgcgcggcgggagggcgggcagggcgggggcggtgtctgcggaggcccggcttcccctcctgcgggccctggccccagctccgactcagactcaggctcagccgtgccccagcctcagccggcaggccgggcggcgcggcgctcgcgagccggtgggcgggcgggcgagcccgcaggcggcgggggcgtgggcggtggcagcttggcccagccagtggccttccgcgctgagcgccgctccctcctcccggccgcccgccgcgccccgctcacgctcgctccgcgcggcaggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggtaaggagggacgcggcgccggcgcccggggacccccggcccgagcccggtgacccccggcccgagcccggtgcagcctcattagttgttttgggagatcggagccaaacgggaagaagcggcgcgcggggagactgagtccgagcagccaggtggcggtggcggccgccggccgcgttccagggaagcggtggccggtgcgggcgaggtggcacggaccggggcgttcaggtgcactgtgacccggctggggaggcccccagcagcccagggcgcggtgggagtgctactgagggttgcggagggacctgggaaatcggggcatccacgctgtggggtaagggcttgagggtacttttggaccggagtgtttttcttccttcgtccccttccctttcatgaagaaagggcacccacgtttgtggaccacctactatgtgccccgcgtgtgctcggctcttgaggctgtcattgcatatcatgaggttaagcccagttgaagcgagtagcaattcttggcatgtatgtggtgatttgctgtctcattagagcctcgcagcagccctgcaaattggccagggtggtgattctgggccacctgtctgagaacggggaccgatcggcagaggagcggggtacctagcttggggtcccgcagctagggagtggctggtgcgtagaaagtgctgggtaaatgcccgtggtgtggagtggccttctgccatctgggctgtgtgcccctgctcccaccatgctggtgctccttggcggagtctccggtgtttaacagatcacgttcttaataaattacagaactactgagtcttgggtcaggtaggccttcccttgctccacaactgtagctttgcctctgagaagcagttaagcccttttctcaatgcaagcctaagagaatctagctctgaaagccttttgcaaactccaggtggaaaccttttgtgatgcagcttgttagactgatttttgaaaatgggctctacttgcatttttgtccctgtgggggccccacacatcttggagaattgaacagttgggtttccgtaacccctggtgctcctgggggcccgtggctggtctgagctggcatgcgcaggtgagcctggcagcacctctgtgtgcctcatgcctttcccaagggcctgctgctcctttgccccgtgcaagccccgcaggcgctcttcctgcagccagaggggcacagcttgtacaggatagtgcctggttctttatcccttggtctggggatggggttggctgccttctcccaggccggtttccctagaagacaggctcttcatgatcaatagggcatgcagagtggccccagcaattcatgaagaaatcaggaggagctcgaagccagagctttgaaaatgagtcttaggacccttggaacattacaaaagggtacttgaacgttgtaccgcggatacactcacttgtgggaagggcattctaagacactaaagaaatttggagcagctgctttggcatgttctcgaagtccagttctgatgtgaggcaccggagctccccctgcagtcatgtaagacttgggaaatcccagcgaatacctcgcaccctttgtactgctgtctgtatttatgtcatcttgtgtctgcaactcaagcttgaggcttgtcattgggttggcttgttttgcttggtaattaggaggctctcgcaaaatattcttcgccgagactcacaactaggtcctcgtgctggacctgcagattggcttgaccttgtagacattcttcctttaaaggggtgggaggttcagagcaagctatgctatcaacgttctggggagtagagcattactttctctgaaagagttgttgtcttcaaagtctagttgccttcctttggccaaaatattggcttcaaagaaggcagaagtcatcagggccattctagaacccgagaaagcccactttgtgttttcactagggaagctttagatattttatcacttaagcctaagaaggaaaagaaaacaccaaagagtttttccgtttcttatttattactttcagggcagtgccccctggtggccacatttctatactggctgcaaaatgctgcaactgttgagccagtgaccagggagccccgtgaggttgttttgtttggtgtgagggccaatgagactttagtggctgagagacagtgcaaaggacattatcatgttttccacattcagaatctgggggcgcagggcttctgtactgacgacgggtgatgaattgtctatgaattccctaatgaaaaagtctaaaggtatttgaaaatggccctgctttgggccgggtgccgtgtcttctgtctgtaatcccagcactttgggagtccaaggtgggtgggtcacgaggtcaggagatcgagaccatcctggctaacatggtgaaaccccatctctactaaaaatacaaaaattagccgggcatgatggcaggcgcctgtagtcccagctactcaggaggctgaggcaggagaatcacttgaacccgggaggcagaggttgcagtaagtcgagatggtgccactgcactctagcttgggtgacagagcgagactccatctcaaaaaaaaaaaaaaaaaaaatggccctgctcttaatgtttgggcaaagaatgacccgaatggtccggcccggggtgggttgtttagctgaatgtccggccttgtaaaaatctgatctcagagcaggaagagatgttggccatcatctcatctagcccctttgtcttacagatggggaaacccatcaagagagggggcaggttccggactcttggtcttttcctttaacttctagaatgggtccaacctggctaccttgagattgcctttctgattgggcatctccgacaataaggcagtctccctcattatctttccaggggtctggtggctgctatttagcccccaggacacattccttgcaaagctgagcccctctgcaagtgtaatccttgtcttggggggagggtttggggggtagtgcacgttgatggcaacagtgggtggttagagccacttcatgggccatgaagtgccccacctgccgtaggtagggacaggcgccagccttttcagatgtgcactctgataggatggggctctgctagccagcagatgggcctttgaatccacttgtttgtcagtggtactgtttgttcctgttgccatcctgtttcttcccctttctctggggacacggctctggttgtgttctcttgtacccctcccacctgccttccctagcctgggagcaaccttgtaggtctcccacaccaccccctctttgtggctttttttttttttttttgaggtggagtctcgctttgtcgcccagcctggagtgcagtggcgcaatctcggctcactgcaacctccgcctcccaggttcaagctattctcctgcctcagcctcctgagtagctgggattacaggtgcgcaccaccacgcctggctaatttttgtatttttagtggagatggagttttaccatgttgtccaggctggtctcgaactcctgacctcaggtgatccgcctgccttgccctcccagagtgctgggattacaggcattcctggcctttgtggctttttctagatgctcagaaggggcttcagagggggagtgaagaaattaaagctgttagttggaaatactgggtgatattaatttaattttaaattttgtagttctgtacagtgcctcactggggaatactggctggccccagtttcctcagctcatgttttctgtgcctcctcctctcctcctctctgtcccattctttctgtggctgaacctacgttgcaggaggtgggggcggaagaggcacatgacttggtgaagctttccatataaaatttgggtgaaccttatctgtctttactgtaataattgctgatttttaatgaagtgcttccagggacctcatctcatttaatccttccagcagcccagggatggagggatgagggatggagggatgagggatggagggatgagggatgagggatgaggacatccctcgttgggatggagggatgaggaaacagaggctccgggagtctataggacctgcacagccagctagagggctttcttgagtccactcctgaggcctttgcgctgagaatgtggcttcccttgtttatttgcccaggttaggctggggcttccaggaggctacagaagcacaagaatgtctgtgagtttctcatcctccagagacttggaggccagctgggctgacttggcttgcaagaaacgtgtttctggagcagtctcagaccttggtatcccaccagggacccttttgtcccaataccttagaagggactgaggagttcattaatgttcacgtttatgaccacccttggtaggtagcccaggcctgcatctgctctcatgggtctgggagtttggtgtcaacagtaaactggcttgggaggcgtgccagtgagagtgtagcatgccaccgggcctgtcccttccccttgggccctacatttgttcctttaaaatagggccatctccaaggtccttttctacagggatggcttagcattctggtctggaattctttcgggagattctctgcagggaggaaggaggatcttttccaggattaagtgatgctggtctgtgggtgggtatttttttatttgttttaatgtctggatttgccaccatttcgggggtgcagaggtgggaagaggtgctgacttaggttttctttgcagcagtgcacagggagtattcataacccagccttgcaaatgaacactttctaccagcctcctggggagcaaacagaacttcacataggaggaagcgtccgtgtgcacatggatctattgaagggactgcctcagtttcaggcctgactccacgactgactgcctatgtgccccatgaccctcgacacattccctacccctctgtgcctcactttcctcatctgtgagggtaataatttagcttagggttgcgagcatcaaatgagggaatttgctaaagggtccaggatagtgcctggaattctgtcagtggcggcggccgctgctgtcgtcgtccctgtggagtgagtgagtgggtctctgcccatggatgcctctctattcagggacctttggcctttgtagatttagtgttcttggttttggcagtttgcaagtcaccctgaaggccacgatggctgaactgatcatcttgcagggatgtgggtttgaggatttgaaactgttcagtgggcatagctaaggagggggcccaggcttgcctggtggcctttcagcatcacagcggggttctgttctccttcagcacatggcccatctgaatattacagccccccaggaggtggaggtgctgtccccacctactttatggatggggaagctgagaaatttatgttaagatgctacttgtatttttttaagtttggagattgagaagagtttgttctggatttcctgaaaatgccaagtctccactggtaatcttgttactattactagctaacatttattgttttctgtatctttttgaatatttaagacatgcacatattaaaaaaaattcagaggactcaaagtatacaatgaaacgtcagccctgttcgcttctcattgctgagttccagttccctggggcagtctgtctctataggtgtttatgcacactcaggggcgcgtgcacgtgtaggtctctccatatgtattactgttgtgctcttgcacattgcatgggactgtgtgtcttggagaaactccacatcgctgcttcatttggagaaagttttgtatcattacctctttttttttaaacagctgtgtggtccagttcttaaaaggatggaacatgtttcttccgctggtgttggtttctgctggtatgggcagcatgacaataccccgtccccttgcctgggtgtacattgctagatgaggagggctgggtcagagggcacaggcattttactttttcatactttttgtgtgtatgtgtgagacagagtctccctctgtcgcctagactggagtgcagtggcacgatcttggctcaccgcaacctccgcctcctgggttcaagtgattctcctgtcttagcctcccgagtagctggaactacagtcatgcaccaccacacctggctaatttttctatttttagtagagactgggtttcgccatcttggccaggttggtttcgaactcctggcctcaattgatctgcccacctcggcctcccaaagtgctgggattacaggtgtgagccactacgcccagctttttcatacatgttctgaaactgctcacaaagaaatttcaatatgtcagtcccaatgacagtgaatgggagagcctgtgctgcgcaccctcctgcgctcagggccgggacaaatctgtgggtgagatggtcctctggattcatatttcacctagtgagatagtgagattgaggagtttaggttgctgggggctgactgcaggcacctggaagagctgggtgcacctgcatggcaggatgggcatcaatgtttctaaccactgggccatcctgcctttaccggttatttctcccacatggtttagcaggtttgggacattcagtaaatacttaaagtcaagtgccccatgagcacagttcctgaacagctggatgtaaatagggtttcagttcccactcattttgaattcagctggaaagctacatttgagagaatactatgacacttcccttttaaaaagtagcattcattttaggaagcaaagcattcaagagctgtgcacctccttctttccctcgcaaagtcactgtcttaaacaccttccccatcctgcatgaattgggcccagcccagcctctcccactctggtggcccttggggagccggcccgggtgtgtgtggccttgctctggagagggtgtgggactcccgagaactggcccatggtcacacagtggaaatgtgggaggggaacttgcctcgctccaagccgagtgctccccactcaccactggccaaagcctccttgtgaacaggcctttcctcccggctgcggcccacggtgtgtattagagtggccaggccatacctgtggggccctttgagtctttctggggcttcgtcttgctgctctgagcctgctcagaaagcagctgcccttgtggcctgcatctccccagcagagcctcatgggctggtttctgtaggcccatcctctggatggcccctgggagtgctcccacagccatttttagggttcggtggggtggatctgagattcgtgtcagagatcccgtggagccgtggagcgtcaagaatcactctcacaagggagctccagactccagaccccgctccgcatccccccacccctccaggcccttgagtgctgggtgccccaccctgttaattgctcatgatgttccagggcacacctgtggcagaggccacctgcagactcagctgccccagagggtgaatcgggacccacaggccaaaggccctcccagacagcttcagggagatgtcttcgttccaaacctctctcgccgtcagaatcttcactgatacttaggcccccaccactgggcctgttcttcctctctgacttgctcattgtcctgcttattttaagtctgtcttgtttttaagtagttggttctatgaaggtagagattttggcagctttatttactgctgaaaccccagtgcctataccagtgcacataggagctcaaaaaagaatctgttagtggctgggtgtgatggcttacacctgtaatcccagcactttgggaggctgaggcgggcagattgcttgaggtcaggagttcaagaccagcctgggcaacatggtgaatacctatctctactaaaaatacaaaaattagcagggcatggtggcaggtgcttgttatcccagctacttgggacgctgaggcaggagaattgcttgagctcgggaggtggagattgcagtgagccaagattgcaccattgcactccagcctgggtgacagagctggactctgtctcaaaaaaaaaaagtatgttagtggatcaataactgcctggtggtttttggaagcctttttcatgtccctatggctcagccaaagccacttgtgactctggaatgctctgggccaggaaggaaaccccaggggtgggggagatggggagagagttaggtggtaagtcccaggttccggaggggcttgtgggcaagtcctgagcatctgccctggccaggcctgtgctgggtgctggtccttgccggcatgtacacctgcaggaggtgaaggcaaaccagctctcagatgcactggaaatgctgcaaggtgtgactagagccaggaaacctgcaaacaggagagaactatggcgcagtggctgcagccactttagcactctgtggtcagagaaggcctctctaaggaggcgacattcagcaagaggggcctagagctctctccaggagctaaaggacccacagggtgggcggtgtccactttgtagaggccacacaccctggcctctaccataagccttataagcctctgccataagccctgggttccatgtggattggagggcaggcagctctgggcagaactgaggccggtttccaccttagacagggtggttcaaggaggtgtcggggtgtccttctagagccttgtttcctgacagtgtgaccttcctcccatccgagggaggctgcagttatgccctcggggccagggataggaagacaaaatgctccccgtgggtctggttcagtccagcctttgtgttctggaaatgagccgctctgggctgtggggtggtggggtggatggggtggtagtgggtgggtcagctgacctttctcaagaatcaggttaggtctcaggtgcccaagggagccgagggaagccgcgcctgacctgtgtgctctttggcagtcatcgatcttcctccaagttacttgtttgccaaacttgcccaacaaaagagacaccaggggatgggcgtggtggctcacgcctataatcccagcactttgggaggctgaggcgggcggatcacctgaggtcaggagttcaagaccagcttggccaacatggtgaaacccagtctctactaaaaatacaaaaaatcagctgggtgtggtgactggcacctgtaatcccagctgctcgggaggctgaggcaggagaaacgcttgaacccgggaggtggatgttgcagtgagccgagatcgcgccactgtactccagcctgggtgacatgagtgaaactctgtctcaaaaaaaaaaaaaaaaaaccccacaaaaattagccaggcgtggtggtgggtgcctgtaatcccagctactactcggcaggctgaggtgggagaatcgcttgaactcaggaggcggaggttgtggtgagccgagattgcgtcactgcagtccagcctggtgacagagcaagactccgtctccaaaaaaaaaaaaaaaaagctccaggggcactggggagaagggagaagtacacatcctgaagtctcccttccctgtgagatgaagattctcctgggaagggggctggggagctccttgtgaagtaccctgatgatttttatgggaaactactcactgtcatttcatgaagtgcctcagaagaccttaccccaaaactgtcaggcgtggggaagcaccgagttagccaaggctgaagcagtgtgtttcagacttctcaggggcaggtcccctccaggaggtttgctggagccagaggttcccaggctggctcctgggtctctgtaccctgagctcactgtgggaatctccagtctggcaccgttcacctgaggcctcactggagccccctcatgcaggagggagacatggcaggggcaccaggtcgtcagcccagcccagttctacctgctgttgctaccttttgccaaattccttctcaaaagaagccttttcagatttcttgcctctggctgctggtttgcccggagtgtatagaaaggagctagttttgcacaagagacattcctgggaccgatctggccagatagacacttgtggcgttttcctcagcagtttacgctgcaaacccatggactcctcagcaaccattcttattagcctggggtcactctgggcgctcttggagcccaagccagaaactgggactctgggtttgttcaggcggcctgctgtgctttggcagggctgtgttgcttcctctctgcccccttgtacattcatggctcatgccagatctcagaggatcctgagaacctaccatgggggtcaggcactattgcagatgggataactaccctccaggatggctgaggggtctccatttgctagatgagggccctgagactcagggagaggccaggtgctgtgagcagcacagcttggattcaccctcagggatgggtgactcctgaaaccatgctgtttccactccgccaggttgcctttgtcttcaacacagcatccagctgccgtcgatcgatgtcaggaaaatcaaggagttctgttctttttttttttgagatggagtttcgctattgtcacccaggccggagtgcaaggtgtgatctttgttcactgcaacctccacctcagcctccccagtagctgggattacaggcacccaccatcacacccagcgaatttttgtatttttagtggagaagatggggtttcaccatgttggccaggctagtctcaaactcctgacctcaggtgatctgctcaacttggcctcacaaaatgctgggattacaagtgtgagcgaccgcgccctgcctcaaggggttcttttctgagcatcctttgtgtgcagttgttgggcccaggaggatagtgcatggtggagatggcagtgaagttggagcatgagacttgtcctgagcctctgccctcccaactgtaaggtgggtgcagtgcacccgccctagggccaaatgataggattccccctccacccaagaggccacctcacctgccctcctacccgcccaaggcagggcctggggcctctgacacatctctgctgggagctgccacccatctttttctgggggatcctccagtggtcagcttgctgcttcctgggcagggcggggcatggtagatgggtgcagagagaaccctcctgtggcagtttcactttcatttctgcctcacaccctgtttccatccaacagtcaagggctgggctgcggaggtgaggaaacatccggtctccaccctggggtacttgtcctagtgcaggttcccaggcctccccctcccctggaatgaatctggggtgggccgtggcatcttctttttaaaaaacaccccattcattcctttatgcacttacatgccacatacttactgagtgcctgctgtatgctgggcactcctgggttctggggattgatacagcagtgagcaccacagtctcctggagccccagggtcagtcttagggagagcttcagggcagttgtctcaccactgggagctcttgcccacagtgtgctgggtcacgtacctctcagggtcctgggctcgtgagtttcttcttcttcttattttttttttgagatggagacggagtcttgctctattgcccaggctggagtgcagtggtgcaatctcactgcaacctctgcctcccgggttcaagcgattctcctgcctcagcctcctgagtagctgggattacaagcacgcgccaccacgcccggctaatttttgtatttttagtagagatggggtttcactgtgttggtcaggctggtcttgaactcgtgatctgcccgtctcagcctcccaaagtgctgggattacaggcgtaagccaccatgcccggccctatttttctttttttctttctttctttctttttttttttttttttttgagatggagtcttgctttgtcgcccaggctggagtgcagtggcgcgatcttggctcactgcaagctccgcctcccaggttcatgccattcttctgcctcagcctcccgagtagctgggactacaggcgcctgccaccatgcccggctaattttttgtatttttagtagagacagggtttcaccgtgttagccaggatggtctcgatctcctgaccttgtgatccgcccacctcggcctcccaaagtgctgggatgacaggcgtgagccaccactcccagacttgtttctgtcttttttgccgttgttgtagagacagggtttcactgtgttggccaggtttggctgtaactcctgagcttgatcgatcgcccgtctcagcctcccgaagtgttgggattataggcttgagccactgtgcctagccagcctattttctttttcttttttgttagtcttgctctgtcatccaggttggagtgcagtggtgtgatcttggctcactgcaacctccacctcccaggtttaagtgattctcggacctcaggtgatccttccacctcagcctcccaaagagttgggattacaggtgtgagccaccacgcccagcccagcctattttctttaagattttaaagtcctaacattcgtcatgggatccttgaaaagaaaaggaattatggccttgccactagaggcctttgccgcctccctgcaggaaggtgtgtcccgcggcattgggatcgtgttggagaaaggttttgcttcctgcacagtcagctcccaagcaccctttttatcaccttgacctgggcgcagccaagccgtggcctgtgcttgcggagatttgggtgccccatcctctcgctgctctggggaagcctgtagctgtggagaggccagtccaggccccagcttctgacctttgtctacatatcaggaggagccctcctggtgaggaatgtgcctcgttcttttgggggagctgacgaggtgcctgtagtgtggagggttaggggcaggggagtccctccagaaatgcacttaagcttgcagagtcaccctgccctgcattgttaagtggtataaggacagttagctccagaaacagcagtggctcctgtctctggagctctagcttcatgcctgacatggtgctgagcgctaacatgtggctctttgaagctgtcagtccgtatgtggagactgaggctcagagagggtaagtgactttcccggggtttcatagccgatcaccctgggggtggggttcaaacatcagtttgcacagtgccgcgatctcaggtcactgcaacctccacctcctggattcaagcgattctcctgcctcagccttccgagtagctggagtcacaagcgcacgcctccacgcccagctaattttttgtatttttagtagagatggggttttgccacattggccaggctggtctcgaactcctgacctcaaatgatccacttggcttggcttcccaaagtgctggcattacaggcgtgaaccaccgtgcccggcctcggcttcttactaggtggatgactgtgggtgtgtttcagctcctctctgggccttaatttccttgtcagtaagaggtgaccttgtgctcatgcataggagggggtcagcacatgcaaacttcccttctgtgcagggcagaggccatctctggaaggaagaagggggaaagtggccccttactcacctgtgtcaggtggtatcagagtaaacctccacagagtccagaggtacagagattcacgatcttagaggagtaacttttgaaaacctttgagccagaagaggcctttgcgtgtaagggtttgcagctcagagtggctggccttgcagggtcacacatgtagagctttgggctgacagcttcgcagcccagaagtacacctgtggcctccagggaacctctaggagtgtgaagaggcgagggtgtgttctgttctgggccatgattggtggaccccatcccggccaggatgagttatttttgttgatgggccctgtggtctctcctaaccttgctgggaatgtgacaggaaccaattctttggatttgggatgctctcctgggaaggatgggggagtgagtgggtgccccttccctgacgcagccatctgggacgtgggcagttctgtgagtgcttctgcatgtgcttcaggctgggaccccctggacagtgagacctatggagtgggccacatggctgcaaatctgtttccattgctgtgtgctccagtcctctcactctcaattaaccaacagatgtgatgagtcattggggtctcgtcagctaatgatctgagcagtaagtcgattgtatggctgattcctagagccacaggggtggatgggttctgacaggagcctcagtgctgagcgggttcggtaataaaggggatgtattggttcctgagtcagatccttggggcattctggcttcaggtgtaggtagactcaggcgacagtccaatagggcctggtctgtctgtctgtctgtctctctctctctctgtctctctctctctctctctccctcctctctccccccggccccctccctgcttccctggtctcttttacattggcttcattctcaggcccatgtggtgcaaggtgagtcctcaccctcaatccttattctcagccaggcactgtggcgttccttaggtgtgtgatctcatttgatccgcattaacagccctgggagggtggtggttttagcattcctgtttctcatagaagggctaagtaacttgcctggggtcacacagctggtaggggcagagctgggattcagagctggttgggttggctccagggtcccccatccctcatgctccaggtccacagggacagggattccttctgttggcctctgatttgtcatcctgggccacatacctgtctctgaaccagtctctggggctggggaatgcagcgcctcattcccttctacatggcctgagtgtgggcagggtggatccccaaaaggatgctgcaggggcactgtttcccagaggcaggggagggatgtttggcagctgaggtgggagtggacgtgctccctgtttctgggcttcagtggctggccagagtgaggctgggggctgctctccctcagcttccagctctggacccagcttgcaaagacttggacgggggcctgagggttcgcacacagagtccagggctaggacgttgttcccaagaagggagtggagagtacctacccccacaagtctgagccccaggctggcctaccctgtgctgggcacctctgcttggggttccagaattctcggaggcagctgggtgggagtgctggtgggaagctccggaagggaggctgctcggggcctccctgtggctgtggctgcatgggcagccccgaagcggcttcctggaccccaccttgtgcctcagttaaacctgaatctggcttattcccacggccagcccgacacaggcagattctgagagtcctggctgcgcccagcagccagctgggtgggtggacatactggagggctgatgtcctatttgtgggctggggtttttccgggccttgggaaatgctgcctgagttcctggagaaggatgacatctttcctgccccactgtcgctgtcgctgtgcagaaccttggtgttttgacactgatgtgttctggagctaaacaatctcgtgttatgtaaacacaattagcctgttgctgtttgaccctgtcctgcttggggagggttgagaaggtgtctttttgctggatcctgggaattctgagagcctggagcagctgtgaactagtggctgggggttgtcggagctggaggggagtgttggtctggggagggccactcctgtccaggacactccgctccgatatactaagccagaccctggccccccacagctgagcaggcctggtggaactgcggggaggacatgctggactatttccacccggaaggggagaggaaatgaacggtgagtggctggtggccacaaacccaggatgttccatatatcagggccccagttccgagggccccgggcaaaggggctgggctggaggttgggagaagtgcagggtgacaggccctggttagagtatgggtcccttatggttcctttctgaaacgagtggggcaggtgagggcaaggcctgctcagagccccttgccccgggcctgcttaactgctgtgggtgcctctgcttggtgttccagaattttcagaggcggctgcatgggagtgctggagggaagctcgggaagggaagccgttctgccctgccttggttgcggccgtgtggacagccctgaagtagcttcatgggcctttcggtgctgcacaaggtggcagaagctgggaccagcgctcagacccctgctttgccgctgagctgtgcggccctgcaccatggtctctatttgagggccctcagctcaaaggctctgggaaatgagtttgggacccattgcttctggtttagctggtggggctggtggacctgtcaggttggacaagcaattcttgtgccttagcctcccaagtagctggggttacaggcgcccaccaccacgcccggctaatttttgtgtgttttttttttttgagacggaatctcgctctgtcgcccaggttggagtgcggcagcgtgatctcggctcactacaagctccgcctcccgggttcacgccattctcctgcctcaaccttccgagtagctgggactacaggtgcccgccaccatgcccggctactttttttgtagttttagtagagacggggtttcactgtgttagccaggatggtctcgatctcctgacctcgtgatctgcctgtcttggcctcccaaagtgctgggattacaggcatgaaccaccgcacccggccattaatttttgcatttttagtagagacagggtttcaccatgttggtcaggctggtctcaaactcctgacctcaagtgatctgcctgccttggcctcccaaagtggtgggattatatgcatgagccacctggcccagcccacacttggctaattttcttttttttgagatggagttttgctcttgtcgcccaggctggagtgcattggcggcaatcttggctcactgcaacctctgcctcccaggttcaagtgattctcctgcctcagcctcctgagtagttgggattacaggcacctgccaccatgcctggctaatttttgtacttgtagtagagacagggtttcaccatgttggccaggctgttctctaacctctgacccaaagtgatccgcccaccttggccttccaaaatgctgggattacaggcatgaatcactgtgcctggccgatttttcccattttcttgctgttgtaggtacagctgcattgggcatctttgtgaatataaatgtcttccttccctttctgattccgttacgtgtaggtaaaagtttttatcagttattgatgcataacaacccatcctaaaaactactggctttaagcaataagcattttttcatcccacagttctgtgggctttgctgcgtagctctggtcttgctaggaatcccttgcgtgtgtgtggtcagcttgcagtctggtaaggggtctctgccctggggcttgacctttggctaaccgaaggcgctgggcatgacctggcctccttcttggctttcctcaggctgctgggcttgttcctgacactaacagtggatgtttccaaggcctctggaggcccgtttgtgtctctacagtttgttggccaaaacaagacccaaggccagctaacattcaaggggtaagaaaataaactttaccccttggcggaggtgtcaaagtcattgcaaagggcctggatacagggagggtcaagccctgggaacatgtctgcacacagagtgtgtgatccgggtctgcgcgttggccggcagcccatagacctttcccaaattagtacctggcaggtgcccagctggtgctgggctgggtatggggaggggcggagaagtcgggttcataaggaacaactgtcatcattcagaaagcttttcgaagtgtccgctgtgtgcccagctctaccgacccaggtattgtcagtcctggttcttcaggaacttggcttttgcttacagagggaaggctctgtgggtgactgaccaagggactcggtgacgtcagtgtcctgtgtggtggtgggaagttttgttcctggattggggcctggtgttatctttgtggcaatcccccacctccatgatgaagttcatttttctcagctggaagaggaggttagaacattggagcccctacattctagaacattcgagcccctacattcttgaacattccaactgggagagcccttgggattttcagtggggaaaccagcggtgaatctgcagccaggactagctcctgcgctctctccttctccttgtgctgctgggtgcctgtgttgtttccagattgcatccagacccaggatttcctgttgttgttcttcgtgtgtgtttcttcattagaacaactcctgcatcctctgcagagctgtttacaggcatctattggcctccctccgtgccaggcctcgtggtgcatgtggccaagtgatggccaagatggacaaggtcttgtcatttggagctttagtctgtgagggctatagggagggtacagacatgtcaaccagtgagttacagggatgattttatctgggatcggaaaatgaagtgatgacagtgatatgaaggggtctggggactgtcctcacatagtcagagaagacctttcccaaggagagagctgtggctgctgctgacaggtcagaaaggagtcagtcgcagaaagctggggctgcggcatctcaggcaggggaagcgggtttagcaagtgcagaggccccaggggcacaggagggagccggagcttggtgtgttggtgagctgtggttggaggacgtggccggggcaaggcctgggaggacagggccgtgaggaagcaggcagggccaggtttctcagcgctttccaggccccagcatgcagtttgagattattttacaggaggtagaaggcaaaggctctcatcaaattaccccacaacatagtccgtgaaatactactcagccatgaaaaagaacacaaccccatcctttgcagcaacatggatgcagctggaggccattatcctaagcaaattaacgcaggaacagaaaaccaaatgtttcatgttcttacttatagatgggaactaaaccttgggtatatatggacacaaagatgggaagagtcaacactggggactactagagggggaaatgggagaggggggcaagggctgaaaaactacccattgggtactatgctcagtacctgggtgatgagatcattcatactccaaacctcagtgtcacacattatacttgtaacaaacctgcacatgtacccctgaatctaagataaaagttgaatttattaaaaaaaaaaaaaaaaaacctagtccgtgactctaggtgacccttttaaaagctttgggtggtgctgataagtgtgactgtgtcctggagcggcttcattacttcccatccctccagctgcctgccacagggcccagaagctggctttggaattggagggactgggtcaaacttgcttctgctcctgtctagcaagttagcgagcttctctgagcctgtttctttgtctgtaggataaaaaaagcacttcttaacttctgtggttggtgtgtcagttgaaataattattaatggtataaagttccatagttcactgcctgctagatttatttacaattactacaaataactcatcgtaggccccaatcagcggtagatggtattactgtggtggtggtggtggtatgtaggtggtgctgtggtctgggtttcagacaccatgcggggtgctggagcaccgagttcctcctgcaccccgggagcccagttggtgcggagacagagacaggaggtgaagtgttagatgaactctgctcgaggaacagagcaagtttctctatctgggaagatggaagaaagctttccacaggtggtgacccttgagaggtatgtttgagggcgcagggagctcgctcacggacaggtatggatggaaggtagtggagaaagcgggcaagcctgtgccaaggcgtgacgctgtggagccaggagtccttcaacacggactctgggcatgtagggccggtgcagatgggtggctgtggggagcccctggaagcctgggctgagagcctctaggaagcagtgggctggctgtgggaggaacacccctgcctctccctgtgcctgcagtgggtcccgtccccacgctgtgactgccaggtgtggacacatgctcgtcaagtggtgaagaacgtggagccggtgggctcaccggcttggggcctggctgcctcactgggaagcttggtggccctgggaggtcattgagtgtccctaagcttccgccagggagatgatcgtagggctggtgtgaggggagatgaggagtctgtgtctagcacccagcacagggcatgcactgataaaatgatggcttcacccggctcccaggggccacgtccagctgacagctccttggtgacttagctgtatgggtggtgtgcagctggcactgcttgctggtctgggggagacatcctaggctggcctgtggaggacgttccctctcagcctcctctgagccatgggcataggtgagttttcagaaaagcccataccgacggtgattcagctctgcttcttgcttccttctgtcttattcttaagtcacccacagggcagccacctgccagtgtctgtcctccaatcccctgctccaaggaactgctctaggcagggaagagagaggaggaggaggccccgcatatcctcgggtagaacggaggaggaaactgaggctcctcacagaggttaactaacctctgctagaccacccaggtgtaagagctgggatgcccccagaccctcccttctcccgggagcggtggagccgaggcggtgggggcctggctggagcgccccaggagctgagagaagtttagtccacctggagcttggcaatcggggtgaggatccctttgaggccgggttgcacaggatcctataagccatcattgtacacgcttgggctttgccctgaaggctgggggagccatagcagttgtgtgaggttggctgctgggtggaagccaggggcttgtgggattggagggggaggctgctgcgattgtccaggcagtggtggtctagatcgtgcagtggtggtggatatcaactcttcagagtccatccaggtctgaggactcattagcaacctcggctattcctcgactactcaggatgttgtctgtatggggccggtggcctcagcactcctggttcctcagcatcgccacgccctctgtatccacggactcagaatctgtgttttaacaagacccccaagaggtgccagtacacacggcacattcatgtttgcaaacactggtttagggaacctgttgacctcagcgcagggctgaggggggaagaaaggactgaggtcaaggcctgacttcatgaggaaggggaggttggggagcgggggaagaggagatgatgtcggagcactcagacttctgactgggaggagggctacatcaccccacgccaggggcggcttgaggactagtgcagttataacacaaagggccgaaacggcctggccgctggggcagggcagagagctgggctccacagggcagcctgcacaccccatctctgcccttggaggccctagaaccctgtggaccctgtcctttgtcctttctgccgtgtccatgtaggtgtgggtcgtgtctgccccacaggttgggtatttgccgttgtgctgtcagcagatgggtgttgagcccatgcaggcctggacttggtcacagaacggcatcctgcttgttgagtagccatcctggtcatgaggggtcatgtggtaatgagtgtatggagagctgggggcgtcattgtgaagaccaagtgaagcagcagtcggatctgggacagaggttcctctagggaaagactattatggtctggggcaccctggaggcacgcgccgtggctggagggtgggtgagtctgtggctggtgggttcggctgaggcaggggagtgcgctcttcagcccagccccctggcctgggccctgccgtgctggagtctcctggtgcctggaggctgagtcgaatgcagtggggctgggcagagggtgccctggctgtcgtggggtggaagcttggctgacccagtggacatcagccaggaccacattaggcccagctttggctgggttccccacagctgtgcccaacggcatccctggcctccacctactggatgccagtactactctcgtcttccaagaatgtctgcaggtacttccagatgtcctctgggtggggggtaaaattgctccgttgagggccagtgctggctgagggttcttcatcattcccttctggtcccagcctggctgcactgccacctggcgagctctgtttccaggcagtgggtcaggcctgctttgggggctggcatgctgtcctccctcacccatgtcaaggcccgtgtggccatgtgctgacatgtgcttgatgtgacctgggagtcagagcgcctggcttcctgctccaggcttccgtggtgccgtaaggacctcaggtctgggggtcaggaggcctggatggaaaatcctggcactctggtccttgtaggggaccctgagcctcgattttgcatctttggcgtggggctgtggtagcctttccatgggtgctggtggaggctgcgaatgccagtgtgcccaccctccccatgctgggcttagcgtgggtgcctggtgacagtgtgttaatctccccttgacttctctgtgacctcagataagtccctctcagttctgggccttgcttataaaagggttcttgggctctcttctgtgtaaaaagtggggaatgaggtggagagcctgggggacaggggagtcatggggttggacaccgtgccagagcctgtggtgctttaaaatcaaggctcaaacccagggtcctgaagagggccgagcagcagctgaggtccgagtgcacccggcctgccagtgctgcccaggagtggcacctcccgtcatccctcacgcccagcaaggacccagtgtgacaagagcatggagtctggacctggcagagctaggtttgcctccttgctcttctatgactagctgcatggctcctggagcctgtctgagcttcaggtgccacacctgaagactgaggttaaatgggaggcggggaggagctggtgacactgactggatgccactatgtgccagcctcattcattccaccctctggcagtgtcctgagttacatgcccagccaccgtgctattttccaggccggaaaaccgaggtgtagagcccagcactcggcgtaggaggcacacagcaagtgaagccatccttgttgacatgagctggttgctcttggcatttgagtctgaatatcaaaggccctgaagattaaaaagagagaatgaagaatgatgtgcctggtgccttcttgggaagagcccgaggccagctgtggaggggagcaagactggttctgggctgggcttcctggcctggtgctttcctgggcagctggaagtgcttctgtgggagctgtctggccctggcgccgttgttggcttcattattttttgcctgcaggggcctgagtattctgtactgacgggaaaacatttgttgggctgacgctgtaatcacaccacaagggacacttgaaattatatctgtatttgggaagctaattttaaagaactttttctcttcataattatatgcaatcagccagctagtgttattggggattctctttttccctcttcagctgagaggccatctgccttcctcttcctgcctttccttccagcacacggtgagccatctccctgggagagggaccactggcccttggctgcctgcaagccccagggaaacctttccatggtgattgcggaggaagggatgaggaggaagagcaggggaggatgatgggggcctctggcttggctacaggatgagtccgttttcaagactggaggcgcaggttggtgatggaaatgatggagtgtagcgtttcgatttggacattgaagcagccagggctcttgtgaatgcaagtggcagaaaatccaattcagatgagtttaagcaaaaagaaaaaaaaaatacatttcttggcccaggtaaccaaactggcacaggaatagtcttatccctcaggtccccagacattcctcctgtccctggagttttattcctcatcaggaggaatttagttccagaaaacgctggccaaaaaaagaaaagaaaagcccccgttgcccaccccctgcaaatggggctcattcctctctatcttgagctctgatcctgacaagtagggtttctccaggatggtggctagcacaccagtcagggatacgggctggacatttagggttggcacgaagtggactctgtggattgtccttcacacgggaggcattcaggtcaggagaatataccatgtgctggcccttcaggtctcgatctgaccaccctttccaacaccctgggttcctctgtgtccttcctcttggaccgccctctgagaggatggtgcgaggaagaggcttccgtgttgtgcatggtaggcagggatgggggcgttccaggggcggacagcatgggcaggtggtcagaagtgtgaaagaaccgacctgtggggcacggcaggaagcccggtgtgctaggaacagatggggcgagacttgctgggtgaggaggtgtgcacctgctgcagaggcccaagtggtgggggtgagggaagcccagggggtgagtctgggcaggggctggggggtgatgagccatgtttcagatgcagaaggtgcagagtgtgtgtgcagggacagcagggagaccgcctggtggcctgcaccgcagagctgtgtgtctcagggagtgggaagccctgcctgtgctggcctcagttcttccgctcttctggaattctgcatccttcttttgacatttctctctaatgcccagggtcctggctcttggctttggcttggtggcagctgtgaccccctgcatggggctctgagggattattccagctgtttggggactgtagccatggctcccagctgcagagcctgacaggcctggaggccggcaggaagaagatgggggctgtgcccgcctgccgagagctggctctgagactgactcttggcactggggtcctctgaggccccaggctcattctcacctcctccagagacccagctgacataccattctcatgagctgcagtcctgtgacccagctgatttctgtctcattggtggaaccctttagaggtggggtagggctcctaaaacattagccctactgccttccccacagattggcctctcttccctgcctgtgggcatctggcatctgcttgaatccttcttgtcacggggtgctcatcacctcttgactgccttcctatggaagccagcaacctcttcctatggttgagctgaaatctacttcataggaagggttccttctgcctggaaggtttgatattggacaggactgtcaaccgtgtggagaggggaggaacagggtgctggctcccccggcttctgggctggattgacccagggcgtgtctaccccacagcatcctgacatgccagaggctggaccttaggaagtgccttccgggcccttcactgcaggcctgctcaggggctgctcctcaggtcttggggcccctggggcaatggcatccatccttttggcctcctggggtcaaggttctgagggaggattagggcagcaggtggttgggtggagaggcagctctgtccagaacaaccctgttccagaaatcccagagcctcatccccaacagacccggtgggccccccaccatcacacaggtcccctttctccccaggaagtcacacagtgctgtgggatgaggagggtttcctgacagatttggggagagcgggcctgggtggggagtaagggagcctgggaattactggtatttggatgggtttagattgtggttctgcttcttacctgctgtgagtctttggtcaggatactgaactgctctgaatttccccacttgaaaagaggtgacaggccaggcgcggtggctcacatctgtaatcccagcactctgggaggccaaggcgggaggattgcttgagcctgggagtttgagaccagcaacctactgggcaacatagtgagaccctgtctctacaaaaaataaaaaaagaggcctggtgcagaggctcatgcctgtaatcctagcactttggggggccaaggcaggcagatcacttgatgttgggagttcgagaccagcctggtcaccatggcaaaaccccgtctctcctaaaaacacaaaaattaacagagtatggtggcgcacgactgtagtcccagctacttgggtggccaagtagctcctgcttgaacgcgggagaattgcttgaacccaggaggtcaaggctgcaatgagccgaaatcgtgtcactgcactctagcctgggtgacagagggagaccctgtctcaaaaaaaaaaaaaaaacaaaacaaaaccaaaaaagaaaagatgcaaccattgtacccacccagtggttgctgagatccagtgtgagggggacgaagtgcctggcactcacaaatcctgccccgccactgcctcgtctgtccctgtttctgcctgggacagggagagcaggcctgggtggggaacgagagagctcggggattactggtgttagcctctcatttatttgggtcgtgctcaggcccctggaatcctctctgaaactggagagtctctcgggtagccgatgaagcgctgcctgttttagggtcaggtgcctgggcacctctgatggacctcaggatgagcccaagtgtcagtaattatcacccagctccccggtttgcagccaaggcttccaggcctggagcctttggtctccagcacccagttcccccacatcccttccctgggcttctttcccgccattcccatcagggacccctgcggccatgctgggctgtacccagtgccccttgggaatctgcgggtaccgtgcaaagctgtgctgtgctcctccccatcaactcctcattgactgttgaaggcccctacaaactcctgacaggtcctcattcattcctgcctgacacatgaatgcttccaggcgatgtctgagaatcctgggatggcagagctgtgggagccttggggttgtggtgggcaaagtaaggcccctgccactccccaccaaagacagcaggttctaatcctcagagcctgtgagtgtgctgccttacatggtaaaagggtatgacatgactacagatgggatttttaaatttttatttttcagagatgggggtctcactgtgtcacccaggctggagtgcagtggctattcacaggtctgatcataacgcactgcagcatcaaactcacggcctcaagtgatcctctcgccttagcctcccaagtagctgggattataggcatgtgccactgctcttggcttacagatgtgaaggagtgaggcatcttgaaatagaaaatgttcctgcattacctgggtgggcctggtgtaattacaaggaggcaggagggccagaggagatgtgacagtggaagcagaggttggggtgttgtggccacaagccaaggaatgtggacagcctttagaactagagaaagcggaggaatcgatttctccctggagcctccaaaaggaagcctgcctctgacctcagaaccctaagagaataatacatttgtgttgtttttagccactactgttgtgatttgttacagcagcaatgggaagtgaatacagttttctcctaccctgctcttcttagggcttgtgggtgaatctgtgactgagaagggagggactgggtcagggtcaaggtcaaggccagagcccatgtgacccgacaccttgggactttcctttgacctgccatcccgaaaatatctgaggggccagggagatactccagtaaggtgccttgtggtttaagttttctgagatggggtcagggctgactcatgcctgtggctggggggccccaggaaaccccagtgcccatgacctggtctttgcctttgcttctcctggtgcttagcaggccttctctagcgtgccctggcagcctccctctccctcccctccagggcctggctcacacagcagctctactgaaacttccctgtgcctcctgctgtcccccaggtgtttgtgctatttaagggcctgtggcacacccgccagagggcatggcatgtagcccactggtctgccctgtggcagctagcatctcggggcagggtttgcggtctggggtccccctctggtcccaggccagcccagtgcgtgacagagaagcccagcaaatgtttgaccaaaatcagaccaggaaactctcgctgcctgtggttggaggtgcagcagcagggcaaagacaactaaactttaagggcttgggatccagggaccaggagctgcccccagccctcaggccaggtaaggagtgttggcagcagaatttgggtgaagtctttcggtctcctctggaacacagcctttcaaagagtgtcagcatccaggacacaggctggggacacacacacttatgctgctattttaggagtgtggggtaccttgaggataggtgctagaacaattcaggctttcctgagcaggcttctccctcccccagtgagtccaagggagggaaatgtcacgggaatttctgcctcccttcctgcagtagcctaccttgctcattaggctgatactaaatgactttgcattcttgggattaagaagctgctgtgaagagaaccaactgaatcattagccctgaggctggctggctgacggaggagggggagtgggggtagcggggaggggaggaggtgctagaaccaagcctgccagcaccccccactacctccctctcccagcagccaactcccctgcttcccacaatttaggtcccatccctaattaggggaaagaaaaattaccgcacctgcaaggggatagtaaaagactcaaaaacaatttcaagtcgagaatttccacactaaaaagcggggatgtcgagagccattaagggaatagatttaacgtttgtgatcagcaagaagtcaggatgattcctgatctgaagtggtggccccttggatgtggcagaacactgccttgcgtgatctcctgccctcgcctcacttcctccttcctgaaaattgaactgaggaggggagtctcaaaggcacctcagttcctgtgctgctttcagcccctgcagctctgatgacctctccgggaggtgccaaaggtgggtcacccactctgtctctctcttgtgcctgttcactgggaaaagctgcttccaggcacccctggaagctgttctgggtctgagggagtgtactgactcaggctgctgtgcctgcactgaggggcgcccggactttggggccggcctgcctcccctgggtggggcacccggtcggggggagggtcttcaggtaaggtggttggtgactccccagtcaaaggaaagatgcccccactcaataaaaaagacacatggcagcttccagtttatctggttcttccctagagctgtccagacaattcaaatgtttgtactggctttaaaattctgttcgtatgttgtctttatatcgggccatttcagtttctggcactgttaataggaggaaaatccaaattaccaaacaatcagcaagtaaaccaagatgccgcagggcaggcgggcaggggtgacacggggctggagcctggcccaggaacccggcagcactcggggagtgtttgcagagagcctgccaggcccagggtctgcagggggcacagggatgctgaaataaagagccatctttggcctcgaggggctcatggtctgatgctgagcatggagcaggcttcagtggaagccattattcctgcctcttgatgaggaaggcacttgagctgctcttggtgggtgggcaggagtttgccagctgaggaagggtgcctggcagggggatcagtttgtgcaaaggcagacttaggtcaagccttggcatttggagattggggtccctcctgggagggtttgagaggctgctgctgcctccccctcgtgtcttctgagctgcacctccaaatgcccatgtggcaggtgttttgctaagaatttggggctgtggacacagggcacaagctgtgtccctgaaagagtgcttgttagtcaggataggccaggttaggctgcagtgacaagtagtgtcgaaaggctggcggaaataggtttactcacaactcattcagcatgcactctggatccagagactctcgggggctgtggtctgccctgcagtggctcagtgtgtatcccacttcttaagttcagcactgtggaccttttgtgctggataattctttgttttagggggctgtcctctgcattacaggggccctttcctcactggattctagtagcactttcctcggtgtgacaatcaaaaagctcttcaggtgttgctaaatctccttgtgggggacacacagttgcccatagttgggaaccagcgctagctggaggtcctcttcatcagttgtttctttctggttcccagcctggcttcgtcgccactcagcccgcgttgtttccaggtggcgggtctggctggctctgctggtgggtggcagcctcatgtgcttccttgtttctgaggtcagggaggcctcggtgctggcagtggaatgctttttccaggaggggacatggtcacctctgttcacatctcattgcccaaggcaagtcctgtggccatgcctgactgggggcagggacaacacagtggcactgagtgtccaggagggaaattgccggctttgatggccaccattgatgttcaccaccgagcattagcctggtggggtcagtgcaatggagtccagcagcctttctctctgcccagtgctgggtgtgggcagcttggggcagtggggcctgaggagggtgggagccaaggcaggtttctccagaggagctgacctggggggtcaggtggtgatgtggggatggcatttgaggaagggaacagtgtggccatcaacacacatgggtgacggggcttagtcatctgtttaggagccccaagtcctggggagacatcctgggcttctgtggggtacggtgtgggccctgccctctgcaggcagggaaaggggaccataacttggggctttttccccagtgcctggtacctggaggtgccaaagggtcttgttatttggggtgcctgaaatcagtagttactgaactgtgccacacgttgcttggatgaggatgtgcctggcttcccacttccccgagttgttctccgtagaaccttcctcccttgcttcttcaccatttcatgtacttcacttgctgcagcgctcaggtccccaccctgccctggggagggcctcttgggtgggaaaggtcatatccttttaacggatatgaaagctgagaccccgagcggctcagcagcacatcccatgcctgctgctggtcatggtccctgagccttttgtgccctgctgtgctgtgtggcaggcctgctgctggatggggtctgtcatcccagagtgtcttgtgttaacctcctgacgccacacctggtactgtgctgcagtggcttggtggtggcgtggatgccgtggacgtgtctctgctcctcatcactcttttctacttctgccctgatcatctttattgttttcccttatcatcccctctccctcagtgctgggtcatccagagtaattttcatcatcttcagaagtggtaaccactgtcactcacagggtccctgctgctcagcggccagcgacagaaagctttagctggcttgagcagaaatctgcagctgaaggtctagagaggacgagccccactgcggccgggtctggccggggaatttgccctcctggagccctcttggccctttctcctggttggcctctggctcatctggattctcgccacatagaagcaatggtgtcctccagcatttccaggcagtgccatttgtactgcagacagtcccccaggacccgtccggtaaaggaccaggaccggcttggcttgggtcctgctcccatgctgctgctaagtgaggtgacaggtcatgtgcccacccctggagtgggcgtgccgcccccagtcatgtggactggaggaggcagttctggaagggtaggaaggcagggtggcagggcagagtgcaggtcacaagacccccatccctggcatgagccaggtactgtgccaggcctggactctgtttcccttaaagcccgtgtgggatgagttctaggattctcccattttacagataagaaaacagaggcacaaggtacaggggggtctggttccatgttctgctctcaggggctcacccacctcttccgctcccgcctacgcccccgaattgtgttcatctaagcctctgaatgctgcgaagctcagtcctgggcttctaaccacttcctggcaccaccacggttgaaaagtggactgctgctgccttcttgcagtgttctctcgtctcctgggcctggcgcagggcctcagtctgctccttccagactgtgagcgtcacaactatttctggttcttaggtttcctttacccttttcccaagacctgcaagggctgccccccaccccacccctgctatgtcctcccctagcaaatcagatcctgcttccactggtcacagagaagcacatggagtcgctcttgtggacaagcagctgtccccatacccagctgctcctgagcaacacccggagtgcgatgaaccctgaatccttcccaggccctgccctaggcctcctggatcagaggcctcagggtgggcctcgaatgaggatttttgacacgctccagtggtggttctcaggttatctgccctggcatttgggacccactggcccataggtaaaggctgggccacagggtgacatcctgggcctctgaggcgtgccccacctttatcctctgtcctgcgtctcagcccccgccccctgagagggctttaagcttccagagccccagacaccctttggggagggcgcaggactcaccttactcctctctaagtactcttctcagcaccggtctgtagttacccttcagttgctctgccagatggcaaatgctgcctcctctttgaagccttcctttattgccagcctcctcctctgaaaggatcgaatcattttgtgagtattttcacttcctgaagggttcgtgctccttggacttctggggacaggcttccctgtgcaaagcggatcatccctttgttaataatccagcttttggaaaagcatgtttatacttagctattcctattttattaatattcatattaatatattgtatttatatattagtgtaatatttatcaatacaatgacagtttagagcctgtaaaattattcgcaggtgcaggttttgtgttttttttgagacggcatctcgctctgttgcccaggctggagtgcagtggcacgatcttggctcactgcaacccccgcctcctgggttaaagcaattctcctgcctcagcctcccaagtagctgggattacaggcacctgctgttatgcccagctaatttttatattcttatagagacgaggttttaccatgttggccaggctggtctcgaactcctgacctcaggtgatttgggaggcccacctcggcctcccaaagtgctgggattacaggcgtgagccaccatgcccggctgcaggtttttaatgaaacttaaaaattattaaattgtaggctgggtgcagtggctcagcctgtaatcccagcacttttgaggtcaggagttcaagaccagcctggccaacatggtgaaaccttgtctctactaaaaatacaaaaattggctggcatcatggcaaatgcctgtagtcccagctactcgggaggccgaagcaggagaattgcttgaacccaggaggcggaggttgcagtgagctgagatcatgccactgtactccagcctgggcgatagagccagactctgtctcaaaaaaaaaaaatgtaacttttattgttactttccctatagttttgagggtagcgtatatgttcattgtagaaaatctggaaaacacagggaagtatgaaggaaaaaccacagccccgtggccacagttaacactgcagcacacgcacctcagtctgttttccaggtatcggaatgtttccacgggcttagaacccatagcgagtgctgcagcctggtggtccccactgcaggcatcatttcagctcctctttgggacagcacttggaagcttttcatgatacatcctgagctctgctgtcttgtgtcctccattgatcgattgcttcgtgcttttatcaagcatctatttaagaaacaattaaaaaatatattttccagtttttgataacatgttataggcacatggcacaacattgaagcaatgtatgaggggacacagtgaaaaggaagtccctcggccaccccagctgcccttgcccttgaccaggggccctgccatgattgttttcctgtagcgccctcaggttcactctgtgtgtacacaagcacacatgcttgtcctggatgttgttcttaacacagataattatctacagcacacagggttttgcatcttacctgtttcacacagcaacgtcttggagataattcctcgtgggtgcatggaggccttctgtgttcttttttactgctgcatactattcctttgactgtgtgtggtttgttaatgtcccctcttgggggaagtttaatttgctgctagtgttttgctatcacatacagtttggtaattaacagggcagagccggaaacatattgcacacttgagcctgtctgtggggtgatgaggtgggatcatggagccagggttttcaggaggaacagtcacttgacaaccaatgctctgatttgtgttccctcctcctgtctcccatgtcccttccttctccctcttcccctttggcttcatcattcaatttctgaactttctggttatggcaggactttaggaacttgcttcttggggaatcgaggttgttggtgcctttgctctgcacgagtttcccagtgaaaaatgagccccgacaggttgttttattttcccgagaggctgtggtggtgcatgtgggattccaccaccagaggggatgcagttttccgctgccacctcctggtccttccattgcactgaggccctggaggctggagaccaggccttccagcttggtgccacccttgcccacggtggtgcacctggtggtgaacacgtgggtgtggggagagccctgttccgggccagctcctgcacttcctgagtctcccaggcctcggcctgctctgcaggtaatggggtaaccactgtcccaccctcatgaggctgcagaaggtattggtgagtggtgagcttcaaggggtgtgtagcatacgtgggtggccccctcttttctgccactgttgcaacttatcctttttttggagctctgagcgacagaggaactgctgtggctcctgggagatcaaccccacttaagattgcagccgatcttttctctagattacttttttgttgctttcttattttatgtgttccatctgttttcagtgagagactgtttttttaggactaagggagggagagctgcctgggatgatgtaaaatgtggactgattggaattgacctcagtaaagagaggagagtcacacgctgggataacccagatgccagcagggttgactcagagggaaaccgaggccctggcccagagcccagtggaagtctgcgctcctctgtcaccggcctttcccattgtgcggttcacagtctcggtgatttgggacttgagttttctgtcctggagcagggccgctggagtttgggctggctcctcaaggtcctctgctgtgtgtcctgggtcaggttcccgtcagtgacgcttccttcagttttctcgtccctgcggggggaggggcaggatgattgggaatgaggcaggggctgaggtgtccacaggtgctcagaaacggtgcaggttgtgagcgggtggttgggtgtagcacaggttcctcatgatgctatctgtcactgtgctgtgggctgtggtggcccagggctatgctgttgtgtatctcccctgtccctcatgaaaccgtggaagcagatggatattggccaccattcctacaggaactgcagacaagctaagagacactgagggtccctgaatgcctcaaccagggtggttctcaaactggattcctcggggcccaggtttctgttgaggtgtcgggggtttgagggaaggtgggctgggtgcttcccacagtgggacctggtcagctctccttggcctctgtcttcctgtctcatggagtggctcctttgtgaggttccgctcagtgccttgctatcagaaggtgttgaggaagccctcactgaatgagctgacaaacagatgtaggaattggtgggcggcgcctcagctgtgccatgaaacaagggagcaagggtgcccaaaggttcctgtggggcttgtgcccatctcctccctaagaccttgagcctctcaagggcccagactgtggaggttgcatttgttgtaccctccgagtgctgggcccaggagctgagctaaattgttacacatttacaccttcatctgccagcagccgttgaggagtgtctgtgtgccaggtgggcatcataattgggcacgggcacacatagctttaaagtttggcatagtccctgctccaaggagcttgggtgagtaaaccacacattcctgaccttgcctggctgcagccatctttgagcatctgctggaggcctttcttcccagcacaatgtgcacagtatgctgtcttgggtgcctcggtccctgcaggtcctggtggccctacaccagtgcttgtccctggctcgtagcaatcaataccccagaacaaagggccgagacagtggtagccttaagttcttccaggttaggaggcgtcctggagaggctatgctgagccgaatcctcaaggctggggtgggaggtgggcaccagggccagggaggagaaagccctgtgtgccagagctgcacaggtgggcacttcctgggcccacagtaagaaatgtgggatgggggaggctggacgtggtggctcgcgcctgtaatcccagcactttgggaggctgaggcaggcggatcacctgaggtcaggagtttgagaccagcctggccaacatggtgaaaccccatctctactaaaaatacaaaaattagccgggcgtggtggtgggtgcctgtagtcccagctacttgggaggctgaggcaggagaatcgcttgaacccgggaggcggaggttgtagtgagctgagatcgtaacattccactccagcctaggcaacagagtgagactctgtctcaaaaaaaaagaaatgggtcaggaagagaagggtaggagtcaacagaaagcctttgtgtgttctgggcaaaccccgacccaggccatgaggctcctaaaattgggtggcaagagtcaggttacgtggtggccgtgggactgcatgtgagcggggaagatgtagaggacatgagtgcagcttggaggctgttggcgaggccagggcaggcatcagtggagcattgggaaggcagcgggcaggactgtgtgggcctcccgtgtgtggcagtggatgggttggggcatgactggctgtggcaggtcctggggcgagacctgatggggaggacatggggacctatgggggttgagctcggcagggacggcaggtggtgaggatggtggtgaacttggtggcaggggccttgggacgacccaggctggagctcggctgacagaggcccggcccaggagtggagggaggtggctggcgtggggcctccagaggactccagcaagtccctctgcagagccagccctctcagtgggaaggtggtttgaggagtggctgggagtggaaggcatggctgttctgggacagtagcaggagaggcgcagctgccggctccctcctgaaaccctctcatggtcctgccctcagccggctgtcgggaaccttcggaaaggacgtgtccagcctgctggagtaacgcttgttttctttgtttttctccacaggaagcgagggatggaggttgtgcaggtgagtacagaccgcgtccccgtggttctttgggtagtggggcccttggtgcccacctctctgtctctccttctctcctccagcattgggcacggctttctctcttcttcacgtgcagcttgtttttagctcccctgtggatttgatgtggtttctgccctggcctgggcagactccgacaggggcttctcgggtttggagggttgctgtggctttgtcagtggggagagggttggtttgggagtcctgaggggggtgtgcatggcagtggtcaggttagggtgggtgtgggaagggtgagggggcagtaggcacccagctagatgtccagttgtcttgtgctctgtgtagcctcaccctgggtggacttggttcaggtgctcattaactagaaaaagaaggatggatggaagaagaaggaagaatggatggagggggaaggaaggatcttggagggaggggaaaggtggacagatggagggagaaggaaggatggagggagaaggaaggatggatggaggggaggaaggatagaaggatggatggagagaagagggaaggatggatggagggggaagaaggaaacatcaaaatactctcagactctatgtgaggggcaggctgtgttatttgcactaaaggctgtacctggcacctaatgggtacttggtaaacctgatggtggcctggccatgtcctctgttccccacgctgtccccgtggagggtgactgtggtctgtgcagctgggctggcatcccatctccttgtcttacgggcctcatctgcctgtagctgcagagaggggaactcaagctggggactagatcagggcagtggaggtgctggcccctgctagaatatctaaggggctttcaaaaagcccactggggagctcttccagcccacccctgttaacttcagctccaggccttccctcagcggtcataggagagcagcgtccccattcctgcaggttcagcattgcaggccccaggtttcccctgctcctgggaccagactggggctggttgacgggtggggctggtaaaggatcctcctgacctccctcctggtagtttgtgggttgaacttgtcactggaagactgagatttgttttggggtaaggaggtagtttctggaagcctctcagcagctctaggtttttgtccaggctcttcttggctctggagaattgcatgttctgcactagatttttcttttttctcttcctttttttttttttttttttttttttttttttttgagaaggagtctcgctctggagtggaggctggaatgcagtggagctatctcagctcactgcaacctctgcctcctgggttcaagtgattctcgtgcctcagcctcctgagtagctgggattagaggcgtgtgccaccacacccagctggtttttgtgtttttagtagagatggggtttcaccatgttcctcaggctgatcttgaactcccgacctcaggtgatccacccacctcggccttccaaaagtgctgggattacaggtgtgagccaccgcgcccaacctgcattgaatttttctgtgggctttaatttctccatcatcaagtgggggatactggaattcaggaatggcttaggggtgtgtgttcagggaccatttctgtttgattggttttggcagcctggaggatcctaaatctgtgagtgggtgggaacaggggttgatctgtagtgcctgccaggggtacaggcgtggaaagaggaggtgtggttattcatctcatcacggggttagatggtctctaaccattgcacctctaggatgcggtggcttctatttcccttttagccctctatgatggttcactgggaaatccacggatcctttacagatgctgctttacccacaataagcctgagactgacagctggggctcactgtgctcaggaaggccccgggttgccctgtggttccgcccagccacttgggagggtccatgggggaactgctgtgggagccattttcagaggaagtgagttcaggcgctccccagcaaacacactgcctgagagggcaagacagccttcccccatgcctgatcctgtccatacgcgacctcaaactgtcacacagtgggtgtcacccccaccgctcgaggagaggatgagagatggacaggggtcggcgggtttcatttatgtggcattctgggaagatttagactaaaatctttaatccgctcggtctgtgggaggaacaggagactggagccattgtgtcagaatgtccggggcagaagaagcattgcgaaatctttctagacatgtatgctgttcatttaggtggtggcttgggggaggaagtggtggctggggaccagaacgaagccaaactggacactttacacttcagcatctaaaaataaaacctaccacgatacctctctgttcacctcctcctggcatccctgcatttggagaacttttagattttaagacattgagaaagactctgcaaaaacaggaagccaagccacttggctggcttttcaaaatcagctgggcttctgtgcgcaggatctccaggctgctgggccctgggagctgggggtgtttgcagtcctctgggttcaggtgctggtgactgaagaggacacacgtccccttgctgccagccgtcttcctgtgtttcctgtgtctggtccctgaggggcgtctcccgttctgtgcagccacccagggatgatgtggtgttaagtacccttttgaggtggggaaactgaggctcagaatgctgtgctttctcttggggatttcagctggccgtggtggagttgggatttgagtgcaggtctgtctgtctcaaaagcctgtggcccatggttttctgctgaacggtctcctctgcatgttcataggttctccatttactaaatgcttctgttcctcttattacctggactttggctgctatctaaaaaaaaggatgttggggccaagggtcaggactcaagactgcaaaacgctggtgaccggaggtcggttggtcatgggagttgtttctcttcctgttatttaatggcaacagtaacagtccttttattgaggactccagtgtaccaggcatcatgggtttactttaaggaagcatttgtgtgtaaccttcccgaggtgggtgtgggagcatatttaagaaagtggattttgcagatctcagtgtcctcaggtgcctgtgctggaggctgaggagctcgggagcccttcttccctgccacccctgtgcctcttcacctcgttcctcctcccacctctgcagaggattgtgcactctgtgaggcgcagggccgcctggggtcaggttcctgtctgtgtgaccttgggccagttgcttaacgacgctgtgtctttctgctcatctgtaaaatggggataatcatggtgctggtcccctggcaccattgtgaggactgagttactttgggtgaagtaattggcactgggcctggcacactggaagctggctgtctgcaggagaactgtacactatccacaggcagacctgaccgagtgtgagacctcagggcataaaaccctcctggtggtcaagtacagtggccagtcattgtcatcctggggccagggaggtatttccagttccctgcttgcagcaaaattcaaagagtacctgatggtgtcgtcagctgatagcacattaagaatgacctttgttttgggtggctgaggtgggtggattgcttgagctcatgagtttgagatctgcctgggcaacatggcaaaacctcgtctgagggttcccccccaaccacaaatacaaaaaattagttgggtgtggtggtgtatgaccgcttggggctgaggtgggaggatcacttgaacccaggaggtcgaggctgcagtgaactgagatcgtgccactgcacttcagcctgggtgacaaagtaagacactgtctcaaaaaaaaaaaaaaaaagaataatatttgataagagatgactagattactgtaattcttggcaaataattataaaggaatccaaagaatttgctgtggtaaatctctttccattctattttttaaatttgaataagtggtttctgttctcacatctgtaaaaattaaaaaatggagatgaaattgataaaccctgtcttattctagcaacaggcaatattcatctgagaattcatgaaataatttttcaaaaaattcccattcattgtatagatgtatttttaataagatttatttattaaattttacttatttaattttttttttttttgagatggagtctcgctcttgtcgcccaggctggagtgcagaggcatgatcttggcccactgcaacctccgcctcccaggttcaagcgattttcctgcctcagcctcccaagtagctgaggttacaggtgcctgccaccatgcccagctaatttttttttttttttttttttaagtagagatggggtttcaccagttgaccaggctggtcttgaactgctgacctcaggtgatctgcccacctcggcctcccaaagtgctgggattacaggcgtgaaccactgcgcctggcctaattaagtttatttttaaaggttatttcttatacaattttgcaatatatttctgtcttattgatcaattgtatacttatagtaattgttataataattcagtccaggagaaaacttctgacagagctttatgatcacaggaaatcacaggaaattaaaaaaaattaaaacattgatttttgtattttttggccctatagtatataataggataatcagtataaggctttcaagcataaaatacactgtgatagtataaacatctctgagggagatcagagtttgtggaggaaaaaaggaacactgttaaatttccaatggttaaagaagagcttgattatgtaatttaaaaatggatgatggcgaatctctaatcgccgtggtatttagataccattggatccatttaaaagagaaacattaacagttttatttttaaatgttaatatttacagtatgttggaaattacatcctctacaagtatttagacttatgatgagaaatttttcatatcaacttaaaaatgtgcaaatagatatgtagttttaaacatttattttgtgggggtttggtttgaagtccactgcttcagaacattaccctgtttacttctcagaaccaggcctgaggcaaatccttcctcggagagggacagcacgaggccttgctctcaggctgtccagaggccctgatggggctgggctggactgggctgactctggggcccagaactgtgctccgagacttgcttggcagtggacttgtctgcagacctggtctgttgggccacgtgatgatgatcatgaaagacacagcactgtctgctcagggctgctcaggcaggaaaggaagttgcaggggagccaggacccaggtagctcagaagaagaggatgtcctactttgtgtttagagcagggagttgggctgcaggacaagggaagagtgtagtaagggtcgtgggaccagatgctctctacctcctgtcttgagaggctacttgtcatgatggtgatggtggcaagtgcctgtttcctcagccccgtgctctgtagtatggtaatgggaatgctggacgcacgggccaccctgactccaccatttcagtgttgagttggtctcactgagtgctgagctgagggcccctcatagccaggccgtgcagatgggacgcagtaacatgcagcagtttccccgacacttgctatggataggccccaggtgctgggggctcacacaggcccaagccaggccccttcaactctctgtgatgtctgcagacagtggccaaggtaggcagggacaccagacaggcacagaggagggccctcacgcagcctggtaaatcaggaaggctccctggaagacgagtctggttagtggcaatgagcccatctacccaacagatcctaactgagaggcaaggcctgacagagctcaacccagttcctaggtccttgtgcttccttctaaaacacctagttgctaaaatgaccaagtgccaagcacggcactatgattacttcccccgtacacaggagccttggtcgtctgtgatctggggagtggggctggggctctcctgtgggccaggcagaaggcctgcatcagccttgctaggtgctgtcacctgggggcaccttccactccgatccaatctgtggggaaggctcaggaggagcggtttccccatccagggactcactgcctctttctggaatagtcctgaatttggtggaggaagaccctgaaagaaagacccacctgctgccgggccccctccagcctggacgtccttagggaagcatgttttgcagcctgacctctgccctggcctgttctctgggctgcctttccccagttactgtaaaagatcggggagaaggtgactgctggcatgaggggactcgaggtttgactttaaagtgcgaatgagcaagctgtaagtgtgagaagtgcagcagccagttagagattcactgtcctccatccacattccttgagaattcagacactatgaaacccagtctctggtgcggcggctgtttctcaagcaggcaaggaagtaagtaagttctcccggcttgcgaatgagtgaatggtgggcatacgtctttctgtccgtgttttctccagagctggtgctggctggcttgctggtgacctttgtatatgtgtttttaccccttcctgcaccagactttcagggaaggaggttgggtgggtgaccatcaaaccaccaagaaaaggcaagtctgagaaagagacactaagacccaagggaaggtccatgtgcctggggccgaggcagaactgggtgctgggcctctggaggcgaaggaactgtggggatgcccactggcagggaaaccgtggggatgcccaagcccaggggcagggcaggcctgtctgagctgtgggggagtggtgaggacgcaaggctgggcatgtaaggaggagtgggccatcaggggatggaggccatacctcctgacatggaataaactgggcgtaggggctggcaggaggcgaggtgttagaatggccttacagacaaggagcatggccagggccacacacagcagctggggaagggggtcctttggctgccaatggcttggaaaggctacagccccaggcttgagggggctagtgagagaccaggctggagagagtagcggtgccaggtgagttgttcatggggtgctgtgtcgggggcatggaggggcttctgcaggcgaaagctgggtgctccaacctgaggctatgggggaagagccatggggaggatacatggagggtgattagacagggctgcactggaaagcagacagcagggttttctgagaggggctgtggctgcagcctagtgaggggtgatgtgctctccaggggctcctgcagtgacagagggcagcaggagacagatggcagggtgtggtacctgggtagatgtgggaggtgagagggggaggatcagtccccagactcctcccttgtttctggccggagtgcctgggcatgggggtgcaggaggagcagccgccagggagggaaagcccatgccagcactggcgctttccgataggtgtgctgagtgcaggcagcggaggcctgtgttggtagctgctctcggaattcagagccagaggggactcacgtggttgcgtggtgtgcatctctggaaggattataggtgctaaattctccatctcagcattaaaaatgtacttgttatttaggttatatttttacatggtaccaacatttttttaaaaggtatgctgaacacagtgtcaaatgatcaatccacagcggggttccctctgccacccatactctccagcgtaccccagctggctgaccccggtgctcttgatggattttatttccaggtcactggggcataggtaggggtggacacctgtgaacatccttccttctgtcgattttctctgccgtgtgctgtggagccaagcgtaaagggctttgggaataacaatcgctgtggggttctgacgtctttggagctgggacagcccatggtagacttgcggtccacccatatcctgggcagtggctttctgaagttcacgtgagcctgactctgacctctccccagaccccatcatctccaaggaggaccgccacgggcttggggggctggctctgcacacagtgtttccatgtggtcatttgaggccagtaatggacacagattgctcttggctgtgcctcacttccctgtggggtccagagacctgggtttgagtttctgagtctgtttcctggctgtggatcttttccttcctctttaaagggatgacagcgcacaggattgaagacacctaagagatgctgaaggaatattaattgatttttactcatctgttgttatgattaatggtggcatttcagtggggaaaatacagctacagatgaaactgggctgttgagaaagatacattgtttcagtgtggagaatatagtattttttttttttttttgcctcccctctgtatcacttttgggtttctaacaattgtggattccagcttactccttccttttttaaaagatagattttatggtttttttaaaaaatttgaaatgcaggtatttttttccccctaaacattgacaattattttcattctccatcatttactatttgcttaggctatgtagataacaaataagacaaagttatgtgaaagcatgatccccatagtgttttttaataatgatgatacatgaggtgctgggaagggttatataaatgaggtctgctcatagcagttctccaatgtggccattaaaaaaaaatcacatttttcacattttggaagacagcgtggggaaatgctcgtgagttgctttgagtactgtcgtcatactctgagtggtttcatttctatccgttttattttggttcctgagctttttaggtttgctgttagaaatagaagctgtcaccgtgttgcagtcttgtgcagcttccgaagcctgtggcactcagttctagggtgattctttctccagcctttgatgcactgagtcaatttgagcaaatcctttaaaaaaaaaaaaaagttcccacatcccatgtcaagacaacagagctctgccagggcaggtggggctccctgtgctccagggtgcctgggtgccttcttgcaggcaggcttccagaaccccaggccctcctcaccacaccacgcagggttgggactggatctccctggtacctgccacccttgcttggctgtcaaatgtcaagaattccgtggcctcagtggagcgtgccaggtaagcattttacgtaaaagcaaagaaaagagatggaatgaagtacacaggggaaataggaagggatggaacgggggttttagaaagggccagaagcaagattctgctcttaaagtagctgactgtcctggcattctggggtgaaggtatccatagcattgctactcagagtgtgatcctagggaatctgggtgcagatggagaaactcggatgcaaacactggattcctcagcagtcggttcccgtttggcctggtgcagggctgagactctgaggaggaggcatcttgacctgagggccctggactgtgctccttgtccagctgggcgcagaaccatcgtagtcaaagccaggaatggagatgcattgcctcaggtcagttccaaagaccaggaagcgtccctgagtatttcagttgagtaaggacctggcatctccctcttcagccccttccctgctctcatatttttattcatgcttttagaactgctaaatgtcaggtgggtgcagtggctcacacctgtaatcccagcactttgggaggccgaggcgggtggatcatgaggtcaggagatcgagaccatcctggctaacacggtgaaaccctgtctctactaaaaatacaaaaaattagctgggcgtggtggcaggtgcctgtagtcccagctactcaggaggctgaggcaggagaatggcgcgaacgcgggaggcggagcttgcagtgagccgagatcgcgccactgaactctagcctgtgacagagcaagactccgtctcaaaaaaaaaaaaaaaaagaattgctaaatgtcaccttggcagtgacacctaccctgctttcccagcagacgcctctgccccctacacacacacacacacacacatacacacacacacatgcacgcgcacacacgcacgcacaccaagctgagctgcctgttggtgtgtcctcctgaggctgggacttgctggtctctgaggagcacgtggtctggccctgatgtgcgctgtgtctactgggtgagtgaattaaggactgaggtattgtgctacacaggatgtggccaggcctcgagggtctgtgcttgctaaaaataactctagattattcttttgctcattaagtaatatgtacttgtggaaatcttgggaagtcaagataggctcacaaatgaaaacccagagataattattgaagcaatttttacataaaatatgctcctttttctatatgatgtgcattcaggttaggcttttctgtgtccctagttttgccacttgcatttgggggaacagttgagcatttgcctgtgccatttaaacaccttggaaattgctgttagagtggctgcaccagcttcccaccatccctatgtcccagcatctagaaccatttctctgctccagagtctcaagttctaggttatttctggtttgctgttactaacagtcctgccctgggtgtctctggacctaaatctttggggacctaagtcacatctcaggctgtttcattgggttatggtctagaagtgacttcaggattttgttgctaaagaagaaggggagaatgggggacaggttgggctgcagctagtcagctgtgtccagcacacttgggccctggacttagaactggacaggttacttgccccctctaagcctcagtttattcttctgtaaaatggaaataataatggacccagtctcatagagttccaggagtgaggtcatgcagataaggaacagcacagaacctgtttacctagtttgtcctcagaaggagctgtttgtgattatttactggtgccacctccaccaccatcattgtcatcctcagtggcccagggaagcgtgagtctgaatgaggtgtgttgtgtagttaaatgatgcgatgggtagatgagccaaaatgaaaggatctcttctgtttgatttattttcatgagtaaaaaagccagaaatgtctgtagcataagttatgtctgtttggtttggctaaagcagggctgaccagggatgagtctcctgctgtgagtgagtgaggtcccagcttgtcctctggggttagagcagattttgctctggctggggtgcatttgggggcatgggctgatttatgttttccttctttctggatctccccaggtctagccatgatggggtgaaggcatcacccccagggagtgctgacccctgaccctagccccatgaccccctcccgtgctagttcattatgggcaggggaggtcccagggattccccgcacactcatcgtgacttttccaaaagctgtgtaaatccagagttgtaacttggctctgtctttctccttccccttgatccaccctcagctcaagaactcccctgggaagcacagtggctcccgtctttgcctcaagttctctgatgttctgcacaaatggtaggcagagacagccctttcagggacctgattgccctggtgtctagttctcctttcacaggcctgttttccagctcgactgtcaatctgagtctttctctttttgagctttatgcaatggccttagagtataccctataaggagatcccggcttgctggtgcccggccctgcagctgtgtcccagaaacttggcggtggtgcatggggctcactcagcacttctacagaagccgcctggggtggctcccagggttccggtgggaatggggtacagaggcctgagagggggctttgatcaggtgtcctgggggaacatttagagctcctggattctctgcaggaaggccaccagcagccaggcatgatggcctgtgtctgtaatcccaacactttgagaggccaaggcaggagaattgcttgaagcctggagttcaagaccagcctgggcgacatagtgagaccccatctctacgaaaattttaatttttattttttgagatggagtctcgctctgtcgcccaggctggagtgcagtggcgcgacctcggctcactgcaagctctgcctcccacgttcacgccattcttctgcctcagcctcccaagtagctgggactacaggtgcccgccaccacgcccggctaattttttgtatttttggtagagacagggtttcaccatgttagccaggatggtctcaatctcctgacctcgtgatccacccaccttggcctcccaaagtgctgggattacaggtgtgagccaccatgcccggccaattttttttttttaaaggtcaccagccctgttgtctgggcagtaagcacctagtaggattgcttcagagttctagaatgcgcatgtaaaaattccaaagtgcgtttggcgtctgggctgggcttctatgagcagcccaggcagcagcagtgagaactcctgtgtgtgcctcgtctactgagtgccagggttagtgccccacttgccaggtgagaggactgaggctcacacaggtgggcttgtcacagcctagcatgtgagctgtggagctgggattggattctagaggtgtgatggcatagccagtgcctcttctgctccgaagactgcctgcctggtgagagtccagtgactcctccctagttccagctccatccctccaaggctgtgcagtcctgggtagtggcacaacctctctgaggcccatctaccagatggtgatgagatggatgattgagacgaggggagggcaagtgagaaggccttctaaaactcaggccctcgtaggagaagcgtgggtagcctgaggtcagggacagggcttagtgtgctgtgtggggctgtggggagtgggaagctcactggttttctggctcctgagatgactcgaggggtcttgtgaagctcacacccctgtctcactgggcaggagtttggcctccactgtgggtctctgccatctcaggtgggtgggggaccaggggtccctgggcaggagggtgtgggtcctggcttggaggcagaccttggctcactcccttccttgcccaggcagtatttttgccgcaggccctgccaagtagaaataagttatttacagtgttttgacaggatcatcggcagccgggatgggcaaggatgcctttgggactgagctaatggccaaggagtggggcttggagaagggtctggcgtgggagagagatgggagatgggggtggggtgggggcgcacatttactgaacttgttaaatcttgacaaatgccaggcctggccctcccttaagccagggctttggggcctggtgagggcaggacttgatgagttttcctgtcgaccaaatattccgccggatcgctcaggaccctcggttatttttgctgtctgagccctcagtgccttcctttgtccatcagggacaaggacccctgcccacccagtatatcttcttggggagaagatgaaacgccttggtgtatggtaggccaggccctggccttgactgtgagcctggcagcccctgcagcccctcacactgggccaccattgacctgctttacgacttcaaatagcacagacctgccgtgggaccagggcctcctgctagtgcctgacctctgtcctgcatgatgttctgaccctccagaagcaggtttgaaagtgcctttcaggaaggtctggagagcctcctgtgtagcttgtgggaacaaaatgtgttactccctagccgaaggataaccagcacactaaaatgtgaataaagtgtgactttattcatgtcctttgagcataaaaatggcacacacactgatgcattaaaaaaacttttttttttaattaaactttttttagagatggggttttgctctgtcactcaggctggagtgtagtggtgcgatcatagcttgctgcagctttgaactcctgggctcaagcaatcctcccacctcagccttcttagtagctgggaccatggtgtgcaccaacatctttgatgcagttttttttttgagatggaatctcgctctgtcgcccaggctggagtgcaatggctcgatcttggctcgctgcaacctccgcctcccaggttcaagcgattttcctgtctcagaccccagagtaactgagattacaggcacgcgccaccatgcctggctaatttttgtatttttagtagtgatggggtttcaccgtgttggccagggtggtcttgaactcctgacctcaagtgatctgcccgcctcggcttctaaaagtgttgggattacaggcgcgagccaccagccttgacatagttgtaaacaaagttgtggttctgttgtaatctgttcccacaaacacacttagcattctcttagagcttccccctttgttaaatgtctacttaggcttgctttttaaatgactgcataatattatctgattgtaactgaagttctttgattcccttggttgatgctgaccatggttctggtctgtcacctttataaatagtattgtgataaacatccacttttgatactgtttgggcaagcctgtgatgattatttctttgggttacataagtaagttgtatatattgtttttgtagtctgtaggaggaatatgtacttcttggtgaaataaacaaacccctgcattttggggaattacagaaagggaaggtcttgtgggagtttgtgcttctagatttgaatgctgtgttatcacctgtgcaccaggcacgcatacagcaactcatttctctctcatgtgccctccctcccctcctttctcactcctgccccagacccactctctctgcccatgaggctgggggctgtagcctagccgcagctgtgcccatggacttttctccccttgcaattgttcctcaccccagggagaggaggaaggagtggtgggctctggaggaggtgggtggtccccgggtggcctctggtcttgcttcttcccagcaccgagggtgcttcagcctccttgcctggaaaaaggggttgtcgtaacaccaacctctaaggttaagaagggtaattgagatacagtgtcaaagtacttatcacacagcctggccccagatctgtgttgaggaatctgcagctagtggtggagggttaggagtcatttggggaattgcagtccggaaagttaatttctgaagagtatcaaacaccagcttgcatgttaagttgtcttttggagtgatccctccagtgattccctagtggtatggagccagtccagatttggagtggaacttttgttgtgggtgtgggtcactgttccagggaaccccagctacctgaccttgaaccaaaatccttgtcattgtggagcctgtgtccccctctgccttggacttttttacttttatcttcctagttctcataatagctctgtgagatgggatctatttattattctccctattttgcagatgaggaaactgaggctcagatctgtcacctgcttctgtgatatttctagtcacagagctccaagcaccaatcactctgggtctttgaactcagatctgctgttgcctatggcctaggctctttctactctgactcttccatcccctgccccttccccagtgctaaccagacctctctggttcctcataaaaacctcccgtggccttcctgaattttccaaggctaccacacaatcagccccctaataccttgcaagcatgggccttttgcagcagagcagggtcccctccattcctgagcttgtttcactgtccccatgctgatactcgcctgttccagactgtgtaccctcagcctggcctctctcctggtcagggtgcatgcctggcccacgtagcctggtggttctgtgctcgtctctgtggctcaaatttgctccctgtcttctgaccctgtatgtgtggtgacccagaacgtgttcctcttcatattagccagggagcttgcaggaagcagagctcaccctcagtggttcaaagagagccttgaaagcaggggctgtttgttgagctgtgggcagggttaagggagcagcgggggctggtgaggcacctagagcctggcagcagagaggagctgttctgcttcttgggccgcaggtaaggtgaagaaagtgtcgcagaagctctgtgatggtagtcatagcaagccacagccactgcccaggcatgtcactgaagcagggagagagaggggactaaataccccacccccctcctcctgccctctggtctcctgccagtgacccctcttggccaagtgcaactggaagccctggatcttgaatgctgcgttctacggcagtcagcctcccaggctcagagccaggcagtgtggatgggggtgagcagggagtgaccagcaccccccacccctgcctcatgacctgcaccccctccacccctgcctcgtgacttgcaccccctccactcctgcttcgggaccctcaccccctccacccctgcctcgggacccccaccccctccacccctgcctcacgacctgcaccccctccacccctgcctcgtgacccgcaccccctccaccctgcctcgtgaccagcacccacccccgccttgtaacccgcaccgcttccaccccgcctcgtgactcacaccccctccaccccgcctcgtgacccgcaccccctccaccctgcctcgtgacccgcaccccctccaccccgcctcgtgacccgcaccccctcaacccctgcctcgtgacccgcaccccctccacccctgtgttgcgacctacaccccctccacccctgccttatgaccctgtggacctcaaggcagagcagcaatgtgtcccgtggcctctgtgagagcggacccagttcttctgtccctacccagagtcccgcatggccactctggcttcgaccttccagactggccctcccagatgcccctgtggccatcaccccatggctcatttctgtcatcaatttatgattgatcctttaagggagctgatgggcttgcaggcccagggccctaacaggggctcagcccttcattccttctgttgctgggtgctcacccaggccccagtggcaggtcccctgctgccctctagggactctaagatgaccaagtctttgacctcttctgcgtcagtagctcagggagacagacaaccatggggccgcctgggaagatcgggccagggagctggggagggctctcgccgagctgatgggtttctcccacctgtcagtaggtagccccttgagagacagcatgtggtgatgccagaatcgtgggtcatgatcctttttctctccatcaaggtgcctagcgccaccaagcatggtgagaatgaccaggagggtgcctggtgggtgagccctgagtcgtgtggcccccatgggagagcatgaagccacggctgcctgtgctgcaggctggggccgcaggagactggggtccctgctggttctgcctctcctccctgcatggcctcggccgggctctgcttctttctctgtctgacagctgataggatctcatgggtcccgtttcactctcaccttctgtaaatccctgattcttcagaaaacggggctagaaaatctcccaggtgtactcgcacgtctgtttcctttcttagcctttcatcttgaagtcagcttggtgaggttgccctgttcatactgcagaatccagggatctgaggcctctcgccccctgggcagcaagtgagtaggagtgagcaagtgtgtgtgagtgagtgaatgtgtgagtgagtgtgcatgtgggagaatttgtcgatctgcttgaagcaggctctttgggtgctgtttcagcaggacagatttcgagagaacacagctagctctccacgttggacctcgcctgggtgcagtgtttctgtgtatagcaaatgcacacatggctgcctgtgtatgcgtggtggatttggagtctgggtgatgggtttgcacgctgcctctgaccttgaccagccttgtgaccctggggagtcactgtgctctgggcaagtcgcctgtgaggctcataatcctgacagcattactcatcctcggcctatggtctcccgggtggcatttgggagcacccagagggtgagccaggcgctttctaagctgtaaaagtgccctgtgatgtgagcagttatgtgatgtgctctcccagcagcacccagttttggaggctcaggaagcattcccagcagggcctgtttttagccttgaaacatcatgcttgaaaaatgcttgcatggggtttatttaactttaagtggggcaaattctgaaatgggttgtttattgtccaagttgaatttttaatttctcataaattccccacaaattgctatagtacatctttatttgttgaatctgtcagagttgtttatggcactgaagcctgggctccccctgtttgtggactgttgccatggcaacaccaggctctggaggaggggcactgctctgaggtggtatagaaggttctggaatgggctggtggtgtgaagtagagctgtggctgctgcactgagacccagccgtgggtggactgagctgcttaagaccctggttcctcttcaacatcactgcacccctcttggtccctcttcccttgggggtgcactgctgaggtctcctaattctgcttccctaagcccttgctgctcccagtgtggtctgggaaccagtggcagctgcactgatggggcgcccatgaaaaatgcagactcccttgcccccagacctgctgagtcagtctgcagttcaccaagctttcaggcaccttctcagcatgggtaagctgcagaagccctcacatgccacactgcccttgggtgaccccagaggccttggcctggcggttcttggtgtttgccaccgtcctccctgtgatctttctgactccttccccgacagttccctctgcttggccaggagtgggctttgcctctcaaccctgctgcacccaggccactctcctgctttgcacacaccagtctctactcacacagtcaccccagccttctctatctggggaactctggacatcttggaagaggcaactcttgagacacctcctctgtgaagccctccctcctttccccagaccgggtgatgttcagtttcactggagctctcctgtggcctaaacacctcacctgccccagcctcatcaggctgcctgattcacctccctagccgtgacctcactgggtgccccggctgctcctcccgtctgctgggtgctcagaccccagccagcgctcaggaaggtctgtggagtcattgccactccagtcagctggcttcacaaggctgagacttgagtctggacttcttccaagagcctgtactctctgcccggggagtggtagggaccgctgggcaccttcagtttctacctgaggcctgactggcagttggggctaggaccggataaggatgggtccttggactttggaaaggcgctgtgggagggaggcatgggaggggacagctgagaggagtcccgagctcatgcgcaggtgagtgcagaagttcaggtggcatttgtatgtcccttgagtatctgttctgggccaggcagcaccgaggctcgggagagtcccagtaaacaaaccccaaatccctctgccttcgtggagcacttgtgtctaggttgagagactgaaaacagaaagaagtgtgggtggcgagtgaggtgggggagggggactgggagaaaaatgaaggagagtaaggggctgagggctggtgtgggatttgggaacatggcttggttaaagctgaggagatgctgaccctttggccctgcaaatcctccatggcatgtacccaagagaaaggagggctgtgtccaccaaaagacacgtgtagaatgaatgttcccagcagcagcattcctgatggcctcaaagaggagacagcacgcatgcccattggctgtagaatgggtacgtacatgacctgtgttatcatctggccatggagttgtatcgaatacagcagtgagaatgaaccatggatgagtcccataggcatgaaacgtggccaaagatgccaggtgcagaggcgtattcagtgtctgattccatttacatgaagatcttgaccaggccaagctactctctggggacaggaggcaggctggcggtcacctttggggacaaggtgccgggtgggaatgtgaggagcctgctggtgtcttgcaactgtcctctcctcagtcttcctcttgggtgccagtttgtgaaatattcaagctgttcacttatggcatgtccttcctttcttatgttatacttcagtgaaaggcttataaaagaaagaaacagaaggggaaaaaagccatgagaggcagagagagtgctgttttctgtaatatatgcccttagattctctagaacattggttctcaagccaccgtacatatcaggacatggccaccgcccctcctgaagctctccttgccaggagtgatgcaggctccgaggatgaaccacctggtgagaagccagtagccccagcggcatctttcttgctcttcactggactggagcctctctgtaatcaagggagtacatgttctgtaccccctggcccagtgtctagttagaatagacagtgagcatttacagattgaatggttttttgtttttttcccaatggttttagcttgtctttgggaatatagggtctgtttctgggcatggagaaacagggttccctcctgtgctttaagtctaacctccaagccagagaggtggtactggcaggagataagaccacccgttgtctggatgctgttttccatgcagcagacatgggctccagtttctgtcaatcagtttattaaaacctgcgtttattacttgtttgccctgtgccaggcactgggctgtgtcttagtccagccccacagtaccctgtttacagatgacgtcaaagcagctacacgtgggtgactggctcggttcacttgctagaagtggggactctacctctaagtggggtgaatcccaggctagcacttgacccactgacagggtggaggggatgtggggaaagaagatgttcagtcagggttggatgcatgaagtgctgggtgggctgccaggaagtgcttctaagcctttgctcttcgcttccttccccgaccccatctctccctacttcagtctgacttccctccatctagaatcttcccagatgactccacaactgggtagttttacctgctgtttctgaagcctggctgtcccgtctacctcccaaacatcagcccaggctccagagactactggaatcacagtcacctgggagattgatttttaatagactctattttagagcagttttgggttcacagcaaaattgagaggaaggtgcagagacttcccgtatctgccctaccctgacacacatgcagccccccttactgtcaacatcccacgctagcctggaacatttgctacaatcagtgaacctccctgggtgcatcaggatcacctgaagtccccagtgtgcatagggctcactcttggtgttgcacattctgtgggtttggacacatgcatagtgacctgcatctaccattaccataccatacagagcagcttcactaccgtgaaagtcctctgcaccgcctgttctttttaaagcacttctaaaaagaagtgctgatggggtggcatcaattatatccagatctctggggcagctcttgagcactggctgtcatgaggcccccaggacaacaggcagccgggagaggggcgggtggggaaccactggattgaagtaatggttctcaaactggagtgtgcactggaacccccagggagcacatcttcaaacaggtggctggccccattcccagggtctctgaaccagtaggtctgagggggctgagaatccacatctgtaacaggtatccaggtgatgttgaccctgcttgtgagcccctctgtctgagaaccactggtttttttttattattattttttattttatttttattttttattatactttaagttttagggtacatgtgcacaacatgcaggtttgttacatatgtatacatgtgccatgttggtgtgctgcacccattaactcgtcatttaacattaggtatatctcctaatgctatccctcccccttcccccctccccccaccccacaataggtcctggtgtgtgatgttccccttcctgtgtccatgtggagaaccactggttttaaacagtggtgacgaaaggtgtggttgggccagatgtgcctgctcagaaagccaccagagcgctttccaagtctttggggcatctgggagattgtgcccggcccctttcccagttctgagtgagggactgaaccctgggatgggagatgtagggctgtttcctgtaccaccagccccttggggacctgggtttggagggagggtggtggtgcgggcaggtattatattgaatatagagtgagccagaaggccggtgaggcttgggggcgaacttccagcccactgagtcactctcaggccgtctctggccccactgaaggatctcccgtccccctaccccactgggggttcctttggccctcacagaaggacagataaggcccccagggtaagaacaacccagaccaggcctccctgggtcagagagtcagccagggcctggtatcgagacttagaccttggagagcttgggattatgggagaatcaggctgttcttcagacaacaggccgccctagatgcctggcgtctgttgtaataaaagacctttagtggaaactaagtctgttgcctttggcctcctaggagcccagcaataaaatcagtgtaaatagagctaacatttgggagtggtttataaagcacttgaaaaaaatccctcatataaacccaaagacagtcctacaagctgcagggacaattaattatcctaccttttggatatggaaattgaagttgagaaaggttaaataacttgcccatggtcacagatcttttaaatggcagagctgggatttggcctggggactctgccacccaaatctctgtgctttctgctgtcttattccccttccaccacgtggcccctccaggcagagatgaaggcgctcccctggtgcaagctccagctacaaaagggtgaagatggtggtgccctcagagtggaatgtgctggaatttctcacaacagagttgttcttgaaataggtacttattcttggcatttcttagccaaaaactgcagaggtgagtaccccatagccataacagtggcagggattagggagtgagttagcgttacaatggaagggcttccgcccaatctgctgtcttccattccccatgctgagacatttggaggcacagggtggtttccggtctcattgaattggctttcacgcttggctatgaggcacccctaggggttccttgaaggggtacctgcttttcaagggggatgagttgctcaccactcccttcacctgagcagctctttcttttttttttttttcttttgagacagagtttcatccatcacccaggctggagtgcagtggcatgatctggactcactgcaatctccgcctcccaggctcaagcgattcccctgcctcagccacctgaatagctgggattacaggcatgcgccaccaagcctgcctggtttttgtatttttaggagagacagggtttcactatgttgcccaggctggtctcaaactcctgagttcaagcgatccgcccgccttggccttccaaagtgcagggattacaggtgtgagccacctttcccagccactctctcttgatctgtgtttgatctggggtctgcatgttagatttcatttcaggaaagacatttgaggtcagagagagtttgaaaaccatggtgtctggggcagaatcctgggatattcagctcccccatgcctgggaaattgaggcatgtgtatgtgcagagagctgtgggcctgccaggtgcgtgatgactgttggctgtcaggtcctgggggtggagtgtggccatcaccgtttgattggttccttgtccgtcaggtgtccttctgagtgcccaggcaggccgggccctgtgctgagcactgggcacatagctgagagcaaaactgccacatcccggtccttaaggagcttccagtttagtgggaagacagaatctgtcttggatggactttgagtctcttccagcaccgcaaggcgtgtttattaaagagctgggcattggactcgcctgcacaggtacctctgccagctctgcttgctgatgggccagtgacactcacttcctcccccacacgtgtgggcctacccgatgctggcgactggaggtctcggtaggtcagccatggggtcactgaggtcccgtgacttggctccctgggtctctaaccattcctcacctgaccccatctctccagaattactcttgtggacccccctcacatccagggcttggatttgtcacctttctgggtggagagaataaagggaggaaacacgaactgaggtggggtgcaggagccaaggcaggccctcaaagtgtgcatcgatgccttcaaaagccagctgcagtattcggccacctgcgatccctgggtgcccgccatcagcccttgctcctctctcttgccttggataggacagaagttgacacttgggggctcttggagaaccatttggagcacgtggaactcaagagtgaatcacttattttttgctgtgtggcagcagggcctccctagacaggacatattcgggggcttgcagccaggtaggggagtggaagtacctcctctcaccccacacacgggaattggagatgaggcagccgatcctgcctgcttgagtctcagctgtcattttccaggctggcagcaccagcaggagaacccgtgtgtccgccgggctttctttaaaatgcaccgagtgcaacccagtcctccttgtgtaaactttctccaactggccagatggtttgcttctatttaaggcagtgagagtatttcctacggcctgctgccccctggcctttgttttgccccgggaaggccattcctcgaaagggaagctgagcaggagttgcacttcccagcagcagggattgtcggcgcccacccccatggcaggcctagaacctttgccaagtgcctctgcctggagggaccgtgtttgtaacttgactccctctgtcccttccaaatctgcttgtgctgtgttttcttagatggtcatgaaggtctccccccatctcccaccccagctgccagcccggtgcctctgtccctccacatccacatcttttctgtttccaggttctgttgatttttccctctggatatttccttacccaccccccacccccgtccttctgttctgtgaccccggtcagtctcccagtcccccttacccattattgccaagcctctggctggcatccccagctctgggctctcccaccctcagtccagcccccacctggcagaatgatctttcatcgagaatatctgagtcactccactgatctaacctttcctggcctttcattgtctttaggttaaagtctaagccctggagaatggtttatgaggcccttcccagtttggtcctgccagccaggcagcctcaccccctgccattcccaactcagacaccagcaacacctgcgcactctctccctgcctctgcacttgctggtccgacctactccagccagatgtcacttgctggcagaagcattcctggcttcccctctgtcccctcacctcctctgagccgactgtgtttacctgtgggctcctcgcaggcactcaccttggtacttagcacagagccctgcatgcaggaggccttccacacaggattcttgtgtattgctgactttccccccaggtctacctagaagccacagaaggggttttgtagggcttttaaagggcaaatggaatctgttattctttagtatcattaatatctgcaaagtttccttctcagcagatcttcacttctcattgtctacactgtcccttttcctctgggtggcagtgatgattggcctgagcctgttatgagatgcttcattcccagcctcccttgcagtgggggtgcccatgttatgtgcacttctaaccagtaagacatgactggagagagtgtttcttttttttgagacagagtcttgccctgtcgtccaggctggagtgcagtggtgtgacctcggctcactgcaacctctggctcctgggttcaagcagttcttgtgcctcagtctcctgagtagctgggattacaggtgtgtgccaccatatctgggtaacttttgtatttttagtagagatggggtttcatggtgttggccaggctggtctcgaactcctgagcttaagcaatccacccaccttggcctcccaaagtgctgggattacaggcgtgagccaccgcgcccagctgggaaagagtgtttcttctctttcaaagggttggctatttcgccctggccccttcttccccgcttccagatattttgtgggagtatcaggagctttggcagctgtcttgtgagcgtgaggcgacaggcacgcggacaaaggtctaccatggcgagcatggcagaatagaaacttgaaaggagtatgggttcttgctgatgtcaacctgttgaaacaccctggagactccactccctcctaacgttccgtccttatgattaaagccatttttagtcaccacttaaaaccagacacatcttcactcatgattctgagcttgttggaattgttttttgttatacgaaaaccaaatgcacccttgacgtaaagactggccatcattgaaacaaagctttgaaggccgaaggcgcttgccaaagagaaggatgccagtgctttgagtgttactaccatcgatgtcagaaatgtaggtgcccaaaaggatgaccgttgggcaccctgttcatttggacatgttatgtcagaaaacaaatcataccatgttcaccatgttatgagaaaatgtaaagcctcttcaggttgtaagtagcagctgtcaatatgaaagaaaaatcttaaggaaatgtcaataaatagaatttattggcctgaatgtctcagaaggtccagagataggtctggcaggtttcaggccattaagaactcacatgtattgtcatcagaaatatttcttcacttttcatgctccttgtgaaagtcattttgggtgggcttgtgccaagtcatgtgaaactggttgcctgcagcttcatccccttggcttaacagccctgcaggaagcagatgtcgggctggctggtgctggctggctctggttggcctggcttgggtcacatacatatcatatttgcctgctaggaatgccataacaggtcactgcaaactgcgtggcttaggagaacagaaattcactctcagttctggaggctaggagttggactcaggatgtcagcagggcactgctccgtctgaagccccgaagggaggagccttccttgcctctgccagcttctcatagtcccaggcacgccttggcttgtgggagcatcgctgtagtctctgcctccatccccacttggccgtcctgcctgggtgtctgtgtcttcacctggctttctccttttcctataaggacactagtcatattgaatcagggccaaccctgatgacctcatcttaatttgattatatctgcaaagaccctgttttcaagtaagatcatgttcataggtaccagaggttaggacttcagcttatcttgttgggggacaaagttcaacccatgacacctgtccttgggctggatgacatgatactctagctggccaggactgtatcacttgcccaccccaaagtgagtgtgggtcaaccccctggagttacgtggcttaaacgtcggggaggaaggttcttcaagggaactaagttgagggcagtccacagatggaaacttggcaaaggcagtggtggtaatggttcaccagcagcccggcttggcctgagggccccagctttccagtccggagtggtccattggtctgattcttctctcccagttcggtcccctctttcctgacttccattctttaactctgcaggagggggcgcttagtttagttggaggtgaatggagagggaagggagacccaaagcagggaggcccttgtgatttccctaccagccgcctgctctgggctggagcatgggcctcagatagcctaggtgctgggctgcatgtgcggccttgtgggagttccaccgagcagagcttctgatgggggttcgcagcctgggtgggctagctagtgaccgagctttgatggtaatgaaccatcgtttgctgcttttattcattcactagtttttcatctgctgtgggagaaggctgtgggagtgtgcagtccgaaagaaatggaaaaacaccagtctcctgtttctgccctgtgctttccagttgaccactcatttggagatgtttctgtttgcttgtgttccccccgccgcccccccccgcccccggctgctgggccatccctgcttacctagcctttttctgaaggtcttgaagcccagagcacttaggaaagtctgagcactaaattgcgtcctgcccaatcaccatatcctgtgtgtatgtcttatctcctttatgacaggaacatggttcatagttgcctttatctggagcacatggggccatgtgggaaaggaagcttgagccaggccaaccctgtgcagaccctgctgtccccaccgtggggccccgggctagcgctgtttctctgagcctcagtttctacctcctcagaatagaaaatgggagtagcactaatggttgagatttctctcagccaagtgtctgtgagtgggtttgtgcatgcctgggacctgagcaatggccacaagaaagtcctgtttggagcttgtggtcagcctgggcgatgaggtcaagatgccctgagagtcaggagggaggggtgcggcttgactgccccagaccacactgggaggtttgcagaagaaaagagcgtggggtggggatggggtcaaaaaggactctgtgtgtgcctggtgagggcttgaggcccggctcacagaccactggtggacccgtcccgccagagcagtgaccgcttgggaggcagtgagctgtgagtgtggaaaggaagtcggaggcaacgtgggtcctcatttgggggcactggggagcgattgaaggtttttaggtagttgcagaggacagtttcagggaaggtattctggcagttctggcccagggtggattgggttgtgtccaggctagaaactggatcctgaaattagttctgaaagaataaaaaaaaaagtctgaattagagagtatagcttaattttaattactggtccttgttaattagttctctgattgcatgtaagccaaggtctctaattggattttcttagatagggtttcgctgtgttgcccaggctggagtacagtggctatttcacagatgcaatcatagcgcacttcagccttgaactcctgggctccagtgatcctcctctcacctcctcctcctgagtagctgggactacaggcacgtgccatctaattggtttttaagtgctgtcagtacgtttcagggagactctccacccactttgcgctaatcttcccccatcctggtgatttgctgtagagtctttgttatggggcaggggcagcatagcctacttccagcctctcagtctgcggcagtgctcttcagggtcaccaggggagttgaattaaaaggccactctgacctggcctctgtggtttcctggccggctgcatggaccagccctcaagcgctgcgggaggcagagctgctgactggcagggacaggggcctgaggtcttgcccagaggggtaactggcctctgcttatttgtgagaggtgaggcttggaggtttggtttgatcttgatgccctgtgcctgcaagggcaaggaaccagtgcctggtgacttggaactaaggcacagacttccatttcaggctcaaaagcagcatggcactgggctgcaaagtcagggatctggttctttaaggtagatcttacaggagggagaccttaaatgcccctttcttcctgatctgacagatcctagagccctggggcctgccctggccaggagtcctggtgctaaaccctgtcaggttggtggggaaagggcatttaaggcccttaccctgttaagatatatcctaaagaaccacaaccctgacttgcggcccacgctagtccgtcacggtgtcgggtttttcttgcttcttcctcttcctcctttgctagccttggtgcttgcggtggcccttctggccaggccatagacagaggccacacccttcttccctctctgccgtgttgctgtccgctgggccactgtcccacctcctctgagatctacagccccacagggttgggtgatggttgtcgccacattggtcagttctgcatctgggtcagtcccaggggcttgcatggctggctgtcagtcctttacctggggggccctgtggctcatccgtggccctcgagttccagagtttccatctgctgccaggccgagtgcagcatcctcaccagcttcacagccaagcagagggatgccagtgttcggcctaggcttcggtttaatttttatgctagactttctcagtaatcgccagcacaaacttattcatggtcccttccttgtgtctggatttcagctttcctatctctgcggagggggttggaccagattacacgtgggtgactcagatatacctgggcctgcatgcaatctgtttggcccacacaggaattttacattctttcctttgaatttgttgccagtgtttaagctggttgccccttaggccccaccattctctgttgtcccacaccaccagcctcatggtttacatttgccccatgggcgcttcagtttgtgaccctccatttgctcctaggaccccctcctcacctcccccccaacccctcccacctgaattcctcagtaccctctggctctgtcttcccagggtgatgggacagaagaggagggaggctagagcctagccatccacaagccgggttccagaatggttggatttgagaaatctggtgaaggggaaaagatttttcatttgcccagaactcagggtagtggacttggggcagtaaaggtctcaggaacagagttgaagccagaactgtaggaagatgtgtattggggccttcaggtgggcggcaggagaggaagggtggggctgtggtctgggaagggcctcctgcaggatgccagcctgccaccaatgaggggaaggagaacggtggcctgggcatgacgtgcgcttggaacagattcctggtgacaccacccccagccttggggcttaaagattgtggtgtaatccaagcttgttttaatcaagccacagataagaatgagccaggctgaggctggctacggcctgagtgcacattcctgcctggtgcactttgttcttcatgtaggtggggctgggcggggcagggaggctgccctgctgccttggacccaggatggcatttcccctgcttgacagggacacttggaatttcctgttggaagtagccccaaaggaaagagtgcctgatgggttgagccttggatgtgttcggtgctttctgcagtgactccacagagcactgggcttttgcagtctctactgtgctgtcttcggctttcccactggtatttcctgccctcagaaatccacctgccccacatctcttttctccccttctgtctgtgcacataaactggggtggatttcaatccgatctccttagctgtgtgatcttgggcaagttattttgcttctctgagccccagcttctggttctgtgtgtgctgtgaaaccacctgtggcccacgtggccaatcctgggtcaatatttttttaaccaatgacaagaagtttctaagggttttccccaaagtgtgggcctcggtggggagctggcagtagctggatgagaaagagtttggacttcaagtcaatttgtagagttaagattgaaacttttttttttgagacagtctcgctctgtcaccaggctggggtgcagtggtgcgatcttggctcactacaacctccgcctcctgggttcaagctattctcttgcctcagcctcccgagtagctgcgattgcaggtgcacgccaccatgcctgggtaattcttgagtttttagtagagatggggtttcaccatgttgctcaggttggtcttgaactcctgacctcaagtgatctgcccaccttggcctcccaaagtgctgggattacaggtgtgagccaccgcagccagccatgattgaaactttaatttccttctccttgtccgaggcccttctccctttctttgcccaccagtttctccctctgagcgctgcagccaccccacaagccccagtgccctgtcaggcccatcaggacatgcaggtggggcactggcctgagttttggatctttgcttcaaagccgtgttaagtccagctctgccttgtcccagttcccagccctgtcgctgttaggggtatccgatcagcaccctcaaaactagagagatcgcagcctcaaacaaatccttttggcaaatggctgcatgttaggagggttttggtgacccaaacatgtgccaggcatgttccaaaacccccagcatcaaggcccactcagggattagggtcgaagctgcttggctggggagagagggactgtttttgttcttagccactttctgttcacatatggctatcattcactgaatgaacgtttactagaacagcagggtggcggagtagagaaaacgtgtttccagtttgctgtacctgtgtcagaatcttggatttgttactgtgagattcagggcacttgagtcatttgttctctagaaggttaatttcctcaacttataaaataacttgatttgtacctcctgcagtgggtgttgtgaggactgggtgagaggaagtctgtgaggacccagcatgacacctgcacatggcagctgtgtggtaggcggtcactgctgttgtcatttagtaggtggcccttaggattagacaccgcgggggacacaggctgggtgagatagggtccttgctaccaggaacatatggttaacagggggctgcaggatagatttgctgtgttttgggagttcctagcatctgaaccccctctgagtttacatctgaggattctcttccatatgtatcttggaggccagacaggaaaggccaggaactcttgtcacctgtagtgctgggtgcgagcacaggactggggcctgccagccagacccaccccctggtgctgggattcaggaagcaggacagggagcattcgtcatggtggctcagtggcagaggcaggtgccagatgggatgctgagccctgtgtgcccgggtgtgggctgggcaggggccttgcctgcctgcctgcctgccacagggcctactttcactgtgcttctctgggtgaacagcctccctggcagaggcccggtttctgagcgtggctctcccagcttcctgtgttttctgacctgcacagtggccttttagtgaggtcccttgctgctcaggtcagccccaggaaggttctggtgctcacatcccagaacctgctggtctctgggcctcagagtaactcatactgagaggagggaaggatgcccaggcaatactgtgcagagacagggttgccacttctggccgcagggaggagtcagagaagacttcttggaggagggggcatttgaaaggtactttgtaggacagagggcctggagggaggttcagatcctggccgggcagtggaagcctggcccttgccttatagcctctttgaaatgtaaatgatgctagtgcctgtgggatagggcctttgtgaggagtaaatggttgaggacagcgcctggctaatcactgatcaaaatagccccctcctgacaggggattaggttcatggctgtcgtatatacgagaccaaccatctccccccacactctgtattgatggggagtggtagagttacacttctgctctgagctcagtgcatagacatcctatcttgttgaatgtgcacgacacctcgagatgtaggcaggatccttccttttttacaggggagaagacggggccttggtgaggtgaagtagttcccagggccttccatccaggtgatggagccaggaccttgcttctagttctcctgcctcccaagcttggctgtttcctacagctgcatacggccccacccagagggaggcagtcaccagagaaagagaatggcagtgacccagagggggcacagagctacttcctgctcagggagtgctgggcagcctcctgcgggggggagaggggggcattgaatgggcccttcagagaaggctgggagctcaccaggtcctgaggaagaggagggactgcgtgcaggaagcctcaaggcacgagccagcttagcatttgggggaactccaagtatttggtgtatacagtgtctgcagggtgcctgggcaggggtgttgggccaagcggtgtggcaggggaccatgtgtgctctggccaggggccttgacctcattctgttggtggtgagggcctctgcaggtggggagtggcaaagtggaccaagaccgcctctcctccactatctcccctccctacccctgctctgtccttataccccaggccacagtgaaggacattgggccgaggccctgctttcataggaggaagcaaagctctgcttcatgtagctgaagcccaggctccccattgtccaccctgacacagaccctctgagtcctcagttttctggtctgtaagtggctatgaagtctgtcttgcttctcctcccagagaaatcatgagcataaagagcctgccagacgtgtggatatgcggttttaaagattaaggcagtttaaccaaaaagaacaaaacattggctgaattaatagaagtggcactgggcgttcttcccgtcagcctgagttggaggtggggtgcctcccagcaggggctggcaggagcacccgtgtgcgctctgaccccatccagagggtttctgggtgccctgcacagcgggacaccctctggaggaggccctgtggggaggacagagggccagtaagaacactcagtggccttggagaagcaaaggtgtcatttgtcccctcccaaccaccctgtacttcctgtactgaaactgacagcaagggagactttggcagggagaactcccagtttagctcctcaagtgtttttgaggctgaataccagcctgacagcttgctggcctgctgcagggtgtggggctgagacggcctcagcgacttatcacagcgaccctgtgaggtgtaggtgcgtcctggtcccccattcagtggtcacagaagcacagtggggtttaagtgaccagtcagatctgcgagcagcggattcaagattccagagtctggggatctgacaccaagcaccttgggctggtaaagatacaaagtctccagcaggcacagggtggaagaggaggtttctgtttttaatttttttttgtagacaaggggtcttgctgtgttgcccaggctgatcttgaactcctaggctcaagtgattctcctgccttggcctcccaaagtgctgagattacaggtgtgagtcaccatgcctagcaaaaaaagaggaggcgtcttgttgacatggattgagagaaggttgagtagctgagaaggagagagaacagcctctgtagaacaaggaggtggggggtgtttctgggtatggtgagcatggagcaaataggagagggagcccaaagcatgctggggccagagcctgcccaaaaggcctgtgcccagaactctgggcatcgtttagtaggaaaggggaagtcagtggtgggctcttgagtttggcagcacccccgtgagagctgggcgtatgcaggcggacgctgtagccatggcagcaaggtcggcggtggtagcaaagggaacttaactcccaacttgggacatcttttggggctcagttcagagaaaaactgagcaagaaataggtcacaggttttaggaacggtattagagtatcttattttctggcatgtccaggaaatgccattttccactggatgcattttttagatagttgcttggcacttatgtctttgtcttcagaagaatggttttccggttttaaacacatatctggctgggtgcggtggctcacgcctgtaatcccagcactttgggaggccgaaacgggtggatcacttgaggtcaggagttccagaccagcctggccaacatggtgaaacccatctctactaaaaatacaaaaattagccgggtgtggtggcacatgcctgtaatcccagctacatgggaggctgaggcaggagaatcgcttgaacccaggaggtggaggttgcagtgagccgagattgcaccattgcactccagcctgggcgacaaagtgagactctgtctcaaaaaacaaacaaacaaacaaaaacccacatatatcccacttttctttcccttccaaaagagagtatatggatataatttaatcatttttcctgtgttatgtataattgtacaattagaaacaaccaaacattaaaaggtagggaattgattaaataaattatgcttgatttaccttttaatgataatgctttagaagaatatgcaatgttggctggacgtggtggctcacacctataatcccagtactttgggaggctgaggtgggcagatcacgtgaggtcaggagtttgagaccagcctggctgacacggcaaaaccacgtctctacaaaaaatacaaaagttagctgggtgtgattgctcacacctgtagtcccagctacttgggaggctgaacctgggaggcagaggttgcagtgagctgagactgtgccattgcactctagcctgggcaacagagcaaggctccatctcaaaaaaaaaaaaagaatatgtcatgtcacaggaatatattccttatagtttgttaattaaaaagtaggatccagatgtttgtgtagtataatttcagttttagcaaagataaatattaaaaacttggaggagtacgttatgtaatacaaatgttacaggctatctctgagattaagttaaaatttttcgatccctgagtaaataactggagatataaacatctcttacaatggacattaatttgatcagagaaaaaagacagtttttttgaaaagctgtattactttatagacacagctggtatctttattctgcctgagtctcaccatctccactgcaggaggcagctgggtcatgttaagggttcctagagccccaggtggcactcttctgtcttccttgtctttaacatccggaccacaccttgtcaggaagctgagtttgaatctcagccccgggctcgccagtaggagttcttgagtcctgggcctggccttggactcccgttgtgaagtgggagccagccttgcaggtggctgctcaggtgagcatgtaaggtgcatctaggtggctggggcctggggctacatcctgaagcttacctgcgccttcagccagtggctgctgtttattccagcagtgaaacccaaccgtcacattccttgaaatacctttaataactcttaccaaattttgaattttcagtgagtttgaccttgaccatctgtttgaaagaaaggcagacacacacccacacacacccatggtgaaatgcaggcaggatctgacgtcctaggctgagaaatgctggtctcctcttttcctatcaacactgccctgttgaccatgcaaggggcatggagatgccattgtcccggggtcagagggttggcagggagaattgctgtggctccggggcttcctgtgtaggccccagggattgggactggcctggctcagagcaggagccacccagggagcaggggaacagccttccagggcctccctggtccagctgcctgggcctgcaggctcttctgaggacagagccctgataagtgagggtcagtgcccaagaaaaaaggagcattgttagggggtgggggccgggggaacagccagggcattgtcgccgagccgggaggctctgtgtgttccgtggctttcccagctctctgacagtcacaagcactgaggtttggggcttccaccccttgacagcaggtaggtccctttttggcagctgtcagcatctctcagcccttctctgctctgctctggggggatttttcttggcatttccaagttctgggggctgcatcctcccctgcggtattgagatgagtgggagagaatgcggtgcgggttgttggtaacgatcccagagcccagagaataggggcagtgttcctgggggagagccctcacccggcccctggggtgctgagcctggtgagtcatgaggggtgtgggccacagaacgccggggagagtggctgggggttagggggtgtggagaggctgccaccagcaaacagcaagagccgtgggggtcaaatggggcacgtgctcccaccagcctctcggaggaggtcacgtgtttgtcattgttggctgtgtctgacgtgcgggaaagcagccgtgaatactgaggagcctgtcacatttgttctctcagcatctttggtttatcttaaacctcagtgagatgtttgcagttcttctcacgctgtcacagagcatgaccttgtggcctcaaccggatgccctttagacattgcagtccactgcaccatgtggacctcctggggcagggctggttgctataggagcggcccttcccagtaggacggggacagtgtccctccggttgtggcctctgctccccgcagctcttgaagttaccgaccttgggctcctgggaccttgggctcctggggaggggcaggtctcactgacgccaccattgctttcgtagccctttcttggaaagggtggccttgggcttggcgagtgctcctcccacctgtttccaaactctgaggatgctcctcaggaattagaacaattcaaattagtcatcacgtgccggagtcaggctgggaagaggcagccacttggcaccacatacatccacctgggcctgccacccttagcccaggccttggacctctctggtctcctggctaggccctgggcccagctggtttctggtgggaggtgacaggcccagtaactgaagcaggaggctctggtccagaccgacctgggtgggttgaaacctgcctctgccacctcctggtacccaggagggtgaggcagctgttcacggtgctgtcgggcaccaggccctggacagccatggttgttcccattctgggcctcatgcagtgcctggtagaccactgcctcccactcaccagtgtcacagcagccagacaggtttctgcggcctgagccccctccctccctccctcccgtcctgtttcctaggcagcatggcctctttggccatttgttgacctcccattccccttggcttctcagtgcagaatttccatagcacatcagtctgcactggtgatttggggctctctggtgtacatgtgcagatatacacacccatgggagatgagggaggcattccactgtccttcaaggctcagcttacctgccatctcctttgagtcggcttttgactgcccagcgtgaatacctgtgcctgcctttgtgtgctcactgcactcttttgggtcattctggaagagcctccattttattttgcctcactggcccaactgccaaccatgtctgcccttgaggccatccctgctgccctggtgcagcatgaagtccacagcgagtgcctggtctctatttgttgaatgaatgtctgcaacgtaatgtgaccaaggtcccacagatcagcatcctagtgagctgagagctcaggtgagctcatctgtgtgtttcagagggggtggtgggcagaggacagcaggctgttgtcctgaagcccctagaacctagcggagaagaggcaggacccaaaagaaggaggtgtgttcaccctgtaggacttgctttgtaggtgcaggtgcccagaggccaggcccgtcagtgctacctggggtggggctggagaagggaaggcctgccaggccccataggtgatgggagggccaggacctcaggttggagggaaccactgaatcctcggccctgtggtgcaggcccacacagggcatagcccctgggcactggcactgcccactgcccactgcccgtgtgtgctggggccatgccagccttctccgctgctaaactggcttcttcaccctccctcagtgggcacagctgccgcttccatctcagtgtctgcttctcccttgcttggtgggtcattatgtgcccacttagccataggctttcactgagtccccaccttcatgcaggatgtgggaggtcccaggggcccccaggcagctcaggctggcctgccctctagtggggagcagagcagacagatctcccagcccagtgggggccagctgtggtggagcccgcctccccattctattcttggagaggaaaagcacagaaatacaggagtgaaggcacagactgggcagaggggccggagtcgccctctgaggaggcctgtagggcccccagaagagttttctgggtcagaatcaagagactcaggagcctttttgcattttgtgagcccagtcactttgcctctggtcagggtaggttttccagagcatcttcctgctccgacagggggtgggggagtgttgggggtgggtggtttgccatgggaacccccggctgctgcaggtgctgtgtggctgaagccacctcccagttcagtgtgctgggggcaggatgtgggggagggcacctgggaggaaggtgtcggggcagggcttaccagggacccatggggaagtattagacggcttttggggctacactttggatagggagctgggggctcccagcatcagagcccactctttctcccccattcctgagtttggaaaaaggctgccagctggtgcctcacccctgcccctcaccagaagaggtcctgtgcttgccccctgccccatcctcagtccccagtcccacagctgctgtgcagtcctgcttctctttctgtctcctcccctgcatcattcctgccctagctctagacctctccacctagctacccctgtgctgcccgagagccctcctgtgccccaccacacacccacatgcacaggcacgcacattcacacactccgttctcttccaggagaaaccctccctggttcctgaggccctggggaccagtgggtgtgtgtctgtctctctctagcgcctctttctcctctctgcctttccttagacacgtacctcttacctcctgtctggcctggcttcctccatgaagtgctgtttggttttctcagcaggagcctcccagccccaaggctcccactgttcctctaccagtcctgtcctggggccctcactcctgggtggtcactgttgactgattactcatcagtggtccctctctagaccctggttctgatgtctgtgctcagcagggctggcccagaggaggtggtggggaatgttggggggcattggctgttgtggggctttgaggaagcctccttccttctctggttaggaagttattgcagcagatccagcttttcttattctccttttcacaaggctcacaggtcacatggctgctgcctcagagtccctgaggcactgctgtgccaatgcacagttggtttatcttaacatcacccaccccaggaaacctcccttgaccctgtccctaggcctggctgagatgaccttcggtcctactctcacctgtaggattgcaggaataacaaatgacacttaatcacaggcctctgagcaaaaactgggacccaacaaatttgagtgtgctgatttcatttgtagaccctgggaaaaccgatgcttatacctttcccaagccctggcagggcattggcacagatctgctttcaccctgagtctctctaggtgtctctgtgtccatgccttctcagcagctcacaactgctgcccagggagatgaagcccaccagctcctttgctaaagggctcaccccctagagaaaagggctggctttgcagggtgcacgatccgatccgtgctggcctttgtcacccgattccctgagcagctgctcagagctgtggagtacgctgcagtctgcagagtgcgatggccccttcgtgagtcccagcaactcaccagggtcacagccagagctgggtggacatgtgccttctagatgaggctaatcggaagatattcaagggcatcaagctgccccgcccagcatggtgtgtatgtggtccctgggggacttcctcccattgagggtggggcaggtcagatgtgggtcagtaaatttctgtgacctggcagcattctctggaattctcccaagtgagtatgcaagggtttcagtgtcagcttcttcctctctgcaaatctctgtgcaagtgaacatattaaagtatctgagaagtcctgcaggaaagcttctgctgctgcttagcttgacgcaaccgagtctttgcaaatgattttgagtactgaacttccccttttcatgtgatgtttaaaaggttgttaatgctttattattattattattattatttgagatggagtctcgctctgtcgcccagcctggagtgcagtggcgtaatctcggctcactgcaacctccgcctcctgggttcaagtgattctcctgcctcagccttccgagtagctgggattgcaggcatgcaccaccatgcccagctaatttttgcacttttagtagagatggggtttcactgtgttgcccaggctggttgcaaactcctgaccccaagtgatccgcccgccccagcctcctaaagtgctgggatgacaggcgtgagccactgcacccggctgctttgttactattatatcaaataccagtttggaaaactgcctcaaggaatgctctcttcggattggaaagcaatgaatatagaaagagtacagcttcagggcttaaataataatctatgcaggctttgtaggagtttgagtcagagtttccctccttattgttaaaaaggatgcatagaaaatttttttgacttggagaattctttgccacttgtggccggggctgccagttgccattctagggggaacatggagataaagcaaacattgaaatatgttttttattgtcagcaaaaataaacatcccaggccggaagccagggtgtggaagggaggagtctggggacatgaagtcggaatcccacttggggatgggcacttattctcttaccaccacctcttggagccagaccaggaggccttaggggggtctatggccctcattaaagcccaggcccccagcttccagacaagggaaatgatggctcgaggtcccacagcaagtcagtgccaggctcctgacccctggcccgctgctgtcttcgaagcatcatggtttctgaaaatcttacctaagtcccttgttccatgaggccataaaaatggcaactgccatgtatgaagcgcttacagcctgtaccaggcaaggtgctgacacctcacctgtgttaacttccacagcggtctctccaaagggactgaggcatctaactccctcactcatggccttttgccagcttcccccactctgaggacactgactccaatcgtgcccccacctctttgtcccccgtcccctgcacccacgctggcctcctctgctcgggacccctgcacttgccttcttcttagttcagaacattcttccccaggtctctcctgggccttcttcttgcccaggccttccttagagaggccttggattcatttgccagtgctgctgtcacaaagggccacaaactgggcagcttaaatagcagaaatgcacccctcccagttccggaggtgagaagtctgagatcccaagtggggctccttccgaggcagcggggcctgttccagccatctctccctgctgggggtggattgccagccatctttggcgttcccgggaatgtagaagtaccgccctcatctctgccttcatctcctcacgatgttcctcctttgtgcgggtctgtgtctaaatttcccctttttataggagcaccagtcatcgtggactagggacctacctgctctggaatgacctcatcttaacaaaggtcatctgcaaagaccccatttcctaaccaggtcacgttctgaggtactaggggttaggacttcaacataccgttttttggggacacagtttagcctgtaccaggccttctctgacgagtgcccccctttcctatcatgccctctgcacttcattgatgttgcagccctcggtggtgcctccagtcgcttcctttgcttgtttgttgtctgtctcccacactaggctgtgagtatgagcactgaggacagggacctggcggtcatcttcacgttgcatcttcagagcttgagcaatgctaggcacaaacttactctgttcacttaattactcaatgaatgagtgcatgaatgaatgaatgaatgaatgaaagaaagaaaagaaaacaagtcctgttgtctttcccatgcatcactcacacaaactgaggctttgagaaaaccagaggagagtaaagaacaggcttttgtgtgtgattcatgaagcagtaacggtttctcttttatttacattttggataaagggcagaagcaagaagggtggctgtgactgcattcttgatgttttcagcatttgtcaagtgggacgtgtcacctcattttatttttgcacattccccagtcagctctactgagtgtaaatgcggggtgccgctctcacaccctcagttcccatgttggcagttggaagggagtgcagcctgcattgcgcgctaacttcgtgcttgccatctgggagggaagttgggatccaggtggtgcagtcctggatctgaaatcctctgtgggaagtgcagagagacagggtagctgggtttctggaagggggtagcagcctttgaattcatctggctgagagctcagatagaaatccatccctcgccacagctttgggacagtcagatgtggtgcaccgaagacaatctgctggggactgtcagtggcttcctttgttacccttgccttgtccactctcttgggcctgggagggtcagtgtctgtgactgtttgatccttactatgcttggctgtagaggaaggggcctgcaagatgctcatggcctgcttgggaggacaagagtcatgcccaggaagccgtgccagtgaccaagggtggtggctcatctcctgccttgtgtgcttgttgtcagagctgtggcatcttcagccctcaaagattgtggcctgccggcttggctaaaagcacagctgcctggagcctctgtgccttttgggcttcctggggcccatgtctcctctctgcaaggtgcaccctggggctgaagctcgggtggctcgggtgtccttgcctgctctgttgcccagagacggctttatttttcttaccctgctaggcccagggcatgtgtggcttattcctggggctgcttgggacatcgtggaattctttaacctgaagattctcacctctcccaccataccctccagagtccaacacagacacaactaagctcagggtccccaagggtccagaccccaggtggaggtgaggggcgggcagtgtgaggtgttggctctagggaagggagtggtaagaaaacatgggcctgccgcttactctcagtgaccttccacgagttccctcatctcatcatgtccttttttcggagcaaagcagggataacatgtccttggagggtggttatggaaatgcccaatgcccaatatatactgtatggataggtgaatggcatgaatccctccagctttggggaatcaattcagtccatgttggctggtttctagaacaactgggcatgatgccaggccacacaggggccacggggaggaataggacatagtccctgtcctcagggagggggcacaggctaaggagaactctctgcaactcatcagccacgtaagctcagtcagcttgagcgtctctgttctccctgagtaggcaccactgcgaggaggcagtgaagtgttctcaatgggagggaggagccacagccccatcatcgtgcctgggacgctgaggcttagaaatgccgaagctgaacctgaaggcggttactgtttggcgttagaggtgggagatccaatgggaactgtgattgctgaggttccggagggtctgagagctgacatccgcttggggaggtgcctgcagggggcctgctctgggccaggcttggtgctaaggcttcaccaacactgtctcgtggaatgctgatggcagctgtcatcggctgtattgtaccagtgaggaaacagtgtctcaagggggttgaagatcactgactgaaggcccaggtctgcccacagctgcctccacccctccattgcttccagtatctgggacttgagttccaaagccatccttggcgtgggcacacagtgagcagtgcctggggagagattgtcctggctggagagctcgtcaacaggctgagcgaaggtgttagaacaggctgccctgtacctctgggggttggtttccggctcatgtcacagtccagtggagaccagcggcctctccaagcagtgactcaagaatctgtgttcactccatcaggttattctgtcatccaagtctttttcgtcagccacatgaatggggtctagggaaggcacgctgttcatcatacacttgaactagcttggcctggaagcacccactacgtctgctcccattctgttggccaggacgcgtcctgtggctcctgtgcgtgtgcaagggaaccagggcatgttgggcgtgtggctgtgggagagcagcctccgggtttctggcgggagccagcaggtgcatggacccacagtgccggtttcccacagaggtcctctcagtgcagaaagccaaggaccagcccctttttttcccactgctctctgggtgacttggaaagtactgaagcctcagggcagaggttggagagaggagagccaggattccttgggcactgagagcagggaagggttttcagtgagccccttgtgctcagccaaagcagctgggtcaggtggccctgggtgagactgaggttgtcacgtgtgccatttggtgggaatgggggcaccagttggacagcagcagaaatcatttctgttttctgttgatgactgtcttgcttactcagtgactagtgcacgggctctgagatctgcagaggagtcctgaggcacgtgtacacagttgtccacgtgcgtgcacatgttgtagacgtgtccctgtgttggaacatctggagtgtggttctccagttgtctagcccagagtctgcctccctggccccctcccagctccttcatcattagctgtgtggatgaaggcgagttgccttggtgtccccatctgtacaatgggaataataattggctctgcctcatggggtcattgagatgattaagtgagatagttcatgtgaagtgcgtagagttgggctgggtgcacagaggtgctcgatggatgttagttattggctggatttgaatctaagcctgtctgactctcagactccaaacgtgtgctcttcctagagactgctcagttggtaatttacaaactttcagtaagtaaataagacatttcactggttttaaatttctgggagcacatgatgagcagtctccctttcaccctgatcccacaagccccctggtcctctcccctgtggtggctgccactctgaccagtttctagtgcacatcccaagatactctgtgcatatccagtaagatctcacttaacgtcttcgataggttcttgaggactgtgcctttaaatgaaatatataatgaaaccaatttttttctcactgttataaaaaagtgacgttgaaggaattgatgttatttaaggacctgctgtacaattcagttgatactgcactttccaagaacctatccccaatgttcagtgaagacttactgtacaagcacatgttgattttgtgtaacccttttttcccctccccatacatattctagcatggtatactcagtgatcggccccttcttggagatctttccacgtcaccacagaaagcactccccgttctcttctgtggcagcatggtcttccaccatatggatcttcataagtgattcagtcccttcttgttggacttttatttagttactaatttttggcgattacaaacagtgcagcaatgtgtgtgagtgcatatgtgggtgagttcaccctgtgagatcagctcctggaagtgagactcctggacgagaaaggttatgcatttatattgtgatggatattaccaacttgctgccgtcgagacggttgaatctgcatccccccagccctggccgatacagtctgttatccgtctctctgactttcaccaatctggtacataaaacatggttatcataatgtagttgtaatttgcatttgttgtatgaatgaggttgagtattttctaatttttatatgttggaagccttttgtagttaattttctgtacttaacattcaaacatatcttttgttcatgttttctgttgtgttaggttttctttttaaaaaaatcagtttgtaggatcttaatatatttgagagagattagtcatttgtgatataagctgcaaatataatacgtggtgttcctggctaagaggattcatgatcaaaccatgggttttccttaaattgatacataaatataagtaattctccatccaagtcctattctttttttctttttttttagacagggcctcactctgtcacccaggctggagtgcagtggcgcaatccgtgcttaagccaccctcctgcctcaacctcctgagtagctgggatgacaggcgtgggcgtggtgtgcaccaccagcccggctaattttttatatttttagagatggggtctcactctgtcatccagcctggtctcaaactcctggactcaggcgatccacctgcctcaaccttccaacaatcccatgctgggattacaggcatgagccaccacacccagctccaagtcctgttcttaaggatgtgtaggaaaaataaatgagcatgactggtcaggaaaattgtgaaaaagggaggacctagatcttattggtattaagcttatcatgaagcaattgtaattaaaacaatgtgggaaaaagaaaaccaaacgaaatcattgtgatattggtgaaagacaagttaatgaagagtccaaaaaatgtgagaattatgaaaatattggcatttgcaaacagtgggtaaaagatgggtaagtaaatgttgttgagacactggagtgctcatccggaggaaaacatacacagatgcacacctcagtctttcactgaaacaactcccggtggatttaagatttaatgataaaaacttaaaatgtaaaaatagttgagaaaaccgtgggctgatttaaaaaacagtctagggagcaaagatcaaaagatgaaaatatttatacatttgaattacagaaaagtcaagattttctgcctggcaaaaccaccacaactaaagtagaaagacagcaacgtgggcggcgctaggcaggccttaccactgtctgcttgcccccacagcctccattcctgctcttgatttccgggttggggtgccagtgccaggcccttcatcttggagaactctgcaaagctgacagtggtgtgctgtgtcggtggccggcaggatggaaagaccctgattccagccctggacaggttctcgcttcctgacccaggtggctctcaggagatggcgttgtggttgaaaacttgaggcctgccagctaggatttcagaattgtcctgttctcctggaactggggcaagtctgggttgttgacgctgtgcttgtgggtgcttccctgcctctggccccctcagattgtatctcggaccacatgatagctccccccagcctcaatccctgcacatcaggaaaggacgtctagccagctgtgttgtcggcccactccccttcctgatgaaggcagaaggctcaggagcctgtgtcccggagccacagggacctgggggtgttgggggagatttgctggttatacagcctcagttcggttgttttgcctcttgacttccttgcttcatgtgtaaaatggtgacagtggcctctgcctcctaaggacatggagattatgtgctaaggagattaggtctgtcatttgctcactgcagcacctggaatataagggtcccggtagttctggtggaggtgattatcagaatcatgctggtggaaagccaaagaaggccagaaaggcctccgctgaggccagagaacatccagcctcatgtgaggaagaaagtcctatttgctgacacctgtacagcatggtcagctctagtcacagagggaggtaatcgatggctggccctggctgtgtgctcatcgcgactataggaaggatatttctttaccctcactccacaggcgaggaagcaggcttggggaggggagggatgtgcccttccccaggctgcacagctggaggctcagcccctgccctctaacccctgggcatccttctgcctggggagggagcacctctgtgcttgaggtggcttgggaagaagagcactggccagccatggaggagtgctgtgggcaagaggattccgcgagttccttcctccaggcctggcaacaggaggttcatgtgtgggatcctctccgctctccccgcaacacacacagggcggtcaggctttgttacgtggcttctgactccccaccttgtggatccagacctgccagcccttttatgctccctttttttctttttctgctagcctgtgattcgtactttccccccaggacaggactagattggtgcctggcaacagaggggaggggttagctcctatcagctctgactctggcctctcaggtgccactgtgaacaataacacagatgaagcagccccttggccaagatgcacgggatcgagggactcatctggcaggttgaggggactgctaggggtgagctttcctaggatgctggggaatagccacgtcgtgatgtggctctatcaaggctcctgccttttgctcctaagggctctgacaagttatcttccccttacaggataaatccccattcctctctcatccaaatactaataaactacaatgtgaaaaaaatcatagctaaatcctgttctcaaccttgcagttacctgtcggggcctgtttgccttaatctgcttttctccccttccctttcccttcccttccatccttcctttgtttcaacaaatgaaaaagaaaagcttggggtagggggaccagctattttatgaggacagatttggttgtgctgtattaaccaacagcctcagaatcttagctgaaaaccgtgggttattccgcactcatgccacatgtccacagggccagctgggggctctgtccatcttattcactcagagatctaaaactgagcagccccatctggaaggttgctggtcctgcaccagaggggagagagggctctggagaccttactcctgcagttacatgctctgcccaggaaacggcatgttctgttttcactcacagctcattggccagaacgagtcacatgatcacccatttaccagggaatcaggaagtgcagtcctgccttgtgtccagaaaaggggctgataggccgtgtgcggtggctcacacctgtaatcccagcattttgggaggccaaggcgggcagatcacatgagatcaggagttcaagaccagcctggccaaacatggtgaaacccagcacatctctacaaaacaaacaaacaaacaagcaaaaacagaaaaggggctgctatacccacagtccttttattttcatattctgggttttcttatcagccttttccacagtaaatgttggttcatgtggttgtaattcaagcacctactcttatctctatcaagacctcttcattgtcatctcagttactgtttttttctttgtttttgtttttttgtttttgttgttttttaagagatatggccaggcacagtggctcacgcctgtaatcccagcactttgggaggctgaggcaggtgaatcacttgagtttaggagttcaagaccagcctgcccaacatctggtagagatgagtagtgaaacccatctctactaaaaatacaaaaattagctgggtgtggtggtgcacgcttgtaatcccagctacttgggaagctaggcaggagaatcacttggacccgggaggcagaggttgcactgagtggagatcatgccactgtactccagcctcgacggtagaccgagactgtctcaaaaaaaaaaaaaaaaagatgtggtcttgccatgttggccagggtggattcaaactcctgggctcaaatgatcctcccacctcagccccatgagtagctgggattacaagtgtgccccactgtgcccagccacaccatctcagtggctcttgactagccctttgtggtggcatgcccagcattagccagcaccccgttttcacacatgctctctgtgtcttttctcttgtcaatatgttgtcagtgactctccctaggccagaagtggccttcacttgttgatcatttccttaggccagcatcctgggagtgggtgtgcttatcctttgcctgctcttggacctggccttccagcacccagtgttgggaacgcagaacaggactggcccatcctgagaactcagggtcagtcctattcttaaggagctgtgcttgctgaatgggtgtagcttttctgggtctaatgtcagctcgtaaattcccagaactttggctctgcaaggtagcaccatcctcaggccatttagttgtcttgaccctttatcttctagggagaaaagttacccactcttatgccttcacgagtttgccgtttcttcccattatccgagtaattggaaaccagttactcagaaatcagggaattgggtcagagagcattttcaacagcttccctccccagcctggggcagaggctgctagggtgaccagtaccatccttgtcccagcctgctggtcttggtggcagccccaaatgacctttagctcttgacctctctggagcacctttgagaatgagagttgttcttgccagggaaaagactccatctcctcttctccagtcttcctttggaatcaaacccactgaaaacacaccactggcatggagtcctctgaggccaagctcgtttctttttctttttcttttctttttttttttgagacagggtctcattctgtcgcccaagctggagtgcagtggcatcatctcggctcactgcaacctccgcctcccgggttcaagcaattctcccacctcagcctcccaagtagctgggactacaggtgcacaccaccacacctggctaatttttgtattgtttggtagagacagggtttcaccatgttggccaggctggtcttaaactcctgacctcaagtgatcggcccacctggcctcccaaagtgctgggattacaggcacgagccactatgtccggccccaacatccttctggaagtctgtccatgaggttcccagatctgactttcccttctggagagacctgcttctgcttggcaaggcctttgaactttggcaatggcagttctgtcccagattctcagatccatggagagggcagaggaataagtcagacttcagccctctcaccctttattggggccattttgtctcaagcttggttgggacaaaacttttcggaagtttccactggtcagtaataataagaatagtaagtatagggaaatacaatagctgacatttattgagtgtcactggctaggtactgctaagagtgagtgtgaagttgtgagactgtgacatgttatttaaccaccctgtgcctctcatgagtccccgtctcagactattgtgagaattgagcaactcagtgcatgtgaagtgcttagagtagagcctggcaccgagcaagtgtgcaagagctgggtgctagtgctgggatcgcgaggcttcttgctttaaagacaaggaaactgaggttcctagagggcggtggccacacagccctccccattatctgagtaattggaaaccagttactgagaaattgaggaattgggtcagaaagattatatgataccgtgggggaagagcagcccccagcgcaggagcaggagacagtggattaaagaatcagcatcataactggggttacggtgcaatcctggagcgacgtgcaaagggttctggggctgtgggcaacacaagggagccactaattcttcctgtttgggctgaggtgagttgagaaatgtgaaagaggattgaacttttgctctgggactcataacaatcctgtgaggtgcagggaagggtgagtagcatcctcattttatgactggggaaactgaggtaccacacagctcagtgacctgctcttgttcagaagcagtggattggagatgggtttctaggcctgtctgcctggcccacccctccccagttccagatcctgggagagacagggatagtgtcagggcctagctcagcttggttaccaggctgggtacgattgggttaatcattttggaagtcaaagaggactctggggccactggggtttgcaggcctttgtgccgtctcccagccctgcccccacctctagtaagtctctgccttcgtccctgagggaaacagtggccccttgttttctctgagttctgaactccaagcgccacacagagcaggatccagcatgggccctgcgagatggcatgacttggaaacggagtgcccacagacctcaggccccggcgggcagcctttcattgagacacccttgctcctgctgggagggacaaaccagaccccgtcctctgaggagaacaagaagtccctgggaatgttcttttttctgggggcagagtgtggtcagaaaagcagaatgacaaccttgaaatgagttcctgtccccatcgcatctgggagacctgcctctgtggtgtccttccccccgggcatccccctgcacagtgtccttttctccgtggcctccccagtctcaggagctgggccctttctcctgtgggggccgcacccaagggcccatctcttttctagctagtggagggagaccgcagcctgtttgcagtgtgttcaggggacagaccccttcagggcagttgtggcatgtcaggcacctgaggaagagccactagagctgccagcagccctgctggtacccagcacagacgccacagcgagaggcggccgcacccgagagcagcccaggcctgatgtgtgtcccaagctgctgttctcacagaagggttttactggcatgaaaatgcttggaaaatacacaaaggagggtggcccgtttccagagctcagctgtttaccttcagtggagcgccggggatgcggagagcttattttccaaacagctgcggttgtcaggtctacgggcctcaggctgatgccaggggaggacaccaagggcgtcccctctgctcacctccttccccagcgccaagggaaccccacagtttctcccaggcagggaaacctggagggctgtctggagatgtgggtgctggtgggcatgggggttctgtgggcccggatgcgtcgctcctgtggcccggctccccctgcgctcgtagctgtcttggcctctcgtttgtggtgcctgacccaccgaagccacaggctgtagtggaaatgggttggtgtttggctctgtctgagagcccagtgttctctgcccatggcctctctaccttccttcagagtctgctttttctgggaagaggtattgggtggagtgtaatttggaatctgtgaagagagccatcaaagctcttgcagtttcttgtttctatcaaaggggaaactgaggccccaggggatggtgagcccaggtcagcgggctgctcatggagactgacacatgggcattgctgcacagcctccatcctggccgcttcacctgcatggccttgcttggtcattttccttcctgggccgttggtgtcctggtctttgcagcagggagcgtcttccccggcccctgggcttgccgtgaggatgagccggcgccaagtctcaggagatattgggaagtgtctttcccttccccttcctcacccaagagccccagagatgggcagcttctcagctagcctggttttggttttattttatgttgttttgtacacaggcctgtcaccatggggagggaacagcattccttagtagtttcttattgtgaggtctaaaggatattttttttttctatataggggaaatcccttaacatctttcctggcaaacagtaagaaagaggagttaaagacaccagcagacaagagctgctgcgttccgggggtgcaacggagaggagtttagtaagggaccatcacagggtgtgggcaggcccgagagccagcacaggacaaagttccccggtgctaacaagccctgagagctgtcaccacccctaggcctgaggggactaggggaccaaaaatgtacctggagccataggggaggcggtagtgttgagagaggggctgccctgctccatgggggctgtgactgctgccagaaatatggcagggggtgggggcgtgaggatgctgcaaatacattccctccctctctccttcttgcccatcttctgctgtgcctccagttggcccgacttggccagaggacaaggcagccaggtgattgtggcctgagaggacagctgcctagggcacagagcaggcgtggggagcggggttgcaggggcaggcagcggggaatggagtgagaagcgcagccttagatctgagtttgtgtccccacttcaccgccttcctgctgtgagaccctaggcaggttttaaaagtctccgtcctccacttttctcattcgtaaaatcacttctcatagtggttgttaaatacaatgaaagaaatgcacgcaagctttgagcgtggtgcccactgccagtgaccatttgtagttgtcattatgatgtctttcgtaacatttttaaaacagtcagccttgaatcctggagggaaacccacttgggggtggggatgagagcaggggtggggcttgtggccttctctggcctctgctaaggccagattgggggtcagccaggtgccgggctggcgccgctgcctccgaggcactggccttgcaggtggtggtggccgcgtgccgggagggagacatgtggcgggtcaggaagcgggggtcaggctgccctggcttttggcaggtgctcctgtcttggggtcaggtgacgctgactgttggccagaggctctggctctcttggggcctgatcttcccaacctcaggcacttgcaaaaataaacaccttccctggcatagcaggagagcagtatggaacagattgcaggcagccctacgcgccttcgcttctcccgatgagcccagatttcagtgtgaagtgcaagtggctggtcgctcaaagcggcaatttctagattcctgaggaccacagctttgctaaggctttttatagattagcagaagcagtatccacttagatctaagttctgatctggctgtgcgatgttagtcatttacataaccccttggaaccctagttttcctagggcagatggggtgtgttgagaaaagcctttctctgtaaagccatttctcagcatcacttgcctggcctgttgacactattgccctgattcctcttatgtgtcttctgcatcctgggtagcatggggcttggggaacagaagttacaaacgtggggtgtgcccttgaggagttagcaggagagaagagttgtggggtcttggagggtttgtcctgcttgtcctgtctgtattttccatgtcagccctcctcctgccccatctccagagtgctacagggaggctcgagggtcctctggtgatatgccccagggtggacaagaggatgggggcagtggactcaggtgctgaagttgttgcttttgtctgtgttccctgcctcacagctgaaccttagccggccgatcgaggagcagggccccctggacgtcatcatccacaagctgactgacgtcatccttgaagccgaccagaatgatagccagtccctggagctggtgcacaggttccaggtgagtgaggaccatgcagcccttggctgtggcattttcaggaggaggaggggaggccctggaatggccgtgtgtgtatttagggcggtagcagctctctggaggtatagtctggagaaatggctctgccactggcaagacatgggctcgtgggcaggtacttctgtgcggcgtcagtgtcctcgggtgtagcgtggggactgaaccagggcatggttgggccgtctccaccccctggctgtgtagacacggtttactgatgaggcatcgctgagttccagtgtggcctccacgtcctcagcacaggcatgtgcaaccctttcccctggctcaggtaggcacaagggatggaacccttctgctgcacttggtaaaggggacccccgagggcctttgaactgagtcctgccttggtggagaaccctgcctctgcccattactttgacctgggtactcacctttgagcatggcctgaggtatcttgctgagtcccttggctgcttccctctccccacaccacttccccagcggcctcccaggtcctgatcgcacagtgacctgcccactgccctggggttctcatgctggctactgacttgtcctgtgttctctctgttgtggacaagaacgtgattctgtcctctagaaagcggctcagaggtcatgaaaaacaaagttgtattgtcagtgaaagtgcagtcaagatggtagctgttttcaggtgtgcctagtgggatggggatgcctgagatggggtttctagcgtgtgacaggcgcagatttggtgccctgcttttcttcaccaggacaaagggaatcttacccgcctcctagtcacccggtgctgccgtcctgccgacactgttctctccccgtgtgttcggggtcagccgccttggccccccttgcttccttggggctctcaccccgttccttggccaactccctgctgcacattcctgcttcccaccaggaagtggccccggacacagaggcagcctgctcctggcatcccctgcttgggggcagggcatgtcccacgttgtgccctccagggcgtctgccctgccagtggccccaagtccattccacttgctgaacactgtctccttgatcggactggagactgtgggaaaaacatggtcgggctcctctgtgacctcgtggagcctcagtttccttatttgtaaaatgggtgctaggaataagaaaagctcagaccatgttgggaggagtgtgctggggttcgaggggaacaagacagaggagatgtgtgccctggtgatgtgctgcttcctgagtccctgccctgtgccagggctgggctgatcagcactcacccatgtgctacatttgatccccacagccctcagtgcagactcaccagccttgttgataagcaggaagtggaggcgtggaagcatgtgcagcttgtccacagggacccagcagagccgggggtcagtcttgactttctcaggtgagccgctgctcatcctgagggcttgctcttctgttcctctctgcctccaacctacacaactgtcctggggtgtggtcccagctgatcccaagtcatacagcgactttcctctcccctgagccatttgctcctgcctcacccccgtctccttcggaaggcccctgagtgcccagttcatgtgcctgtggtgcccttggggcttattctctggaggagcacagccatgcctgggctgccacgcagacctttggggcagggatggtgcatctcttgctgagtccatctgggggacgatggccttccagatgcctgattaccgttacctcagaaagcactgcagagcagttaccgcttaccaagccctgctcgaaagcgcttcatggcggttgacccacttgctcccatgagctgtaaggttcaatgattcccgtcctgtggaggaagaagcagctgcaggacaactagaaagtggtccaggtgggatttgagcctgcgctagcttgctctcctcacctgtcgtgtggcctctccagagatggatgaggcggaggacttgggagtcaaactgtcttcaaggcagatccttgttccaaaacttaggaaccgcgtgcctccccacagcctcagttccttcctccttgggtgggcaggttgctgggaggagtaaatgcctgtgggtgtaaagtgcccattgtagctgagtgccacttcatcacacccacacggttgctcttcctagagaccacatctcccagctagcctgggcccggagttctggaacatctgctcccaagctcttatccctcttgcccacttcccagacacacacacagcccacagcccaggcaagtgatgtccaaacagtgaatgagagtgcccgctgtgttccttttctgggcagaaaacaatattaacagggagcgtgtgtggagggcagcatggggccttgtggcttaaggctgtcaggcagccacaggtgcatttctcaggcagtgtcttgtctgggtcttgggggatggttgccgtgacctcaccataacctcccagcactgatatttctgggataaattttcatcaccgtctgtgcttcagtaagaggccggatatctgataaggtgggaagtttcctcctttgtgaggagaacaatcctttggagaaaagggtgcggggctgcactttccagaggccccaggagagaggaggcaggcagggttggcacagagaatgactgagaggcactgggatgggggctggggaagaggcttccttctaccaccggtcactgggctgtcagcattgatcgtccccttccctctgccataagatgcaagttcagagccagaccacatagacccagggaggcggacacttgacctcagtcgtgccctttgttttcagatttttgttttaaattttattctctagacattaacaaggaggcatgagtgtggtttgaggactgggagggatagggatgctataggcagaggcaggggaagcagcacccagagctggggtcctcccattttgttgtgagcagggaaaccgaggcaagatgctttgccccagcagggactcagcttgaagggccttctccacagtccatactcaggtcctgggagggaggaggaagtggtttggggctgtgtgggtggagaaaaatgaatttctgagatgttcctcagggccccagagcactgcactgggctgcctctgtgaaagttccggtccccagggagggaagaaattcccagagccaggaggccgtgcctgcttctggctgccctggtgggcaggtggaggctgtgggccagaggcttactgcagaacattaaagctgcttgtcacagaaccttcatcactgccccagagttttggattttttttgtttttgtttgtttgttttttgtgtgtttttgattggcttctaaatggcttggcttggagactcaattgggatgattcagttgtttttctgctccaaggttcatgtggagccagcagcctgttgcccctgaggctctgcctgaggtttggttctcagtgtgcagaaccaggcaggggcccccagggcctgcccacgtgggcaagtggggccggcatgccgagagggtccctgcctcaggctcggggacactaggggcctcctggcctggtgagtggctttcccaggggggcaacacgagccttctcctcgctgtggcgcccagagccacctgacaggtgtgggtgcagggtgggaagggaggggcccaccgtcctcttctgctgccccttctagccctggaattgcccctgaaggggtgctgtgattgtgatccatgggccatgtggggctgcctcgggggaccttcctggggttctccctgaataagcttaggactaagaaggaagtttcagtctcaactgctgcctttgccctgtctttatcagctggaaggacggtaattgtccctcagatgtcccctgaattcccggtctgcacacagactgctaggagagtgtcctctgcggcagcactgctgggtgccctgcccgcgagctcctggccaggaggagaggccagcaggcagacccagaactgacctcacggcccctaaagtgatgagttaggaaaaacacaggtctgatcacagcacagcttggcttaaaacatcccatgctttcttattgctgtgacactgaaggccatgattgccagcttgacccatggggcctcggtgatctgccccacccgctccttccctggccccctcagcagctgcccaggctctgatgtgtgtccacctcagcgcctttgcacaagctgttccgtcagctcagtgccccttcccaagaaatgtcctccctcgtgagctgattaatgacacatctctcgtcccaggccctgccaactttgcacttttccttcatgcccttcggaagttcgtaattctttatcagtggctattgtctgtcccttcactgcggcagggattgtgtctgctcccagcagctggtgttcccattgccgcctgcagtgcctaagtgtttgggtggcggcgcatgcccagtgctggtcatgcgctggggcggcctttcatggggtgccctgatggccttgcggagggaggacgtggctctgctgggctgcttggagcggggagggaggaggccaggagcgttaatgaggcagatggcgctgcctgatgggcatgtgcggcgatgtctccaggtgtcagcgaggttggagagggagcagcaaggccggagcttgagggctttttcatgccaggctgtgcagcttggactctatcctgcagggagggtggggcggggatggcggtgatatgatcagatataattggcaagagagaggccctgcttggaaggggagattgccagtgcaagatgaactctgagcagctgaggacactgtttactctttggagcccaggtgcgtccaagttgaagaaggagctcatggccccaggctcagtgttgtgcccatcctcagccccaggtgcccctgcatgtggtcctgagcatcccctccctccgctgccatgaaggctggcctctgagcagcttgagccttgcccagcctacacaggacaaagttgcactcacctcctggctcctctcagtgtgtaatcatctaaagtggatctgggaaggaagctcctgccccgaaggatgccggaagagaatgcacacttggccacactggttcttctcatgttgtccctggaaggaaaccatgtgtagccttcagtagtgcctccccgaccccaccatcctcctgaggggacaggaagtgagtagggctgggagctggtgggagggggtgatgtttggggccctccctgctagtccgccaagcgaggccaggcttcgccacagggatagacagctcccctcacccagcacaggcttagctgggcttgcaccacgtggtcacggagggttaactacagctttgcagcctgaaatgacagccgtcatggcagagggatgagaaggcagtgaggcttatgctggctctcagtgtctgccctgtggtgacacggactcatccatctcactggacctccctacaggcaagggaacccaatactgcatagttcctttttcttcttaaaaacaattaaaataccttgtagggttattgttagcattaaactaattaaaatttgcgattcccctagtgcctggcatggtgtgaatggtgcacgtgtgtgtaagggtcagtcagccacgcttactgtgaatgcctggcatggtgtgagtggtgcacgtgtgtgtaagggtcagtcagccacgcttactgtgaatgcctggcatggtgtgagtggtgcacgtgtgtgtaagggtcagtcagccacgcttactgtgagtgcctggggtgtgatgatgcgtacgagccactcagtacaggcccggcgcctagtgaaccatcagtcaccgtggcttatgtcaatattattattacagtgacagtaggactactctgtcagccttatctgtggccccagctgacttgagagctctcagtcctaattggagtcagtgaggcagtgattatgaaagtgtccccaaacgggagatgcattctgtgctagggcagtggaaatgcctaaaaggcagggccaggtgggggtcagagggactcaagtgctgttcctagccccacccttcacctgctggcccacctgggcctcggtccccttgcctaccgcatagggaaggtgcaggatggcacagaacaccttcagagctgttgcgtctgcctccaaaggactacccaaggccgcggttcacgtttgccacaaatgtgatttcacagctgcattgaatcaaaccctgttggcccctgatgtttattgagcagtcgccagcacagggatggagaggaagtagaagaaacaaaggtttttgttgttctaggtgttcgagtccgacttggaagataacatctaaacctatcagaggataaataacaccgtagaatctaagtgggcttgtgtcggctttgcctttgtgcctgctgaccagtggggtcagagtaagaaccatgggccccgggaaggggtttgtgttgtcaccagggagccatgggagggctccctattttctaagaatgtaccacgtgacccattctgccacgggcgttctcatctcttatgtctttggtccccatctcagtccctgagataatggaattatttccccatttttcaggaggagacaactgcggcccggggaagttaagtcacttgcccagggtcaggtagaaagtggcaaggtcaggatcatagctcggaggggctttggtgacagctgatggcactgtgggtggtgtgagggttggtgatttcagggccaccttggcaggaggtcatcgtctgggattgcctctgacacagctggtgccgtgtgacgatgagactgctggccagcagatgctacgggaggcagagttggacgcatctggcagccctggtcccagagaaacagatcatgtcctgttctggggttgctgtgaggtcagcctctcgatgactgctgccctgggtcataggcgactcctcctgtggtggagacagccacacaatctgtccattgtgcaccaatgccaggccaggaatcgccctttctgcttcggggagggtgggaccattctgtgccgttagcccgttgcagttgcttccccttgtggaaagcaagcctggtccccaggaagacatgtggccctcttaccaaccaggaacagagctagactttgtgcagcccagttgggacaggggcaggagagggcaccccaaagcctgcgctctgagccagcatgtgggctgcagcccctctgcttgtgtgtggacggtcagggtttttcagctcaaggtctgggggcatgttgagttttagaaatatcaatgtttatcaataatacattttccccaaagttttagaaataacttttatgcacattatttctgggtttcttaacctcaacatgattgacatcttgggctggataattctgcactgctaggggctatcccaggcaatacagggtgcttagttgccttcccggctgctcattaccagatgccaacagcactccccaccctgcccctcatgacaaccaaaaatgtctccagatgttccctggtggagggagcccatgccacccctggtcgagcgtcactgcattttgtaagagatgggtccagcagctctgagagctcaggtgggccagtcaagttgtttctgatttttgtgtggacactgaggccccactgggtgcagtttctgggttttagtgtttggaatcacacaccaagaggactaacatcttgtcacttcttttcttcagtaatattagtacctgcggcagaaaggacaccctgttttctgtttcctcctggtttgtgtgagtggcatgacttcccaacgtgtttctgtgctgcctgtgcaggctgtgtgcccgtgataaagcccactgtgtctgcctttgtcttcatgtaataaatcccattgccacctcaccagccaagagcacagccggccgggtaaaccacgcgctgggcctctgctgacctcggccctctgggatggacagagtgaggcatgaggatatcctctgagcccctccctataggtccctgccccaggcctcccacgcctcctggcagccagccctggatctggccctggcccctacccgtttgtctctccactgatctgtgagatcattcatcagtaactattatgttcattcagcaagtcttagtgagaacttactgtctgccagagttctcctaaaagacattacagatgcaacaatgaataagacctggtggacgcagcccctgccctgctggagctgtatctgagtgtgagtgcatcggatgatgggaacaaaacataggtaaatagaggacaaggtaacacagccccagtgatggcgagtactaggaagaaacacaccgaggcctgggagaacagggaggtccttgttactgatcctctgaagagctgacattgagttgaggcctaaagggcaggacactcaggaggggagcaggcaagggagcagcacctgaccaggcccttcagtgaaacaggatggaggcataaggacccgcagtagctgggtgcagctggagcacggtggatagggctgtctgcagtgggctggcaggagccaggctgagcctgggcctggtggcctcctgggagcgctgggtagctctttgaggacacaaaatatcgtgccagctcccctctttgatggccccaagttgagccacagacaacgtgccattttctagtccccaagctctctgaggaggaaggggccctgcccattgcagcagtcagaggtcagggaggagctcctggggcggcaggacgactcccacttctgagcatgcccgcagccactgaagaggatggctgacatgtggaacagaggccagtgtcatccacggggtagatgtcgtagccaggtcacccctggcagcaggatctgtctctcttattgtgcacctagagcctgtaccagaaactagaagactcgggtggctggatgcagaggtgaggagcccaggggtcctctggcctcagtgacccagttggcctaggtcagcagcaccaccgcaaactgtgccctgattctggatgactgttctctccctgcagacactagtttgtaagccctgctggctgtgagtcacatttgcaaacccagcaatgcatcacacggacaaggcaggggagcccatgggctgccaggaggcattggcttattctgggaactgaaagtcagactcggccgggcgactgtgggccagggtggggtgggtggggctccagcaggcatgtcacctttggccttgatgtagggaagctgctcttctgtgtattattgtatacaggggaggggcagctgcataggcccacctgagcaggtgcgtgggaatgcatgtaggggttcagacaggtgcttagggggcgtggggctgctgctgaggtgggtggaacccagctccgtgtgaccttgggcaggcagcccctttcttgccctcctgttgttcagctggtagctgtgacagtgggccagatgaccgaccccttccagctccatctgcgtggaaatcccagctgtcccttcatcctgcgggatccttccctggtcgcctagaggacctgactagtgtgatggtgctgtgacacagcatgtggcatttgtcaggggaatagctctggctgggcaccttgcctgcctcccgctgacagaaggtggagaaagctcataaaagtttggtgtgaaatctggggacagaggggaggtattgttttcagtggcaggcctggaaaaagggggagtttgctgtctccaaataatagtgttctctttccttccagccctctcctctgtagcagtcagggttattttttggcctgaacaccattgttttgcatgggtcttcctgctggctcttgaacaacagtttcccccccagagagcctgtggtttctcccagccgtggctcacaccacatgccaggcggctaagtgaggagcatgacactgtaatgcctcagtagcccccatgggaggatgacccgaagtgaccattgtgggtagcacccaccttcaggatgggtgtgcctgtgacctgcaggccacaggagacacagtggggtctgcatgcagaatcacattcagggtgccccatttgcgtgctcgggcccctgccctgctccgccccacacagccccttttaatgccttcccccaatctgaaatggagaatcatgtacagttcattcaccctggaggctggagcctggttgctttgaatcccttattctatattcattctgttcaccagggaggggatgggttgttgttggcgtctgctccagggaagcttccccagcccttcccagggctccagcgtttcccctaccccttgttgggcctgggacaccgagtttgaccagcttgcacatggactgtgagtctgatggatcctaagtgtggcttgccctgcgcaccactgctcggctctcagcagtcctgaacgagctggcacatgcatttggaacaagtttgtgaacagagtccctctgctgctcagccagccgcttcccatcttggggggcagccatcagttccagtggcctggagcctttccagggggttctgtgggactgaacagagacagtcttcctcgctgcacagcccctgtacaatggggctgtacggtatgccctggaagtgatctcatcttagtcttttgcaggcagcctcattctaactgctgcatgttaaacggcctccctgtcctttttaccaagccagctctctactggtgtatacctagggcatttctgatcatgttttagaaacatgctgtagtgaatagcctagtacatgtatttttgggtgcacaggtgaggaattctgtaggataaacacctaggaatcgggatgctgagtttgcgcattctgcattttggctgttgtccggtttctctctgcagaagcagtaccagttacactgccaccaaccaaggactggtccctttccaccaccttaggaagcgtctctaatcagtttaccttggcatggagtcacagagtgttggagggtgccaggatcctggcagtctcctcctcttgcctgttggttttgctgctgggagctccaggccctgggaagggtggtgtcatgctgcctcacttggcttgcccggaccctgaatctgggccatcttgcccctgtctggtgctgtgttctcaaacttcacttttctcttccgcactccatgtctgaccaccccagcctgagctcatgggtttaaatattggctcacaggagctgatagacctagaggcagattgcatcagagttttctttttgccagctctaccaaatcacagagatcactgtataaaagatgaaggcagcccatcagttcttcctgaacagtgaggtccagcacacatacccctaaggccagcaccacatctgacacaccaccaagaccgcatccatccccagctccatcctgtggccttgcaggctgctggactggtcactccataacccatagctgtccttgtcacttcccagctcaggaccctgttgctttagggtcaagtccaaactcctcagctggtccgtctcctgctctctaccttgtcctcacttttcatgttgagactgccgtccgccccagccctgccaggcccccagcaggcccgtgaatgtgctggactccctcaccccagacctctgcttttgctgtcccctctgcttggagtaccctttctcccctggcccatgcctgtggccctttgtggttgacatcaccaacctcagcaggctcctccccagcccccaaccctgtgccccccgcacccacactcctctgctcctttattgctggtcagccccacgcctctcctttgctcagccacatggccgccacttaggagcctctgggagggtggggagaatgtggctgctctatagctgaataggtgacatccatcaccacacacgcacgcacacacacacactcatatgctctcacactcattctcacacacacacacatatgctctcacactcatacacacacacgcactcactcacaagctcccacatacacgtgcttctcagaggctgtcactctttctgctctcgtactgtctgggaggcctcaggctgagtgctcagacgtgggagatttctctggaatacaaatgagggttgcttaagacccaagtgtctgctgatgggggagctcaactctcccaaggagccgttttagaaaagttaggaaagaaggagtgaggaaatggcctcaacacactaggactgaatccaggcaaaacagagaccgcagggaaccgcagcctcagaggacagctttgcttgggctggtggtcggtgcctgtcgccaatgcacagctgtccactgcccaccagggtgtgcctcctgctggcctccctccctcacctgtggtgggcatggatctcgctggcttgcaggcgactgggatgcgtgcagtgaccatgccgtgggtgtgctctgaggacagcaggccctggctcctgcgtttgaatgtctctgggcctgggaggcatctggctccgttcaggggcctaacagctctgtttttggtttgttcgtcacatcacagaatcaaataatctagaacttaagaggcagaaaggatgttataaatgaattattctagcccacacatcttacagatgggaaactgagatacagataacttaagtgactttcagaaacacacataaagtgaatggcagttctaggacttgtaacccaagtttcttgactctgcatttgtttcaacttgcacagtgccccaggacccacgcgctcgggttaagttagccaggtgtagctgggctgcaaaagattatctgacagtgatgggcaggcagaagccttggctgactgtcaggactgttacataggttgcacgctgcccagcccagtggtaggctttgtgaatggcaccctgggtagctaggcttggtggtcctgtcccagcgtacagtggatgctgctgcaacctccttttggctcttgagagcccacctccaaggtttacctgcatgcatctccaactccaaccctatgccagcctggccacctggcacattctgttgcacctaggcctagtgtggatttcccaggactatctgtggcatgtggttttctgtaagctgtaatcaacaggcaggtgttctgggaggtgccaggaagacttcttctgggggatgttcggctggccttggttgatgacaagttaatcaacaggggttggtttcacggttgcagtggtctgccaagagggttcattacttgtccttcccagaaagcattgcttggcctggccccaccccctccccatgtgacctgacctcccagggagaggctttgctttctgcagaaccacactttctgccttcgaaagtacaactgctcttgacactgttatgtctgttagtcctccccctgcaggggccactccattcagcagctgccttgggagccctcctgtgcataagtgcagtgctggccctgacacgctcttccccctgcgccacgcggaccctcctcacagaggccctgtggactgtggccttcagttatgtcatgtatttactgtcctaaggggtgtgtgtcttcatttgctttcatctgtcttgctccagggctgggaagagatgcagagcctctggtccagctgtggctttgagagaacaaacaaccagtgaggaccatgggttgggaggaacagtggaaagggagctgcagtctcagctctgccactctcccttgcgaccttggcctcgctaccactgcctttcccctttccaaaaagatgggggctggatgaagggtccatctgggttttgctagttctgaccatctttgcctttccctctgggaaaggaaatcgcaaactggatctactattttttttcttggatgctctacctcatgcagaccccaaatggaacacacccggcctccctggactgtcaggctggtggcctcgccttggggtagtgaacatgagaaaggcttccctttttcctgaaatgccccagagcaaccctggccctagttagagttgagatgcttttcatttcgccaggccttccatgccttgggtctttgactggagggctctggagccagaggccctgggttcagactccatcttggccactgctcgcagggagagccctggccacctactaggtgctttgagccctactttgttttcttttttcttcttattttattttgagacagggtctcactgtaatgccccggctgagtgcaatgtcgtgattactgctcactggagccccgaccttcctggctcaagtgattctcccacctcagcctcctgagtaggtgcgcaccaccatgcctggctaatttttaattttttgtagagacagggtcttgctatgttgcccaggctggtcttgaactctcagactcaagcagtccacttgccttggcctcacagaatgctggaattacagacgtgagccaccacacctggccaggcctagtttctttgattgtcaaatgaggctgctaacgggatctacatagggttgttttgagggggaaacatgtccattcctgcaaggtgtataggtctgtgacccgtgcgtggtgagcatgtttataactcaccctggaatcttggcaggacccccgtcaagatgccaaggcttcaggaaccagagacttccagggtttcacccggcgctgggtacggaggagctggtggaaaggccaggccttgtggccctcagctgggcctggctgtgctctcaggaggagccaggggagtgaaattgtgctgagtgagcccagggtcgcttcctttcccatgaaagcccctgtgagtacttttaacagccataaggaagtaatttcagttcttctgtcaagggtagaatcactggtgttagtggggtagctgagtgttaactgaacacacaggccctgatgcagtggatcctagagtcggctgggaagtttcctctgggtgtggcacgctgggttcgccttggtgctgacacctatctccttctggagccaggtggtgatcaggattctagaatcctgttgggttcagtacaggaggctgttgtcatccccagctgatgctgctgtggccatgggggaggtgacggaattgtgccccctctgatgcttgatctattccacgtggaaagctggagtcccgagaagcaaactccaggcaggcccacgctgactttcaggcctgtgcttgccgttttttgtttgtttgtttgtttgtttgtttttcctgagacagattcttgctctgtcacccaggctggagtgcagtggcacaatctcagctcatgcaacctctgcctcccaggtacaagcgattctcctgcctcagcctcctgagtagctgggattacaggcgcccaccaccatgcccggctaatttttgtgtttttaatagagacggggtttcaccatgttggccaggctggtctctaactggctggttttgaactcctgaccttgtgatactcccgcgtcagcctcccaaagtggtgggattacaggcgtgagccaccgtgcccagcctttttttttttttttttttttttagttggagtctcactttatctctcaggctggagtgaagtggagtggtgcaatctcagctcattgcaacctctgcctcccaagttcaagtgattctcctgcctcagcctcctgagtagctgggattacaggtgtgcaccaccatgcacggcaatttttgtatttttgcggggggttttgctatgttggccagtctggtttcaaactcctgacctcaggtgatccacctgcctcagcctcccaaagtgctgggattacaggcgcaagccaccgcgagccacagtgatatgtcgagttcactaacgtttagctttcaggtgctccctagcctttctggagatgcacaacagttcagtcacagagcctgtttctgtaggtgaccaggtgcactgcagtggcctggcgtttgacactggaatggctgattttgaatcctggcaaagccccccagctggttgtgtttgaccttgagccagtcacattgcctctcagaaacttggtttctttatttataaaatgggaataaaaacagagacgttttgctctgtaaaccatggggctgctctgagaatcaaatgcaatattttgtgtcactgcccttgttgaaccagaaaagtgctacacttgtatactgtggtggatcattatgactatgatttaaaacatccatgcctgaggagccaaatcctggggtcttttgtattttcatttcaatttatacacccaagagaagtgaaaacgtatgttgacacaaaaatttatacacgtatgttcacagcggcattgctcctaacagccaaaaagtggaaacaacccaaattccttccaatgatgaatggataaacaaaatacactacaccatgccgtgaagtactatttcatcttaaagaagaacaaagcactgccgcacgctgcaacatggatgcattttaaaacacgatgtgagcaaaaggagcctgtcatgaaggaccacacatcacatggcttcgcttgaaggaaatgcccagaataggcagatctacccagacagaaagtagatgtgtggttgccagaggctgggacttggggctgagagtgaaagggaatgggatttccttcggatgggatgaaaacgttctaaaattgagctgatcgttgcacaaccctgttaatattccaaaagcccttgctttggggtaaattgcatcgtatgtgaatgatatctcaatcaggctgtttttaataaaaatcctatgaggtaggaacaagtacaatctccatttacaggtgaggcccgggcttacaatgaggaaggcccagttaactgggcctggcggcctccagctccctggcatgcagtcccttcatgccatcagccctcactctacagagaagggagctgaggcccagcaaggaggaggggtttccaggctctgtgtggggtcttttcctcccttccagcctccccacccactggaggagagatttcctaagcagcgtgtggagcaggaccttcccagccctgccatggtacccgctcggcgctcaggccatgcagcccagtgggcagaatttcagcccctgggtcctgagtgaaggaaggagcaagctgttaggacgggcagggccggagcccgggactttgtctctgaccaaaacctctcagagtctcagggtcctgagaaaaatggggagaaaccctgccaccctctctgtgctgtgggggacccgcaaatacgggaaggtgctgcgagacctgccaggacttgccttgtgcgcagccgtccctgctggcttaggggtcagtccgggcccctgggcctctgccaggcaggtcacgcacaggctctcctcagagcacaggcctagggcagatgggggctggaactcacagaggtttccagtttccatgatgtccactttatctgtttctttttctgtcttgtgcttttggggtcacatttaagaaactgttgtttaatccaaggtcacgaagatttatgaccgtgttttcttctaaaagttttatagtttgggcttttacccaatagcgtttttatattgaaagaagcagtgtgcatatagcaagtcccaggtaagtggccactgcctttatttttaaatgattactgatgatgatcatttttatttattattattatccttactataattaatctctcgttgtctttcccatctgggtagctggctcttatttcttcttgaaagatagtattggtgtttgaatccatttctggcacacttaggggtgcagggtagaaggggaagatctgattacctgcctcccatttccccccaaactttgtgttatgggaaattaaaaatatttgagaagagagaatgccgcaacgtgctcccaggtgccacctcccagcctcatgcgtcagcagctgcagccactctcatttcatccgtccctcacctacttctgtccctgcccccaacccggattgttttgaaacacatcccagattcctatttaatctgtgagtcctttttgagttgcatctctgaaaaacgaatcccttggaaggtcgctgcctggagcctgggctgccggtggggttgggaggttgtgttgcaccccaggcatcagcaggagggtgggcatgggccagaaccacagcccccttccatgggcacagctggctcctctggggtcggctgcacagggcaaggcagggtgagcccagaaaccttgcgtcaggtttagccctaggagcccaggtgttgcagggtaatgagaatcctttcatttttgtgtctacaaactccttttgcatccatgatctccatgatgcccacagcagctgcctccggtaggctttattcagaatggaccttacccaggatgagtctcagagggttaactccagacacagaatcaatgtcagaggcagaatctggactcaggactctgacagcattttccattagaaggagcaaatccctgtgtctcactccctgctcatttcctgcctgtgaggatcgaggaggaaagagtatctctgacgttcatctcattctgctcagattctcagtggcagcttagcaaagggccagttgtctctgttggcatcattccatgggcttggggcctctgaaaaccctgagagagcttgcgctgtaggtgggcaccgtgacgctctgccccaggtgtgttccagccctcatcctggcaggggctgaatgtttctgcctagagccaggctgcccttgttagctccaggatcccactcttggtgtcctttagctggcaggccctgcgagggaacatgtgcttacaatttgccatggagacggcgctgcccttcttcctctgagtggtgataaaatggtacggaagctcacccacccagcagattggtaattctaagagacttgtgaaaaatacacgaggccctcagtataataggtaagctggaaagcttggcacaaagtccgcttgtggatagtgaggtgactggaaaaattctttgccctctctgttcccatcccagaagagatcgtgtttaggaagaattcttctgttaatgctgatgctttcatccccagtcaaaagctagttgacgcctgcttgtcagatgttttcccctttggtttcatgtagccgctttccctcatgagtttggcttaacttcatgtcttaatgaatctgagttctctctttaaaggtcactgtcctaacgcataaacatggaatcagaatcgccctcatttattcagagctgagcggagacttttcttgggacttcgaggggaggaaggagcacatctgtgttctaagtggcctcggttgctgagggagaattgggtcatcccatccacgtgctcggctgttggcccccttttggaaggaaggcagcgaatgcgtgggtggccctcccgttacctggaatgcctctagctggtggtccatcccgttctagaatggctcccctgtgcagccttcaagtttacctttacaaatacactctccattttctcagtctgtttacacccttggaaccagaggccatctttacagagaccctaagggcatctggagtattcttcatgtcacagatgaggagactgagactctgagaagccaagtgacttgcccaaaggtgactctgagaggtgacgacatcgggcgcctgggtttcttgactctaggtcacatagccttcccactacaccaggctgcttcctggtgtgtttaggggaagggagtgaggacagccaagtgcctttagctcataaccgaggacatgaacttgctagccaggactatagatctggcggggtgaagcggagaaggcttttgatcatctgagtatctgctgcaccccacataatgccctgagcactgtcagtgatgtgaagtctcttgagtggatgacctttttttttttttaaatttaagttctagggtacatgtgcacaacgtgcaggtttgttacctatgtatacatgtgccatgttggtgtgctgcatccgttaactcgtcatttacattaggtatatctcccagtgctatccctccccctccccccaccccgcgacaggccccggtgtgtgatattccccaccctgtgtccaagtgttctcattgttcaattcccacctatgagtgagaacatgcagtgtttggttttctgtcctcgcaatagtttgctcagagtgatggtttctagctgagtggatgaccttttaatgttgacatttatttttctttattttttttggagacagggtcttactctattgccaaggctggagtgcagtggcaccattgtgcattgctgcagcctcaatctcctgggcctgagtgatcctcccacctcagcctcccaaggagctgggactaggggcttgtgccactgcacccagctattaatgttgggctgtgaatatgatttcatacatatgtgtgagtctcggcggggagggcctcatgcatgacctgctctcttggaagcatggactgcatttaaaagaacaagctctgatgacggaatggtgccaagaggggtagttgcccatggagagctcccaaatgagacgagggatcaggtgtaggtgcttgggtgaggctgagactgtcaggagagaggcactgggtgtggctgcttggccccagggcagctctagataaaaccttccttaaggagactcctcggttagtccccaggctccatgtgggcggcagacttgggctctcccgcatcagtgcctggttcactgtctacaggcagtgggttggtggccaaatggcttgctgacggctggagggttctgccccgcatctaggtcctcgcacttatgtgcagggagaggatggctaaggggtgaggagagtcacaggcgtgaggactggaatgcgaggcctcccctaggttacgccggccaccactgaggccagaggaagtctttaaacattcagacagaaaggagcccagggccagatactctgccgcgaaatccaaggagaggctgatttcagagcagaagtgggaatatgagtctctggtttttgtgttaaaagtggcttttggcttaacaagtggtcactaggaccaaaataagttcacttaagaaaaataattccaaatggctctttctctctgtccataaggctcactaggaaggcagcactggggtgtgtttccccagcctgtgcaggcctcactgacgggctgtggagtgggtgagcagagggcaggggggctggctgggcggaggaatcacgctggcatgtctgctgcccccggctctcacaaccaagtatcacaaacagggaggcttttaacgctgcaggaatctcccagcccagggggccaacagctccagtcagggcgtcagcagtggctccctccggaggccctgagggcgaagcttccctgcccctctcccggctcccagtggtggtggtggtgggcaccttccaccctccttggcttgtaggtgtgtcactgcagttgtctgtctccacacggcctcctccctgcgtctgtgttcagatttctctcctaagaaatccagccaggggattcaggcccacccatatggtgtggtccacccatatggagtcctaactctgttccatccacaaagaccctgtttccttataaataaggccacgttcacaaatgctgaagggttaagacttgagaggacacaattcaacccgcagcagctggttgaggccttcttcaggccagctttttccctgagacccccacatcacaccagcattccagttttgtccttagaatcatggaggttgggagcaagggtgggctccttcgctatgtcagctcgggttggtctggcccacctgggtggcgtggggttctgcccattattttattgagttctgttctggacagcagtgtcttccccccatgtaagttagggttattcccctaagaagatagtaagttccttagagactggtttttgtcacggtttctcttgcatttccttcgtgcctaccccaaagctagtaggtacagaagtggagtacttgaggagtgttgggtggctggtgcccaccctgtggcgtgtttctctccaccacaccttcccgcagaccctctgatgactcctggcctcatcccactctcccgcccctgcctcagagtccttatcagtgcggggcatggggccgccactcccagaggagccagtgcctggagtggatctgcttccgggtgaggttttatctggagtcaggcggcctgccctgagcctggttgcagtttcctctctgtcttctgtgtggtgctctatttctgagtttggcctagtcaagcctctctctcagatctccaggtgactgctcgaaatgtcccagtgctggaatgcaccaccctccaccaaagctagggctggaggataggacaggaacggatggacgtgcagagggcgcgaggggtgagttgctacctggccctacccctgctctaaccagagcagcatgcttccctttcaggagtacatcgatgcccaccctgagaccatcgtcctggacccgctccctgccatcagaaccctgcttgaccgctccaagtcctatgagctcatccggaagattgaggcctacatggaaggtagggacacgtgtggcaccacatccgtggcaggcagccacctttgtggtcacaaagtggccacggcctgaggtgtggagacagaggggtcttgtctttttaagcactttggggcaggaagcatttgaattccatggtgcagtcattctggggaggtcctttcattctcctgtgaccagcagtgaggaaacaaaagcctcagggtgctcttgcggaagggggctctgagggttttgttttgctgtgttgaacccatgggtgacattgaagtgtcccggtaacacagtggctggagagcaggagtgtgtgtagacagctcagtggcaggcaagcaagtggagttacgtaactgcgcggaggacacaaacagaaactgaaggcctttaatcaaacacgtggagatgtaatgtggctgctggacctcatgggtccactctgttctggagggcaggggcctccctcttcactgcggcgcctcccctgccagctgcaggctcctgtccctgagggctcaccctgacgcctccccaccccttgggcaggcagagccagagaactcaaggccacattctcaaggtgtttatgtgagaaagactttgtggagagattcatgttaacagtaacctcctagttcactgcttagtccaagtgtgccctgctgagagctcttgtttaattttaaggaaaagtgcttggcctgggccctccggctttgtgaggatttatcctggggtcaaggaggcagcccctgctccctgccctacagaccatgattgaggcctaacctggctgccttgaaccctgacctggatggtgacttggccttgggcataatttcctgtgatggtgaccggtgggaccagtgggtaccatttggctcacagctccagaggcagaccatctgcatgggagtctgagaccaccatttattggctatgtgttgtgttcctgcctttgggttaggccttctccttgtattctcccttttggtactcttagaagtgggcatgataagccttcccattttacagatgaatcccagaggctctgagaggttagcagacatgccacgtcacgcagcattcaggtggctgggccagcatccagccaggtctgtctgactcaggctccccggcccctattcctgagcttgactttcatgtccatggccagagggccctggatctagaagaacctgaaatgggtaccactgaggaccctggcctggagagtaggtgagtcctcggttccctctctgaggaatgtgccctgcagaagagctggctgctggatttggctgtcctggaagggctcccgaggcctctttccctgaatgcctgacacaccgctgggtgcagagaatgggggtgtcatgctggtgccccatgtaggcaggctttcttagcacatgccagcagcctttatttgctaggcctggagtgattggcctctgctgtgcacttcatctccctttgcactgtcttcctggatccatccagaatcccagatgggaagaaagagctgtatgttccctcctggggtcaccttcatctcagtctgccatgggtgaaggtttggtaaaatttgggaaagggaatcagcctctttccagaaggtgtgcttgttggacactgcctgtgtgaagagcaggaggctgtattagaacatgagaaggcccagctagcagaagaaggtggcagaccagcagccacatctcatgtcccggacaagtccattcgaagagtgatgggtttgggtgggattcgaggaggtgccgctgaagggccttttggagccaaaagcacaggctctggcatgtgggttcctgtctgggctcttgttagccacgtggtctcggacaaatcagtcatttgagttctgctggtgttctggaagatatgggtgatacctggttcagccacggggtcaggggtcaggatacctgggatgatgtctgcagagcacttagcatgggaccggcccactgggtcacccgggaacagcagctgctccagctgttcccaccacgatggcaggaccccagcatcctaattgagtcttcacatccatcttagatttttaggagtagaagcccagggctggggatcaagggtgagcctgggctcagggtgggtgtgtgcacggtgtgttcaaggagcaggaacccggtgatgaggtggaccgtaggaagtcacatggtgagaggaaggcccaggaggtacctctgttgcccgctcgcctggcttggaattgggcctctcctggaggcagttaggaatcaggtcaggaattttaagcagggtgtgtcctagttcactgggagattagaaagtttaggagctacccataaggggagagctgtgggtgttccaggagagggccccgtcctcaacaggtccagggagagctgttgaccaaaccctaacgcatgcttggttctagatcagcaggaagtgtagggtgggtgggccataaatgttgcacgctgggttttccttatcgtgcacgccgagcctgggcttgtattcttccaggagggcggtcagaggctgggacttcctggagccctttcctgacccccagtggctgtccattcaccagcatcgctgggtgggtccctgctgcatgcccccaccagctgcagaggcagagagccttcctgggaagcacaccctgggcccccctcctcaactgcctgctgttcctggaggcactcagccctttcaggcgtactgtaaatggccataattacccttgaagttccctcagataatcacagcaatccagtgacacgcttttgtgctgggagaaggagcttggtgagacttcctccggttgtcaccccccctgccccggttgtcaccccccctgccccggcagtaagactgctctgttttcagagactctggacagctgcagggaaaacagagctggtgggggacgggtgggtgcttcgggactgctaggatcctcattgatgagcagtgggagggagacgaccagagcccctgctttgcggtgggggtgggcagttgggacatggcacaaggggaggctctcccaggaatagcaggcagagcccttggataagggtctgtgctcaggtgggccgtctgtctccctgcagagcatcagccgtggagggcctctcccaccccagctctgcatccaggagacagatgaggcctgctgctgggagctcccagcatcgctgtctccgggcagcctgtgtgaggtcactgccttctcagttccacattcccagagctcattcttgtctcattcagagcctggaggggaagcagggtcatttctctgcctcggctctggcagcttcaaacccacccacttcgtatcaattagcattcaagttgctttaacagcagacctaaaatcatggtggcttaaatgcgacagaacttcctttctctctgatgtaaaagcccagaggaaggccatccagcacgggcacaggggctgggaccctggctccttctagctccttattcttctgtggtctgcccatctggtcctgggtgatggctgtatttccagccctcacatccaagatctagacattaggatggagaggaagatcaagaaaaaggaagcaaatgagaagaaggcctagttctcttttaaggaggggttctgaaagcaatccagtgacatgtttttgtgctgggagaagggactttggccagaattagtcacatcctaagctgcaagggagtcaggaaattgagtccttgttctgagcagccacatgcccagctacaattcgggttttatcaccatggaagaagggctagaacgagttttaggggagcattagcagtcttccaagacatgggtccctgcctgaggacccaactttcccatggcagaacaaccttggaatttctcctctggctgggggtttggcctcggcctgtgacctcagcagcagtcccctctttgtagcaaccagcatcctggaggcttgcagaatgacccaccccagcatgccagggccctacctttccctcatagatgactgcttctgggaggcagccatgcctatacccatacccatgtccctccccacacccgcaccccctaggcagaggcacaggcagcgttgagcctggattcaattcaaaccaagcacttaattcttcctagaaattaagcattccctggtgcaggcctcggggagggagggaggaggccgcagtaacaaacattgaatttgcaggctctttctcccatcagcagcccactctgccacccagggccagggtccagagatggaagccccaaagccaaggcatggctgtgctaccctagggtgagcgattctgggcacggctctagctggctcccaaactggctgagaaggcaccatgtatgagaaggcacctgggccgtaattgcatggcgtgggtttgtgtccctgtcttcagggacagcaggtctcagaccattgggcaacaggctggagagatccttgaaagccctgactgctttggggtgatgggtggctctcctgttcttcttctcttagaagttcccatgtgtctgctctgggggtgacagatggcctgtttgggatcccaggcctccctggggatggggggtgcataccgcagattgaatgcttctgcctgtggttttacgggaatttaattagggctcatcttagaggccatttgaaacctgggttgaaattgagtagtctggatacaaagcaaagagaaagtaacattccttagagcctggagaaataattccccaaaaagcttttgccttgggggtgggtgtttgtgattggtggggagctgctcccagaggcaggaactggctctcaaccctcggggagctgcagaggggtggggacttggagtcaaggcctcagaccctgcccattgccaccgccacccctccaaccctccgccaattgtgtggcctctctgagctgtgcgtctgtcagcgcttaggcaggtgcttagtgtgccaggcactgggttaaatactttacagacagtacctaatttaatccacttaatgaccctatgaggaaggttctgatttcatctccgatttagaggtgaggatactgaggggctttgatcttaagttacttgaggtcacagagctagtggggcagatttgggatcagaatccacacagtgtgggtctgctcttagccagtggttcccaagccctgtccctcacccctgtgtgtaccccttccacacccccagttcccctgtggctgatggagagggaccgaggcaaagataggtagggatggggctctgcgcctgcaggtgagtcctgcctaggctcacctggtgctggtggcatggccatcatccctgggggtgccctctggggtccaggaaatgatacttgagggcagccacacatcatggcaggaaagaaggaccttgtcgctgataaggcttccaatcttagcccctcggggggctgggccagtcactctcccctgagttgttcactcatctgggaagtgggtcgccagtgcctcggacgtgctgagtgggcgtctcagctggtggccccaccccagatcgggcagagcgaccccttggtgtgcacctgcccatgcctcccccagtgtcagcctgcccagaccacagggctgaggtgaggggacagcgtgccccatcgaagggtctggaatgagggaggacagggtgccagggaggtagggtctctcaggggaggtgcttggtttgtggttccctttcttggacttcagggatgtgtgggagcaccactgtttttgttttcacatcggctgttgtctgccacccaggctgagacccgccctttcagtgcaggggaggctccgcagagcaggattgtgcttgtggctcccctgccctggggcggctaagcgccagctgcagaccaggccgggtaggtgcgttgccggcatgaggcggcagctgggaccaaggctagccctggtctgagtctgcgtgagctgccgtcctggcgtctgccgtgtggaagccagtgccctcccccagtccgggagtcatggggtgaggaagaaatggtgccccagagcatgtggaaccaggtctggcctgcaagggtggctcctcctgtccttgaagctgctccttccctcagctgtagcgttccccctttacagatggggggtgtggaaccttagagaggttatggtaacttagttgaggtttcagagctggtgcatcttcaagctgagctccatgttgatgccaaagctcaccctgttcccttacaacaaacatctattttacagctgattctcagaatccctcccatctccctgcccttggctgacccttctgtgggttctgctcctgtcctctggagccaggggccacctgtgcagccatccagacattcacattctaagacaagaccctgtcagcccccaggacctgggaatctcggaagcatcagtcctgctggccgggctctcagttgaggcagcagaggccagggatgttcagggcaggacagggcctcagggagcacgcccccacattcacactgccccgtcccctttcctgcacccccacagccaaagccagctccacatcaggcccacaggcctactcgcagccctttctgtgccatctcctcttccctggcctagctgcagcaggggtccctggagagtagtgagagcttccccactctccctccagcagcctcacccctttgtcccaccaggactggggtatgtgcctggaggacagtggcccgggagcctggatcagcttttcctggagaggttgtcaggtccaggcctcctaagggcactggcagagatgaaacagatgctggattctctgccaagctcctcatttccacagctgtgggcactgtggacagggcagcagcccctggcatcctgatggtaggcttgcagtgacccccatgagaacagaccctgccaggcatttgctgccctctgtccctcctgcccagggcactggtctggaggctcccaggagagactcaaaggagtggactgagctctcatggcgactggctggcaccctgcaggagagatgcaccttcatctagggaagaatgttcctgtctgttcactcagagcttaaccttgctgagcctttaagaccatggcagggacccgctccccagcaaaacaagaaggcccctccacccacagcccaccaacccctccagcgccctccagctcagtggcttctggacgagataccccacttggtccaggtgggcctgccccaggccttcctgcagagctttctgaaaacctctgtcccctctcaacccacaggcacccctcctctaggaggtactctcccaatgacatcagctggctccgatcacttttctagggcactgctgctgatcctaggccagttggtgaacagactgtttgtctttgggactctggctctcacccaaaattcctttcccctggctgtgttgactaactccctccagactccactcccaggctttcttccccctactcacactgagtctcctggctcccctgggatataagcagggtacatgggtactcaaaacctccttgttggtcagattggtcagaaggtatccaacagcagccatttacactttagtgtgaatttatagctcacttagtgtttttccagctgaaagagatcttgagttctggaagccctacaaaaactgctcttctccacatcctcaacaatgagaatagaggcccagagtggttgcatggctgacccaggaccactcagcacctttccgactctcagtccagtgctgtctccatgggacccacatctctgcaggggtcttttcagaagcagcgccatagtgaatctaaagtcagactgcctgggttcagatcctctcctaaacacccagctgtgtgcatttaggcaggttatttaactgcattgagccccagctttcctatctgtaaaatggggagggaggtaatgttggtggcaccttcctcataggttgttgtaaggattcctcaatagatgggagctctcctggcagacagtgcattgtgagtttcagaccacaccctgtgtgctgtgaccctgtgagtcctgtgtttctcaacttgcatttagtgctaaaggcagcagcccctggcgccctgatggtaggcttgcagtgacccccatgagaccagaccctgccaggcatttgctcccctctgtccattctgcccaaacgcccagccccgtgtttgcaaatgtgtacctgggtttatttccccaaacaagagtgtcttcagggtgaccaatcatgtaacacaagcgggcttttaaaaatctctttattggctactagatgatgtattgtagatttattataataaagttcacattgcacaggtttgtttagtgtaatttttatttttaagaaattttgacagagttgcaaagatagtacacagagttcccatataccctttgcacagcttcctccagtgttaacatcctatctgaccataattatctaaaccaggaagttcacattgataactattcaataattgaaagacctaaatgaattcgaatttccccagttgtcccactaatacccattttttagtccaggatccaatctggttgtcgctctctgtggtctcctgccatctgggatggagcctcaggttttgaccttgacactttggaaccttgactgtttattttgtggagtgtctctcaattcaggtttatctggtgttttcgtgactgggtcaaggtcatacattttcagcaggaacaccacccagcagtgccagtccctccctagtgcgtcatatcaggaggtgcatgaggacaacgatgtcttctgtctgctcagcagcagttatttggttaaagtccaccaggcttttccactctaaatttctattttttcctttgtagttggcaagaaccttctaagaggattctttgcagactgtctctcatatgtttgcccttctcttgtagcatccgtggatgggtgttgccattgttactgtggtatttaccgaacagtcatcatacagaattataagaactgtgtcccaaccaccccagttgccctagaagtgacaggatccccttgcagctttgcagacatccacagggcaccaggtggcaccttgtggagtgtcagcataatctcacgtgtgaacaaagggaaaggcaaaataaggaaaagagaaaagtgtcagatatgttggagaatcaggattacatgtttctttgctgcaggacttctcagagccttagtaatgtgttaatatgaatctttagtctgggggcagtgttgaatttcattaccgattgtaagatgcactgatacttcatattctataaaaaagaaaaaaatcctaagtaagttgtgaaatatcaattatgagacacatctcaatttcagagatggaaaatatgaaaaacatgccatagaatcagtgaagttctgcagaatttagccttttccatccagttaactatagagtcccctcctctctttgaggcttctcttgagagactgttgcactcaacacactcaggaattccctgactgggtgccttctggccgccctcacttccggccctgcacaggtctgttcttgagttccctgtattagtgtgtggggccctcattgctggtgcttctcgaatctgtttaactccagcctcacttccctgaggcagccactgttcatagtttggaacttatctttctagacccttcctattcatacatgtagagatacatgtgcacttttagtattattttttcattacagtaggctctagtgcaatgtgtacatttagaaacagggtcattttacacgtgtcctgatacagctctttgtccccactgaacatgtgtcttgcttcgcttctttccatgttagcccatgaagatgagggggatcaggtctgccccttttgctggcagcataatatttccatacatgaatgaatgaatcctaatttatgttgggcccataaggtcattccagtcttgtttggattttttttttttaaacaaactgggctgcagtaaacagctccctgcatatttctgcataattaatccctagaagtgggatttctcagccaaagattataaacattcctcactttggcagatctcactggattgcccttcaaaaagtttgagcaaatttcactcctgatggtgccagtctgcctggggaagccgtacccacctcgattgatgtgtgtttgtcgttattggcacaattgagtatcccatcatggattcactggctccatttgcttgtcttctatgaatgaatctttgcctgttgtttgcctattttttagttgagttgttgggcttgttgattaattagatccctttttgtatgaagaaaattgtcccattgttaaaaattgtggacgggttcatgaatgtaagcgtcatctttgctctgggtccaagctaagatgttttgcttttagaataggtactaccagaaagagccctccaaacattttaaaaatgtcttgaaagtaaaaaaggctgccatgttttgggagcgggagctggagctgagcagggacagtgagcgtctgcctgggtccagaaggggctgtaaatcagtgggagcagctgccacagagtctacccacgtttccagctactgccgccagactcagacatcgggcgcagaaatgcctgtctctgtctgagccagtgtctggctcctcttctcctgggctttggacattgtggttgcaaacagctctctggtcacataagatgaaatgagtcactagctaagtcaggtgggaggaaacctgctcttcccctgcccgtggcttgctgtattggactgtaactttgcacctgtggcatttgttgtcttctcttctcgtcctccagtgttttctctccacagcttgcctgtcaccaggtagctaagtgaggatctagctgctagcagggaggttgcacctgtggtaaggccatagggtctcttagatgccttcaaggagcagggtagggggctgtggccactggcgaaatgccccctgctttcccccagtgactccaaatatcacaattgcgtttcccccttgaaagctcatagtagctggatgtgttaatttcctattgctgcatgacagatgacagcagattgagtggcttctgacagtacccatttattatctcatgggtgggtgggtcagaagcccgcatggtgtggttgggctcttggcccagggtgtcacgggctgaaatcaaggtgtccgcaggggcaggtgatcttctggaggccctgaggaaacatccacctccaagctaactctcattgacagaatccagttcctggtggctgtaggactgaggtccccacccttgctggccagcagctcctacaggtcctgtgtttcttctcacggtgcccctctacttgcaaggcggccacagctggccagtctccttgtgctttgaatctccagcttcctcttcagagaagaagctctgtgtgtgatgccctaagagttacccagaccatctccctgttttgagggcagcaatgcaacagaaccgagtcacagaggagaacccatccatcatgcatgcagttctggcgatcatgcagggtgttgcccggccacagggatcttggggttgacttagattctgcctgccacactgagtaatacaatggttttcccttgcatacttataagttcaatggaatttaattgctatcattgcatctctccaggccctgtcacctgtgctgggtgtcttggggcatgtcgcccctgcccattccctctcctgggtggcgtctcctgtcatactgcccctgcactccacactgcagccaagccgaaccccaggggcacccctcttgacccttggcctttgtccatggtgttctgcctatctggaatactcttggtccccaggactaactccaactttggggtttggctcaggccacttcctcccagaagccctctgtgctgcacactcccttccctgcgtgggcctcagtgccttcctccctactcacagaccctttgctgccctcatcgcacattcattccactgtttcgtcattgtctgctggccgctgtcttccccacctgaccgtgacagccttgaggacaggggcgagtgtgtctttggggaccatgacaggtcagggcctggaacatagtacctgctcaataagtatgcaaaggagggaagaatgttttcaagaatcagatacataagaaggagatgcactgggggaggctctgagcagaaatcccactcccatgggagataggcctggggcaggtggggtcatgggctcggggccacaggaaggggtggtcctggttgtctgtggggctctcgcggaggtggtatttggagcggctctgaaatactgggctcaattagaggaaggtgggagccattccagggagagggagcaggatgttcaggagaaatgggggctattggtgctgcgggagagagccccatgccgaggcccagagggcctccagggccagtttctgcttagcctatgcggggagagagggaggccattgggaggctgctgtggcttctggaaaagatgctgagggtgtgatgagggtggtgactctggtcaggaagaaataggatggaggccagaaattgagggggaacattggcaggcatcagggcaggcattattatctgggatgagttaaggagaaggaaacacaggacaagccataaccacaatctgtgtgccagctccacagggcaggacagtgctggggggctccaagggtgggccaggtgtctccacggcggccaagaaaaactacaagagaggccgggtgcggtggctcatgcctgtaatcccagcattttgggaggccaaggtgggtggatcacctgaggtcaagagctcaagaccagcctgaccaatatagtgaaaccttgtttctactaaaaatacaaaaattagctgggcatggtggcacgtgcctgtagtcccagctacttcggaggctgaggcaggagaattgcttgaacttgggaggctgaagcaggagaattgcttgaacctgggaggcggaggttatagtgaaccaagatcgcaccactgcactctagcctgggcaacagagtgagactccatctcaaaacaaacaaataaacaaacaaactatgagagagggaccctttgtaggcccccaatagtaataagtccccagcctgggccaaatcccagggcttcagtgataaagattccatttcaacaggcagagatgagaagggagggcattccagtggcagatacagcacagacaaaggccaggcaggtaagaaaggccaagttatcaccaggaatagagatggtccctcttggtgagagcctttcttgttttggggcatggggtggtacaggccccctccacctggcttggagtggacttgttggccttgtcatgggccagagccctccacctttctcccctcctctcaagccttcagagaagtttctgtcatggagttcactcggctgcctcaggggctctggctcagccaagaacattgtcagggctgggtggtgttctctttgtgttttctctggacttgttctggcaactgacagccccagatccagccttgtattttaaacacgaggatcctgcatcgaagctgtgtgttctgcccaaagatgatccaggcctcagtgctcctctggggctggtgtatagtctgttatcacactgctataaataactacttgaggcctgtcatggtggctcacacctgtaaacccagcactttgagaggctgaggcgggtggatcgtttgacgtcaggagttccagaccagcctggccaacatgggaaaaccccgtctctactaaaaatacaaaaattagccaggcgtggtgatgtgcgcctgtaatcacagctacttaggaggctgaggctgcagtgagctgagatcacacactgcataccagcctgagtgacagagtgagactctgtctccaaaaaaaaaaaagggattaaaaaaaacctacctgagagtgggtaatttatgaagaaattatgaagaggtttaattgactcacggttttgcaggctgtacaaaaaatatggccagggaggcctcaggaaacttacaatcatggcggaaggcaaaggggaagtaggcatgtctttacgtggcagcaggagagagaaacagagcaaaaggggaagtgcgacatgctagatttcatgagaacttactatcacatgaacagctagagggaaatctgcttccatgatccaatcacctcccaccaggtccctcccccaaattgggaattacaatttgacatgagatttgggtggggacacagagccaaaccatatcattccaccctggcccctcccaaacctcatgtccttctcacatttcaaaacacaatcatgccttcccaacagccccccaaagtcttaactcattccagcattaactcaaaagtcccagtccaaagtctcatctgagacaaggcaagtcccttctgcctataagcctgtaaaatcaaaaacaagttagttacttccaagatacaatgagggtacagtcattggttaaacagacccaattccaagagggagaaattagcccaaacaagaactacagggactgcagtccccatgcaagtccaaaacccagcagggcagtcattaaatcttaaagctccaaaataatgtcctttgactccatgtctcacatccaggccacactgatgcaaaggatgggctcacaagacttgggcagctccacccctgtggctctgcagggtacagccctcacagctgctttcgtgggctgacactgagtacctacagcttttccagggacacagtataagctctcggtggatctgtcattctgggatctggaggatggtggctctcttctcacagctcccctaggcagtgctcctgtggggtctctaacatcacatttactctctgcactgccctagcagaggttttccatgagggctccacccttgcagcagacttctgtctggacatccaggtgtttccatacatcctctgaaatctaggcagaggctaaaatcttgccttcagcacacctgcaggcccaacaccatgtggaagccaccaaggcttggggattgcaccctctgaagctgtaccttggccccttttagccactgctggagctggagcagctgggatgcaggatgccatgtcctgaggctgcatggagcagcagggccctgagcccagcccacaaaacaatttttcccttctagacctcctggcctgtgatgggagggactgctgtgaaggtctctgaaatgccctggaggcattttcccctattgtcttggctattagccttcagggcttcttatgcaaatttctgcagctttgagttcctcctcagaaaatgggtttttcttttctaccacgtggtcagcctgcaaatttttcacttttatgctctgcttcccttttaaatataagttctagtttctggtcatttctttgtttttgcagatgagcataggcttttagaagcagccagtccacgtcttgaatgctttgttacttagaaatttcttccaccagataccctaaaccatctctctcaagttcaaagttccacagatctctagagcagggacacaatatgccagtctctttgctaaagcataagaagaatgtcatttactccagtttccagtaagttcctcatctccatctgagacctactcagcctggacttcactgttcatagcactatcagcattttggtcacaaccattccacaagtctctgggaagttccaaactttccctcaccttcctatcttcttctgagccctccaaactgttccaaactctgcccgttatctagttccaaagttgcttccacattttcagatatccttatagcagtgccccacttctctggtaccatttttctgtattagtttgttcttaacattgctataaagaactacctgtgactgggtaatttatgaagaaaagagttttagttgactcccggttccacaggctatacagaaggcatggctggtgaggcctcaggaaacttacaatgatggtggaaggtgaaagggaagcaggcacaccttcacatggtgacaagacagagagaaagaaggatgaagtgctacacccttttaagcaaccagatctcgagagaactcactcatgtcatgagaacagcgagggggaaatccacccccatgatctagtcacctttcaccaggtcctcccccgatgctgggaattacaattcaacatgagatttgggtgcagacagagagccaaaccacgtcggctggcttagaagtttgctgctgatctgagttcgagttctgtcatggtaggtagatggacgagaaggctgcaccttccttaatgcctaagggtcaagagttccatctttgggcaggaggaagcaaacatgtcactcctccagtattctctactcttctttctcccctgcctcccccagggccatgtcagactgcagagcagtgataggctctgtaaggtgatcttggatggttttaaatggcagaccttcaaatagtaataccagtgatgatgatgacgataatgatggacaggatgttgggatctgacacttggtgtcttctgcatgctggtttctgttttaagtgctttgtgtgttaacctgtttgatccttacagcaatcctatgagcaggactgctcttattgccattttacagatcaggaaatgaaggcaccaaaaggtgaagtaaccgtctcaagttcacacagtatggagcattcagccaggcagcttctgggactggctacagtgtttgggaagcacagctggcccagtgcctctgtttcctggtccctgaagtgggaaaggagccttccttaactctttccagactcagtgttcttaagtgggaatgatgagactggagaccagtgacaaaggctattatgcagtggtttgcccagcagtcaagggtattctttcccgccacatgctggctttgatcttgaacgtgcaaccaactcagggcctctgcttctcacatgcaaaatggagtggtgatagtgatccgtgctatggcattgctataaagatgacacaagttgatgcctgcaagtgcttgttgatggcgcagagcacactgcattgcttgtctggttattgttgacattaagccctgcatatgctgtgttaagtgcccaacacatgtcatctctatgagccttcattttggttgtctgttagatggaaatccaaaatgataatggtgtttcttgtgctcatgaatctgcagcttggctgggctcagctgggtggttctcccatgcagtcttgcatggcagtttagcatgatggtgacagagtagccagactactgacttggcagctcagggacccaggggtgtgtcccgagaaagacagcctctctggccttgcttccagagtccatattctatttatctgtgaggctctagggccagttcacattcaagggaacagcatttagggtctacttcataatggaaagaagcatgtaagaaatagagactgagaagtcccacaatctgctatctgctaactggagacttgagacctaggagagctggtggtgtaagttatagtctgtattaggtcattctcacactgctataaggacatacccaagactgtgtcatttataaaggaaagaggtttaattgactcacagtttgcagggccagggaggccttaggaaacttacaatcatggtggaaggggaagcaaacatgcccttcttcacatggcagcagcaaggagaagtgcagaatgaagcaggggagcatggggggagccccttataaagccatcagatcttgtgggaactgactatcatgagacagcatggaagtaaccgcctccatgattcaattacctcccaccggctccctcccatgacatggggatgatgagatttgggtggggacacagccaaaccatatcatagtccaagtccaaaggcctgaggaccaggagagctgatgctataatttatggttctactgcaggagactgatgtcccagcttgaacagggaggccaagtgagtgaattctttcttacccttccttttgttctattcaggcctttgactgattggacaggctccacccacattggggaaagtagtctgcttgactcagtttaccaattcaaatgctaatctcattcaggtacacggagaacaatgttaaccaaatatgtgggaaccctgtggcccagtcaagctgacaagaattaagcgtcccaccatggcaggcctgctgtgttctaggctctagggcaggtcccaggcacacagagatgagcaaggcaggcatagtccctgctcccaccgagcctcctgcctcatctgcctccatcagggaggaaggaactgcgtactggggcaggggcacccaagaagccttaatgtcggaggaactgggtactgggtcaggggcactgcctggggcactgagcctgcaccctgtggcggagcttgattgagaaaccgagcaaggctcattttgcccagagcttgggaggagggaggcataggcaggcccttggccatggaggacttcaaggctggcaaggagtctggacctgattccgaaggccatgggagccgttggggagcatggagcagcggctcagccttaggctgggctttacaggtcacacctcccgagttctcccttgccccctcgcaacagcatgaggcatgccaacactcaggagatgccacttccctaccctctcctcatggtgggtccaagggaggagacacagtcctgccctagcccctgtgccctgaagctgtgaagtcactgcttagtccatgtggcaagggcctggccttctctcacacccccgctcctcctgtgaccacagtcctcatgtgacccttcctttcctcagtgaaccggacggctgggcagcacccagtcctgctggggaagactcactccaggctgcctttcagtgacccaggccccatgggccttttgccattggccttgagtgccttcagctctgagttcctcagtgcctaagcagcacgggaagtgccttctctcctcccttgtcccacgagggcacctgagagggccactgtgtccttacgcccgatgcccatgagagatgctagctcctggggagctcctgagactgtgcaccttggattggaacctgggctcgtagctctgtgtcctacatgtatgcatcgctgcacatgcctggcctgcccaaggcccttgaggttgctgcattagctacaaggggctgcgaggctgagggtccactgctcctaggagccaggcagggctgtcatagattttcaggtggcttccaggagccaggctgtttgtcctgcatccccagggcatgccagcttcaggatctggaacttttaatgtcttcacaaacaaaacacaacatgtcattccagttttatctcatccaggactgttcatagacctttaacacacgatgatgtcactgccatccaattgtttccatcctttcggaagcgcccaaatcccctacaaatccagccctgctcagtgccagcccctgcaggggccccaccctccaggggcccccaacttcagggagagatgagtcactcatcctaagcgagagggacagttcggaggtgttagggatgtaccctggaggcacagggcaagggcagctcctcagcatagccagagggatctggtgctctgccaatctgcaggagggcagggtgggggcctaggcagtcaggcaccccagaggggcatggaggggccctgcctgcgggcaaggcacatggctttctaggatggaatgcctggagccctccagccaggccacgtggacaggaccttgtgctgtggtggtgagggtgcatccagcccctctcttctggctctaagtcccttcagattgggaccacctctgtctctctgtcgcttgcatcccggggcctctcacccgggcccttcctggcatccccctcctggctcaggcctgtgcggccctcccacccacgtgcctgtgagttgactgtgggtgttactgggtggctgccatcgtcatcgctggccaaaaagccatttgggttgtttccagagctgctgtcaggctggaacttggttcacccggatgcacagaacatcttccctgtctagaattcaagagcatgtgactcccgccccctaactgcataaccacagagggaaggtgactttggatgagtccagggcctgaatgagtccagagcacttgaacttacagatgggccggccaggctctttccagtcctgccacagccatcttcaaggctgttccagacccacagcgccacagggtggccaggcgggagattgcaggcccctcctccttcctttgcaggctgtgccaacactgggcttccctcctccttttgtttccagtgcttacggctcacttatcccatccatcaacttatcttcacacgtgcacatgtgccagagagatggttcttactgaggcctgccttctcctgtccccaaggaacatactgcctagttactgaatcagaacccatatatgaaaatttaatagcgtacaagaggtaaacaacaaaactcggtagcagtgccagaaaaagtactagaaagacgtgactgtgggtaggagttgcagggtgaatgccactcgaggcagcagcatgggacagcgtgttcttgggggctctgcagaacagctgggattctgtgatgcttggaagagcaggtgttgccaagtgaggcatggaacggggaccatcccagagatatagtggggacagtatatccacctggcacaagggtttggctgggaacgatcttgggttgtgcggtcagagaagagttgggcgcggtggctcatgcctgtaatcccaacacttttggaggccgaggcgggcagatcacttgaggtccggagttcaagaccagcctggccaacatggcaaaaccccgtctctactaaagacaaaaaaattagccaggcatggtggcgtgttcctgtaatcccagctacttgggaggctgaggcaggagaattgcttgaaccgggagggggaggttgcagtgagctgagatcacgatgcctctgcactccaacctgggtgacagagtgagactctgtctcagaaaaacaaataaacaaacaaacaaaagagttgggaagtatattcatttgcgtgggctgcatgacagtgctgcatttaaacaacagcaatgcactgcctcccagttctggaggcagaagtctcagatcttagtgttggcagagttagcttcttctgaggcctccctccttggcctgcggatggccctcatctccccacgtctgcacatggtcttcccctgtgtgtgtctgcgtcctaatctccttataaggacaccagtcctattggattaggacccactctactgacttcattttacctctttaaagaccctatctcccagtgcagtcccgttctcaggcatggggattggggcttcaatatcaacttggaaacagcgctcagcccatcacaggaaggtacagagtcaggctgcggaggcctggaaaggctgtgggcttcactcgcggggcatggacgccttgctgggagctgtctcagtacaggtgagagctgtaggacggtggtttgtgggcagaggatcttgtgtgtggagatgatgattatggagtgaggggaccaacaaggggcttcctggattaacagacttcaggaacatcgattccaggagctgggaagaggtcgcggtgctgggccacagcccttgttccatcagtgtcccaggagggcaggccagagcaggctgggggtgctgtgctggtgggtaccaggcaccccgaggagggtgggcatccatggaaacagggctggacaatacgattctcagtcattccgaatgcccctcatgggcgtggcctcaccgcgtccctgcaaccaccccgggaggtgggcggcatcactggcctagtttacagatatcagatcagagcattggcggtcccagtcatggcaactgggctggccctccttttgcttcctgggctttccctgccatgacagcttcctccctgcagtgtccctggcttccctggccctgggcattgtggcatcagtgctgggtgcccctgttccttggcgtgttactgacatttgacctacttcttggaccctccccagcagaccttgcgtatgacggtccaggtgatgacgacaatagtacggcgagtttttcatgcacacctgctagtgccagggtttaaacatgaggcccatcctcagcatctgctggatgctggccacctctgagtgagggcagtgggaccacgacgatgagtgggggaggggtagtagccctctgaaccagatgctgttctagtcctcattttacagcaaggaaactgaggcatagtgaggtaactgagacaaaacaaagcaaaatttcttggccagggtcatacggctgatataagatggagccaggattaaaacccagacagcccaggtcctctgtggatcctgcagagtgcccagtcgggtgggggaggtggatgcttcattagttggccaagatgagcagcgtggggcccttgggtggcacagcaagggggctgctcccaggtgagcaggaagagggtgcctgacccatgttggaggataagcaggagtcttccaggccatgggttggtgctgggaggggaaagaaagggcgtgtggggctgagatagctgccctggggcctgagaagtccgggggtgggtttcactccaacccccactttcaaaagatgctgtaaggctggcccggtggctcatgcctgtaatcccagcactttgggaggccgaggcgggcggatcacggggtcaggagatcgagaccatcctggctaacacggtgaaaccccatctctactaaaaaaatatgaaaaaattagccagacatggtggtgggtacctgtagtcccagctacttgggaggctgaggcagaatgttgtgaacctggaaggcagagcttgcagtgagcagagatcgcgccactgcactccagcctgggcgacagagcgagactccgtctcaaaaaaaaaaaaaaatgatgctgcgagaacttagatcctgctgatcctgtccccagtgccctgctctatcagcaacacaatggggcccctcttgccccagtttcctgccatataatatgggcccctaggaaccgggagtggcccaggaagcaggactgagcgcagctctaagagccggtgtcggaggcacacatagctggggtctcccacgtgcaggggcgccctgggatgtggaccagtaaccactgtttgacacctgcctcctcccctgagggcatcccccgctgggtgcctgtcgtgtgccaggcctcccagcagctctctagggaagcaacactcccattttatagagaggaaagcaaggctcagcagagttaagtcgtgtgcccaaggtttcagctagtggaagtttgccccaggtccagcgtcgggctggctggcttcaaaactgccccttcaggtgctcatttcctcctccctccacccctgttgtcctctcgggtccacctgtttgtcactgaacttttgttttcttgtaagttctgtagctgctaccggtcggatgagggaaaggtcacctggtggagtggatgggtaatgaggtgtgacgcgggaggccagcctttttctggctctgctggtaactcgtgtggccttgaactagttccttcccctttctggacttgtggaagcctgtggctgggacttgcccatctccacgtgccctcccgcttcatggtgtctgatttggaaaggcagagagggaagacgggagcatttccgtttcccaggggctgatattcgctctcaaaagaacacaacccaccatccaaccaaagaaagcctcattccacctcccatccaaaaataaggatggcagagaaataagcaacagtcgcctttttcagggaaccagaaatagcctcccgggctccccgctctgacttcccaagtcttcattctgtctctattctgggagaagagctgctggcgccaccactgcgagcttctcgtgatcgagagggaggaacccctgctgtcgctgtccctcaggcaggcagaaggggcttgtctgctggtactgagatggtgggggtgcacctgggcgccacctgccagtgaagacagctgggcctggttccttcccagcctcccactcagctggagcgttctcaggttgggtccagttcatacatcctaagagcagcaggttgggcctttgcaccggctgttccctgtgcctcgttggcgcctccccacccccccagtctttggaaggtgcccctcaccatgttgttcaaatcgcataccccacctctgccggcacccccattttgtggttaatgtttccctgccagctccggccagctatacatttcatttatctctctggattattgtctgggtcccttccactagaatgtaagctcctcgaggacagggatgcctctgttttatttattactatattgttagctcctggcatctagtagaggctcaacatgtttttctgttggtgaatggttattggaacagtagtactctacgtttcttatttactctcacttcatgggtgtgtcgggatgcttttggctaccagaaactgactcaagcggtgcagacatagcagcctgtcatgcccagcaacccgagcgggggcagctcgggatgcaaaacagtctgtgtccactgagagatggggtccttcccagcatgtgctctgtgggctcaagactgccttcagcaaaggctggtgcccaagcttggaatacgagctcatcctagcagtgtggctgggcgagtctcagttgagtccccaccccacgccagagcaggagtggtccaggcagccggtgtgtctgccgctcagagtgtggtcagcaagctccagcctgggacgaatgaacaagaatgaccgtgcagacctttcctggccacccaattcctgctcccacctaggctgctgtcttaacagagcctgggatttcagaagggtgggggtgtctggcctgatgctggatgtggcccattctttgaaaatgtcttgttcttgcatttcgtctggactccagacatctctggaggaagatgggctccccttgttccttctctgacttcacctcagacccagtggggatgaggaacaagactcaatgcgtgtgtagggaggactggaggagaccgtggttgtgaagcatttacttagcccagtgtcctgcagagggcaagcactctggatgacagctactgctactaggttttttttccccttaatgtattgatacaatttatgtatcatacatttacctttctattttttttttgagacagagtctcgctctgttaccaggctggagtgcagtgacgcgatcttggctcactgcaacctccgcctcccgggttcaaaggattctccttcctcagcctccccgagtcgctgggattacagacatgtgccaccacacccagctaattcttgtatttttagtagagacagggtttcaccatgttggccaggctggtctcaaactcctgacttcaggtgatcggcccacctcggcctcccaaagtgctgggattacagttgtgagccaccatgcccagccaaatttaccttttttaagtgtacatctagttctgtagttttgattatattcacaaaattgtgcggtcatcactactaattctagaacattttcatcacccccaaaggaatgtacccatttgcagtccctcccagttccttccttccccagctcctgtcaaccattaatctctttttttgtctccatggatgtgcgtgttctggacatttcagataaatggaatcttacagtatgtggtcttctgtgtctggcttcttccacttagcccagtgtttttatggttcttccatgttgtagcatgtctcaatactttgttccttttcatggctgaataatattccattgtatgggtaggtcacattttgtttattccttctgcagttgatggacttctggattgttgccccatttggactatgatgagtaatgctgctgtgaaccatttttaggattttatgcggacatatgtttccattctcttgggtataagaagtggaattgctggatcatatggtcactctgtttaactgtttgaaaaactgccagactgtttcccaagcttctgtaccatttctctattcccaccagcaatgtatgagggttggaattttttccataccctcagcaacacttgttatttttggtctcttttattatagtcatcctggtaggtgtaaagtggtgtctcattgtggttttgatttgcatttccccgatggctaataaggtgcttattggccatttatatgtcttgttttgagaactttctattcaaatcctttgcccatttttaaatagagatatctttttaattgttcagttgttgatagtgttttatatatttcggatactagacgcttctcatgatttgcaaatatttcccccattctgtgggttgtctttatgttttctttatagtgctctttgaagcaaaacattttaaattttgatgatgcccaattctatttttccttgggttgcttttgcttttagtgtcctgtctaagaagccattgcctaatgcacggtcatgaaggttcacatctatgttttcttttaaagttttgtagttctagctgttataatgagatcatgatcagttttgaattaattttgtatacgatgtgaagtagggttccatcttcattcttttgcatgtgaatatccagttgtccaagcaccatttgttgaaacgaatattctttccgccccttgaattgtcttggcacccttgtagaaaatcagttgagcatagatgcacaagtttatttccagattctctgttctattccattgatctgtatgtctgtccttaggctggtaccacattgcctcaattactgtagctttgtagtaagtttcgtattgaggaagtgtgagtcctccaactttgtttttctttttccagatattttagtggtcctgagtctcttgcattttcataggaattttaggaccagcttgtcatttcctgcaaagaaaaagctgtagttttgatggctatcatattgagtctatagatcaatttgggagtattgcccacttaacaatattaaatctcctattaatgagccttgtgtgtctttccatttattgaagtcttctttaatttctttcaatggtattttgcagttttcagtgtttaagtcttacacttattttttaaatttatttctttttgatgcttttataaatggaattgttttcttaatttcatgtttggattgttcattgctggggtatagaaatacagttgaggccaggcatggtagctcacacctgtaatcccagcactttgggaggctgaggcgggacaatcacttgagccaaggagtttgagacaagtctgggcaacatagtgagacccccatctctaccaattagttgggtatggtggtgcagttactcagaaggctgagcggggaagatcccttgagcctgggagtttgaggctacagtgagctgtgatcgtgccactgcactctagcttaggcaactgagtgagaccctgtctaaaatacacatacataattttctctttttttgatatggagtttcgctcttgttgcccaggctggaatgcaatggcgcgatcttggctcacgtcaacctccacctcctgcattcaagcgattctcctgcctcggcctcctgagtagctgggattacaggcgtgcaccaccacgcctggctaattttgtatttttagtagagacgggttttctccatgttgatcaggctggtcttgaactcccaacctcaggtgatccgcctgctttggcctcccaaagtgctgggattacaggcgtgagccaccatgccagacccataaatataatttttaaaaattaaaaaagtacagttgcttatcatatattgatcttgtatcctgcaaccttgctaaactcatttattagctctaatagttttggaggttttttaaatatgtgcattccttgggattttctatgtataagatcctattatctgcaagtagagatggtttcacttcttcccttccactctgtatgctgtttcatttttcttgcctaatggccgtggctagaacctccagtacagtgttaaatagaagtggcaagagcagacctccttatcttgttcctggtcttaggggaagtgtctagtctttcactggggagtctgggtttttctagaaggttgaagaagctcccttattttcctagtttgtggagtgttcttgccatgaaagggttttagattttttcaaatgctttttctgcatccattgagatgatcatgtggtttttgtcctctattgatatggtgtattgccttggttgattctgtgtgttgacactgctattgttatgaggtttgccacagagcagagtagcatgctgtcaggaaccccctgagccagggagctccatgggcactttttctgcgagggaggctgtagtcaacagcaggggcctgggagtcagatggtctgggtatgacctcctggctgtaccactggctcaccatggaactctatgcagggaaatgccacctctgtgccctagtttcctcatctgtaaaattctcaggggacaggagtgcttccttgtggggttcttatgagggtaaatgagttactgtgtaactacgttgaacagtttctggcatggaacacatgcagtgttttgagacattggctactggccactagtgacattatgtaaaagcttggatgggccagggtggggagggacagttgaggagggcattgaaatctgaaagccaagctgattcacctgctctaaaaactccggggggccacagggagtctggaagctcttccaggaggtggcctgtttgaccccagcagcctccaaatcttcctgtgggaggaggggccaagggtggagcccaggctggtgagcgcccgtccgaagcctgcctatggcagaaccctccagtttaaattcaggcctgagcaccatatcctttgggactgggttgcaggggcggtgtgtttgcagcgaggaggcttttgctcagactgcttcctcccttgacagccatggagggcctgccagccctcacagcattcccgccctgcctggggccttgtttggaaaatggctttcagctgagcaccagctcccctccctccccaccctgactttcctgacttcccctctcctgtgctgccaggtgagcctggctccttgtcctggctctgccgttgaccactgtatgaccttggggcctgtttctggacactgtcagggaccgcttgggattgaacaggcctctgtgcagagggcctgcaacactgtctgccaggggctcaggaaacactggctccagaccaccctcccagtgccccagagaaactgcaaccccccaaatctttctgtttggagtttagactgtgagggtaggagtcggggaacgggggaatgaggatgaggagggagataaaagcaattttatatgccctgtgtaattcttggcatttgtttttatgacataaatgaggctggatctaccttgatttaatgtcctgacctcctagccagccaagtagctagcagctcgagacagtctgctttgctctgtttacttttggtttggtttccaagcctgtgggtggcagaccgcccccgccccgctcacactcagcctttcctggcccctgtgccctgaagtacagggtggtcccacctttgtggtcttatcagggaagggggacaatgacaagaaacaataataacaaaccagtaatttcatcatcagcagagagattccaaatacattttgttatcccacaaaaaatcagtttacccctgctcggtgccaggcacgagtcaggatgaacagaacaggtcagcttttgagggttttaggaagttggactcactcttagaatccactgggtgggcctggagaggggcccaggaatgccaagctgtgaagggcgaggaggaattggcagggggaccaggcgcggcctgggctggagcatgcagcagagatgcagtgagcgtggtggggaggccacctctggagctccacacaatgccctcaattatgttaagtagtctgcaggtgaggggtcaggcagtgtccatgtggaaacagttgtgtcaccaccagctagttctttaatctctctgaccccagtttcctcctcatgggattattttgcaaactgtggaggtgatgccggcaaagccctcggtacagcgccagacgcatgctaagagctatattgtcactgcgattattattaagccagtgtatcacatggtgggaaagtctttattgaaccagaaaaaatggtcatggcttatgaagttaggattcaggttacaaaatttgtacagctctctgcgtgtaaatgtacgcgtgggtaaaagtccacagtggtggggtagtagttgtaatgtcttgtcaatatgtacattttttacttttctgtactcttcggattttacacagtgatcatacacgagttttgtaattacagaaatgttattagacaatgtaacggcagggctgtggttattgttcacacacacgagcacatgggactgcagaggttggggacggtcagatccaggagcgtgggggcactgaaggcccctggggtggggcgggctgtcacaggacgtgcacctggggcggctgcccaggagctgtgctgaccaggcctcccttctgccctagacgacaggatctgctcgccacccttcatggagctcacgagcctgtgcggggatgacaccatgcggctgctggagaagaacggcttgactttcccattcagtgcgtaccatcccagctccacctgagggcaggcgctgtagaccgcaggccagcataggggaggggctgggtttatagtgccctctggatttaagctcacccgaggatggatgagcacatggccctgggtcccacctccacccacaccatagaaacgggtcctggtaggggacacaggtcaacgtgctctcctgcctggcctgggggtgtctacccacacgtcaccctcagtgcagataccaggtgtccagagtctgtgtctcagctagagttcctttctagacgtgccaagtacctgccttgtgggtgaacggcctcactaatttctctctgcttttctctccccaacccatagtttgcaaaaccagagtggctcatggcaccaactctcacgaggtgagtggaagaagatctgactgttgtccctgacccccatcctttcagctcatcgtgtctcactgctaccctgccggattcctcactgccactgctcctgccctgctgttagtcctggctccttggtagatagcctccttcccttccctggactccagaggaatcgagcgggagtgctgtggcttcatgcactgtctgcaacctcacctcaatgcctgtcctgtccctaaggcaggaggatgtgctggggacccacctgtcctctgtggagcctgtcgtagctgtggcagccataacaaaccccaggcactgggtggcttcgccacatttattttctcacagccccggaggctaaaagtcccaggtcaaggtgccagcagggtcagtttctggtgagggctctcttcctaccttgcaaatggccaccttctcactgtgtcctcacacggcctcttgtgtgtgtgaatggggaggggcagaaagcaagagcaagctctctgatttcttctgataggggcactaatcccatcttgagggccctgccctcaagacctcccaaaggccccacctccagataccaccacagtggggcatgggcttcagcgtaggaattctggggcacacgttcagtccataggggagcttgtgcgagtcatgcctcagtccggcccgccctgcagggctggctatcctttgggccatcagtgtcatctcttcgagggcctgttttgtggcaggcaccgggctgggcccacatgagggctgttagctctgacaaggctctgtcactgccacaggggtctgccatgctgctgaattgagacgggccagggaggaaaagagggctgcttagaatcaaccctgtggaatgctttgaatcatgagtcacccacccgcccattcattcttttattcactctatgatgttcccggccaccttgaggaccatggagaccaggagacagatgcataggatgtgagtcctgtccctagagagagccaaggagcctgtgaggactccaggggctagaggagtggatggtcatgcaggggcttcgctggggccagggcccgtaccaccctcaggagccacacctggggccttgtctttgccctggacacagcactgcctggggtctccccagtgggcacatgttggggtatgctgggcaacaggcatctgaccggagtgggctctctggggaaggcttgtccttggaaagccccaccaacagaaatgctccccagagctcacgactaaaaggggaagatgcagcagcatgggcctttcctgggttatgtactgctctttatccctggcctgcacttccggggaagtatcagcagacagtgtcagcgtagcgcagcacatgctgtgatgggaaggagtgtggagacagcccgccgtcccgttgtcagttgtctgaaatcaggagccctcacgtagtcttcctgtgggtgttggccctcctgccgcagcctacctgggctctgtgcctggtgctggcagcaccctccaggatgtaccaggccagggagggagcaggaaggctcgagagcagcagcgttggtccccaggcccccctcagccccagtatctgcctgcccgccttccaccagcccctttaaccacccagtggttcctctgtgtgtgagttgcttgggtgttcccagatggaagcacgagcgtagttattaacgtgagtagatccgcctaactcagaacctggcagcccgggaggagggagccacttctgcgagtcactcaaggcctgagggccggggctgtggaatcccagagacctgggactgattctggtgccgtgtgttgccatttgtgcgactttggcaaattacccagccacccagagtatcacatttgtgactggagacgttagcggcttctgtgaaggatgaggggtcactgccagggttgcctgggtggactgttggatgagctgccggaaccagctgccctggtacttgcccggtacttgctgaaggggatgggggttctggatccaggtgcacccctctcaggatgcccctgatgggcctcgggactctcagccctcaagtatggggtcagcacgctcaggggaagctataaatcactcctcattctagccgcctggctccaggatgtttgtacaggtgcccctccctctactccccagccggctgtctgggtccactgccggcaaggtgtgccaccacgtcccatgtactcagagaccccagcggactctctgtgcagacggggcatgttagcattgcagggacgtgccctctggggtggacactgtccaccagatcggcagaggttgggggacaagcttctcacagattccaggggtacccggggaagccaagtacagcaggggcagaaaatagcactgtgcatggctggctttagatagggcagcaggtgcttctgatcgggagtcctcgtctgcatcccagcccgcgcactcccggcctctgaatctcccagcccgagactcaaccaaaaccaggaccatttctgctaaaccactctgtcttcattttatgttctcagaactcttttatttgggtttttgttttgtttttgagccagtgtgagggtactcatttgctccacagtggaatctttttttttttttaagctataacttagccaaaagctcaaagcatccctgaagccacccatgattttgcagaggaagacagtggcgcttaagcagggtgggggcccagcctcggctcacacagcaagtgctcagcaggcattccagcccctgcctgactccagagctgctcgtgtttttcctgtcctttattcttgtcagaaggctgaggagatgttcactgccccccaacgcccccagcacagacacacactttttgtttttcccatgtggcctggatttccacgtctgtcctgcccagctgagctccaggcacgtagggccggcgctccgtgacagctgacacaaggggtggcagctggggaggcagccagctctccggggcccattatccctgctcagcagccccagccgtctggtggctccttcctggggccctgcgggctgagggattagccatgaccctggcaccagcagctggatcggctaggcctagggcccacccctctgtccttagagcagaccctgtgcagagcccgtgctggccggggctgagagggttttggcagctgcccccctgcactccctaccccagcccctaccagatcctcctgtcagggacctttttccccagaggagtcggggaccaggagcacaaaggcctgttgtttgcggagtatcacatggctccgtgtgtaggggcgcggctgggtgctgtgcagacccagttccatcccgggctcactcactgtccagcagtcactgaacctctcagcgcctcatcgtcctcatctgtgaaaggttgtatgctcacctcagatgtgcattgtgagggagacactaggtaactggtgtacgtgctcagaacagggcccggcttgtcacaactgcttgacaagaggcagccgttgtcatcagacaggctttgacccaaggcctcctgactcctgcgcccgagtcatctgcttccttcctcctcccgggtctttgtggaggatcctttaggatgtcagagggttgagcagcacacaacctcagcggcccccttccctggaccacagtgcgacaagtggtgtcacgctctcagaagttgtgcagtgcacagccagctcgatctcacatggcaggcccggtgaagggaggatctccaaccccgtggcagaagggatgcatccccaggtgttcttcacaagtcccactccactcaccctggctcaaggctcctctaggggagtcctcatgccacaggaccagggatgggccttggtggaggtgctctggacaggtgacacacctgtgtgttggaggctgagaaggtggtggattctgacagagcttttgaccccttgtcttcccagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcaggtaactgctcttctcaccatcttgggctgagcaagactcaggggcccagctgggatgtggcagcagctgtctgtccttcggcactgccccaaccaccctgtgttcttggtgggatggagaggtgctctaaaggtggaaacagttgtgtacggtggataaagaggtcttggggaactagtaaaatgtccctattccctgggtcattgtagggggccccactcacctgaaccaccgtagactccaggatgcatccagaagtgttctgtccccagcatgcttctgggggacccacacaataatgatattcatggaggaatacgctgggacaggtgtggccagcatggcgtggattggccttccagggaagccagggcaggtgctgcctgctgtctcccgctgagccatctttaccttgggtctcattttcccctggggagcctgagacagagttgcctgctgctacctgcatagctgccagggtaaatcagactgtgagaagcagcagctgccgggttacaggtcttcttaggtgcaggactcctaccgtgccagtgagcgtgttttgagtcagtggacggtggtctaggagtcccgtgggtgtcacatagggcgttctctgcatgatgctgttgtcgctgggcctgagaagcagcctcccagggagcagcctgtggaccccactgcgctgaggggccttccttccgccagctgctcaccgccctctccagcctcagccattttaaaaacggacactgagttaaagatttgctggcagtggagctgctcgaaaggatgttctagtggcttctgaaggcatctctaaggcacgttctggaaacctttggaacagtggcagtgtcttgggataagtagctttccaggaggaccctttggagaacactcactgccccgctgtggcttgttcaaatcagctgcacatttctttcagcaaggggaacccacatcatcagaagcgttcagacgccggctgttttacctccagctgagcaaacagatgtgtcctcttggcatccctcctccggggactgcctgtggccatccacatctcctggctggtgtgccgcccggcatggaggggctgcagtgctgcggttgccctctcagcccttcttcccctagatgcctcttctctttccatggacacatgcagagcgtggatactttggaaacgtgcaggtgttcattttcctccgagggcaggtggccttcctagctgggcgtgtggctcccagactcaaggctgtattttcagggtttgggacatcatggtcccagcccctgcccactgggtgggagccaaatgctggaagcatatttttatatgtggctatataccaccaagagatattcctccaagttatgggctggaagaggctgacattttttaaaatgctgtttattccctgatttaagaaaataataatgctttaagtctatggaaaatatattaaattaagaggagttatattttatatcaactcctttctgtttttacccaggtcactccatctctaaaagaaatttactgtcagatctcctttcttatccactgtggttgggtttttctgttttctcctttttccttctggttgcaaaatgctgggccagtttccgtctcgacgctgggaaccattaacagcagagtgtgggctcctatcctgtatctgtgaggacgaggactccttgcctgtgtgtcttcttgtgtggctatttctaggttgccagtttgccataaaatgcataccaggagaccagacgtggtggctcatgcctgtagtcccagttctttgaagagaccaaggtgggaagattgcttgaggccaggaatttgagaccagcctgggcaacatagtgaaactccatccctaccaaaaaaaaaaaaaaattaaaaaattacctgggcatggtggtgtgcacctgcagtcccagctactaaggaggctgaggcaggaggatcgcttgggcccaggagtttaaggttgcagtgagctgtggtcatgccactgcattccagcctgggtgacagtaagaccttgcctcttaaaaaaaaaaaaaaaagcagactaagcccaaatagtagagaaacacacagagctaaaaaggagaaatgtttattctgttcacgtgaactaagtaactgttagtgtgtctctccatccccaaagctgattctgtgtccccatctctagggcactgtgccagggagctaacgtgggtcctctggtttctacgtgtatgttctctttctggataagaagtgtaatgcaacagcagccttttaagctggaccagttggaaagggggtttgggactctggcctctttccggccctcaccccagctttccaatttcctttgcccaatgacatgtcccccaacttcccgtggccacgcagggatgggggttccttgagtgggatttttctggacctgggatagagacagggacatgagtcttcactcgacaactgccagtctcctttgcctgtcagctgcacttttgttttttacgtgttgacatctcaaatcaagtgtgccttatagccagtggcatccatgcagaggctttggctggagctgaagtcaggttgtggcttgtgccatccaccaggaacattttgtgttctctgcctgtggttcgcattcacagagagactgtttccctccctccaccctgtgccagggtagagattagcgggttcctttgctctccctttctatagagtgggtttatttcttgctcgtctttaccctgaggacgcagcgcaggctcccagctttatgcaggttccctccattattctctccagcttgagccttgtttctcttaggcatgcatgagtggtacctctcaccatgtagagcgggaggcagcaaacttttttttgcaaaaggccaaattataaacatttccagctccatcccaattatttaatgctgccgttgtagtgcaaaagcagctgtagatatgtaaatgagtggcacggctgtgttcaaatgaaactttatttacaagtgcaggtggccgggcttacagcctatagtctgctgagctcctctccagagcctcttaatagtcagtgatacagcatttatcaaacctaccatgtgcccagccctgcgtgagctgctggggatccagtcagggactaggcaggcacccagcttcctgccctcatgagcttgtattctggtgggagaaactgcacacaaggagagaaataagaaaagggtcaactgtggcctgagataaggggttctgaggggaagagaatatgtcctgggataccactgggtgaggggagccacttggaaagggcagctcaggatttccctctgcagagatgatactcatggcaactggaagatgacttgggtcaccatctgtagcattaggacacattctccccatccccttcgcctcccaagagagagagaggagatgaaggaaataaggctaaaagcagtgtggcccagctcgtggctgtacggctgagttgctgggatgtttgggggctaatcttatcatttattcttcttttaaacctattttttaaatccataagttgagaagaaaacacacacattcttcctttcattgccctccctccctgtagaacgttggtggtagttctccactggtgctattgggctagtccaggaacagactgcatggggcacccaaaatccagggtgctgtcgtgagtgagggcttgctgatacatgctgggagcaacgccctggtctggtgtgttagaggaaccgactctcttggagctggccaccaggtttctttccctgatgccttctcacttgcctcagctttccatcatctcttgggtgactggcagccacaggaggctgctcctactccctccgacccctgttcagaccgcacatagagaggaactgagcccagaccatctctcactgccctgccaaaagggtcttctggccagagctcccaggtcagaattagccagaagggccaggtgcggtggctcatgcctatatccccagcactttgggaggctgaggcgggcagatcacctgaggtcaggagttcaagaccagcctgaccaacatggcaaaaccccgtctctactgaaaatacaaaaaattagccaggcgtggtggcaggtgcctgtaatcccacctactcaggaggctgaggcaggagaatcacttgaacataggaggcggaggttgcagtgagccgagatcgggccacagcactccagcctgggcaacagagtgagactccatctcaaaaaaataaaaagaaaaacagaattagccaggaggagaaaagagccccttttgaaatgtcctggactccagctcttcctgccaggagaaactgttgtgttgcatgatctgtccaggtgagcagacactggccggcccctctgagtacccagctctggcccttcctggcacccactcagcacccacgtgttctccttgcggctcctgcagacttcccaacctccctgatctttgctgtgtctacctgcgcttggtggcccttcctccccctgggccttctccgccattcggcaactgctattcaggatctacagggaaataggtgggaaggtgccctgagctcagggggctgagccaggctgggctacaggatgagaaggtgggcagcgttcccctcccagctgctcgagctgttccagccgcaagcccacagggcttatgccatccccacagactccctcttcttggctgtcggtgccttgggagtagagatcctgggggccacatgacacatgtcctgcggggtgtttattttccccaggctcctccccaggaccatatttcatggcccccgtctggactggctctggtcagagcagcaggaggactgtcgggcacaccagggcagccaggggcctctgtgccccgctagcgggagggacgccgggtacatctcagcgcctgcctgcttggcttccgcccgaatcactccctcatgcataattgttgcggcgctgtgaagtcctggagctgatgggtcgttggcagccagatcaggtgccccattggcatggcccccagcacgcagcggccctcagccagtgccctcctgtcctcgcacataggcgcctgggtgccaggggtgtgcattgcatcctgggggtgggagccacaatgcctcaccctgcaaggactcaaggaggggctgctggggctggcggcccaggacggtcccgtgccagccttgggggaagtcgtgggatggtgacagacagccttttccagaactcggcctgaggctcatggttctgcaattcttgcatttgcgtgccaatgcttcccagtgcctacaagcgtgtttctgaccaaccgacctgacattttccccaagtgactttggcttactccccaaagacatttctcctgtgggatctacttgcactttcagtattctttggactggtctgcctctgcgggtccccagtgggcctgtacgggccgggtgttgtgggaggcaggcgggagccagacgtgtggggtgagggtatttcagactctctgtgccagcttccgttgccaaagagaaattgtgctgtgtgctttcttggacggatcctgtggaagcctacattctctgatttcctatttttttccctaagtcgctaagaaccaccagaaccctttgtattttaagtgctcacgtgccggtgccagcctgtccctatgtctctagcatgttccccaaaagagagtcccgtgggctgggagcactggcctaaataacaccaagaggctgctttgatgtgggccctctctggccgtgatattcaggtgtttagctgtcccaccgagcccttttcccctacttccctgtatagtgacagcacactttgggaacagggcctcagggaaaaccagatgtgatgctgtgagatggtagcagaggtcagctcattacatcggttacttttatgtgggaggagaaggtgaaccggagccctgatggggcacacatccgtgcccagggctggtgcccagcttgctggagcccagggctctgcagagccgggggccacgtgttgtgtgcctggggtgatgctgccccctggtgtcaggtggcggcagtgtggtccctgcattgaggttctaacgccggctccttcctgtcgctttttcagaccgtgagtccatcttcttcaacagccacaacgtgtcaaagccggagtcgtcatcggtcctgacggaggtgggtccctctgctgggatggcctggcctgaaactgccctcccgtgggcctaggtgtgggctgctgtggccatggggtccttggccaagctctccagcagggtagggtgggaaggacgtttgcctccatgccacaggccccaggaggttccagagccccctgttcctctgcttgcttcgagttttcatgctagcagccattgcagcccggcccagcacagggagaggtgaggggcacactgggcttgcagggacagaccactcactgcaagctgcccacacagaaggtgtgctgacccttctcccagcatgaggaattggaagaactgctctctaatctgccttgttcctgattttcaaaaaggctgtggaggcagcaccatctcagtcctttgtcctgcagtggtcctgaggctggcaggagtgttaccctgcccccagcactatgggtaacgggcgttctggccgttcagtgagtgttgctgtggccagtgtcagcccaggtgccctgcagtgcgggtcgcaatcaggtctcatggcatcagagaggctcagtgatctttgcacgttcacaaggctgttcacacggtgcaaggctggggtttgaccccagatctgtctgactccaaagttggatcttccaggaatttaggacttctgacctcaccagtgattcctgagcacctgaccccaaagaatttaggaaaggctaccctctgctgtttgcccgaagtccagagagccagcggctacttccctaaactcaagagccctctgccagggagcctgctgttctgaggatgcatgtgtgctgctcttctggggggctttgctggtctcttcctccctgtcctgggctggcctctccaacgaaccagcctccactccagtggcagtgctcgtgtccctcggggggctgccccagaacccagatggcctgtctgtctgtctgtcttttgtgtcagggtcctctgaggagccagcagtgtgctgaggattagacagagcacaggcgtgggcaggacctggagggaacatcgccatccctcaggatgttgacacatgtcccctgggaacatatcaggctttgggaacagatttcaacagagcctcagtgcctggctgagaatattatgagatgttctgtgcaagagacggctttcttctaagcttcagaatcctggggcttcttccgtgcatggctttgctctgggggcctcggcagcccatgcaatggaggggatttggcatttgcagactgagtgtcctctcaggggcaaggccagcagccgtgatggcagaaggacccatccagaagtcactgtcttggattatcacttgttgacctcagccttaatctcctcatctgtaaaacgggaaggggtcagcctagagacactgcagggcccttcccttcacctctgaggtctgcagtcacctcctccttccctcagcacatggctgctagtcaggaatctgccaggactgacgatttccaaaaatagaaaagagaaatgcggtcagcaccaccttttccactgggacatcagcccctcctggacgcccgcaggctggcctgacagagccagctctgttcccaggtgcggaaacacgcttgctgctcatccacctgcccctgcccacctggggctcctccagtcctgccttggcctccctgggagtctggtgcaggaagccctcctctggccttaaagcaccccctcccttcccagtgggatgcccctgcggatgggcctagccccaccgaacttggagggccccatacattttttgcttttcgaaattcagtctagggtattagttaagagcacagactctgacgggactgcctggggtccggcccaagctaaggcgagtcgcgtcgcctctctgagccttggtttcttcttcctgccccagaaggattccggagtccagggagttcctgggtgagaagcacccaccgcagttgccaggtgtgcagtatgggcacggtctcggcagccgggtgccgaggcccactggggacccatgaacgccttcccagttcctctgtcacctccttgctttccagaacgtcatcagatcacttgctttgagggccccaggcatcttgtcctaggatggctatttggttttggataaccagacaacttcggaaggatttctgagattctgcaaccaggccgagagcacttttgtaaatggcgtgccatggggcgtgtggcagtgcagcagccaagctcccttgctgctgggcctgtgctgtcagcctgaggcagcagctcctcccgtcgtcggcaccacaatctcacagcgagatgtttttattaccccatttactggggcaagaaaacaaggcccagaagggttctgttatggcttagggtacacagtggagagtgggcagctccaaggtatccaccagggtctctctgactcagtgagggccttgggctgcaggatgagtggctgagctgccccactaggcttagcctctggcccccactggcaagagtgacccaggaggctcagaaaagctaagtggctgggcgcggtggctcatacctttaatcccaacactttgggaggccaaggcgggcagatcgcttgagcccaggagtttgagaccagcctgggaaacgtagtgagatctttaatccctaccaaaacaaaatacaaaaattagcagggcgtagtgttgcttgcctgtagttgcggctactcaggaggctgaggtggtaggttcatttgagcccggaaggtcgaggctgcggtgagttgtgatctcgccattgcactgtagcctgggcaacagagcaaggccctgtctcaaaagaaaaaaaaaaaaagaaagaaaagtgctaagggatgagtgtctcttacagccaggccactcctgccccctagaaagtatttcttccagatacgacaccaaggccttgaggctgtgagcaggggggccctgtgtgtcctgcaaagccggggtgggagatgcgctggtgtaggcctcagagcgtgggtgatatccaggcgtgggtccctcagagcgtgggtgatatccgggtgtgggtccctcggagcgtgggcggcgcccggacttggagcgtgggtggtgcccgggcatgggtccctcggagcgtgggcggcgcccgggcgtgggtccctgctcagcgcttccctccctggaagttcccagtggttacttcagcctcctgtgcttgggtaagggccatttttcttggtgaccagggctctgtccccagccctgtcgatctgctttcacttttttttttttaattcaggtgcacctggcacagcggctcacacctgtaatcccagcattttgggaggccaaggagggaggattacttgaggccaggagtttgagaccagcctgggaaagatagtgagaccctgtccctacaaaaaacaaataaaattagccaggcatggtggcacacgcctgtagtcccagctaccccagaggctgaggcccaggagttcaaggctgcagtgagccgtgattgcaccactacactccagcctgggtgacagagtgaaacattgtctctaaataaaataaaattgaggtaaattcacatacataagattaaccattttaaagcgaataattcagtggcaattagtaccttcacagtgttgtccaatcaccacctctatctggttccaaaacattttcatcactgagaagaaaaccctgggcccaccggcactcactccccatttcccccacctcatgttattggcagccgctgagctcgttgctgtctctgtggcgttacctgtcctagatattccgtagaaatggaatcacacaatatatgagcttttgtgtctgggttcctgcactcagcatgatgtattcagggttcctccgctttgtggcatatgtcagaagttcattcctttttatggctgtacaatattccgtcgtatggatagaccagtttttgtagctgttcatctgtggatgcacgctggggtatgaataacaccacggtgagcgtgggtggacagcatccgtttgagtacacgttctcagctctggggtgtgtaccccggagcagaactgccaggtcagatggttattccatctccagcttttgaacccagcttcacttttgtctttcatggatcagccactcccttcccctttggcccctaagcccacaacccccaaaacttcactatttattgagcacctagtgtgagccctcccttggctgatttagaggagacgggatgcagttcctgccctagaattcagatgaatctcctcccagccgggcacatgctgtccacaccttatcaacataagtctgagatggaggcctgttgcttccttttacagaagagcaaacctgagacagagaggccaagtactgtttccgaagtccacagagctaggagttcactgtcaggtttggaacccacgtctctctgactccagaatccttcccagtgcagtgccccacttccttggaggccttggctgggggcaggctgagcccatgacagtgtgtgcctgtcccaggccagctgcgacaggcacaggacttgagtggcagaggggagtgccgggctgggagggagaacagagcagggtggcctgaccagcacatggaaaccttgaggaaagctgagcttggaccccaggaggcaggcaggagcagcagagcagcctctctggggagcccgcattgtttagggtgtgagttcatttggaaacagcatttttggggaaggaagactggcctgctgggccacagggccctcaccctcacctccttgggggtctctgtgatggcaggcaagtgggggtctgatcagaactcctcacttgtgcccggctctgcgccccagctgctcctagccatgtcccacagctgctggcctcagcacctttgcctcccctgtgtcctccctggggccgctctccttctcccacccctcccaggggcccacatcctcctgcctccaagttccggcttcggtgctctgcaccatgtcttcccgggtccctgacacactctccatctccttcctccctgttaaaaggctttggttttagaggctaaaaaatatgggtccaaattctgccctgtgcttttgagctgtgtgactttagaccagccccaaccctctctgagctccggtttccctgtgtgtaatgtgcagtgctggcactggccttccaggctgtgatgagcccacaggaggtaatgagcctcacacacctcgtgcctggcggccctcagagggcaggacctggccagtggccgccccgtgctcaccacagtaggtctgtctggcttcctggcctgaagcatgccagggcctcgtggcagctggtgtggggggtctgtctgtgtggtgtggcttcgcagctcctcggcccatggcctgacttccttgtgtatgttggcagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggtgagtggcggccaggccacctccactgaccggcctccagagactgtcctcaggtgaccaggcaggtgaggcggggtgactgaggccagaaagccagctttctccctcaccacgaggtccggggaggtgcagccccgagaagcctcagcctcacctgcgcgatgggcttacggggtgtgcgaggagggagggagagctgcacgtccacctggggagcgccaggcacagtggccacagcacgcatgtccctcacctcctctctccacctgcgtcattggtggatcagcccctcccccaggccctcctcgatttaaggagcaggaaggaccttgaagggattacagccccctgcagtttacatgttgggaaactgaggccctagagaggaggaagctgttcaggccccacagcacattggtggcaggccagagactcccaggctcacgttgcctccaccaccctgaactgcagcgccgggcagaggcctggggaggagccctgggctatggagtctgttccctgctgccagctgggccctaggaacccactggcattgagccaggctctgccatgtgcccctcagctctcagtgaggggccctatggggaccgcaggagcagagccccagcacagggcatgaggaacgatggtgtgacatcacagctcgcggtcaccaggctgcgtgcctcgccctggggacaccaaggctcagtggcttgtttacctcccgcagcagctcagagacagagccgcgcttgatgccttggtgcctgccattccccagatgggggtcccccgttcctttctccatcctgacccttgtaaagcatctgctgtggaggtgaagccagccttgctagctgctgaggtgcaaaaacgttcaggaaatgcctcctgccttcagagactgtgcctggcaggtggggactcggggttgtttatcgtggaggtgaggcaggaccttggccccacacactggctgggcactttctgtgtgtgtcacctccgctcgtctgagagcatgcgcaggcgcagtcagcagcaccggccacagcaaggaagccaaggctcagaggagtgtgctggctcctgtcattcagctggtgtttacccagggctgctgtcgcccagggctgctgtgtgtcccagctggtccagatgctgatgcagcttgagctccactgccatgccctgcctggggagagctcacccctgtctggaggaggcggaggacagagcgggcggtcagcgggctcctctgtgaggtggtgacactggagcacaggggcaggtcccaggagaggcaccgtggagccctgtggctacagcaggtgcagctgcggggcaggaaggctggaggacagagtcaggggagctgcgtgtggtgaactgaggacgttggagctctccctgggagtcggggagcagccaccgtgagatctgtgcttgtgaactgaaagggcagacccgtgcgacgatcgtgtttttctccattgcctctgggtgcagtgggggggaaaccatgggtttagctggagctgggatttcatggggttttgctggcaggtatgagggaaccagggcgcaagggacattcaggataatgcaagggacgttcaggataaggaagtgtgggatctaaaccacggagcatgttttgagtggcagaatgaaaaggggacaacgtcagtggctggagggccaggggggcacagggaggcctgttagaagagaagttctggaaggagggaggagacaggagagggtgggaagctttgcacctgagcaaggccagtgcctcccaacacaaaatgtgtagatggtcgcgatctatgggtgcagataagggatggccttgtgagtcagtgtggggcactgtgagccagtgtggacagggagggttcttccagagaagccaagagaagggccacccagatggggtgggactatggctgagcctggcggagactggtgagggagcctggtactgaggagaggcccagggctctggcagggcagagctggttccccgggagatagctcagtgtgtccgccttaccatagagcacccttttggggccaagcagagcagcaggcctgttctcctgcaccccacaggaggcaccttgggccatgggtgtccagcagcacgtgggtgggagaggcctgggagagggcccctccagagaggggctggctctggagtaataaccgcaacagctgcaagcgctgatgacaccgtgagccaggcctgccccgacgcctcacttcgtcctcacgaggcgttgtgcaaagggccgctggaatctctgtgttgctgataagaatgtgaggctgggggttgagtggcttgtccaaagtcacgtggtggagctggatggggcccagactgtcagccccagcctttccacctctcagctccagccatgggttcgaatcttgcctctgcctttacagtctgtgatggcacaagccacctaacgtttaagtctcagtgttcactgcagtgggaaccagtttcccaccctgcagacagaggagatggcttttgcacagtgctggtatggagctggcaccctgccctgcaggttcatgcctcagtccgctccccgagctcctgtttatcctcaggcctccgtggaggcagccgtctctgcaccaccacagaaagcggcctccctgccctgggccactgggcgttgtctggggatgctggaggaggttgctggagaatggctccctgttccctggcgctgacctgatggtggagctcctccactgcatttctccctaggcacccaacagccatgcccgtgcccgggacacctaccctgccctccaggcctagcccagggccgacggacaccccgggtcctatggtgggggacctggcaccatgtggtattcaagacacacacaagaccaagggcgtccttcagatcccactctgcctcttaggagccaccttgagcctcagggtcctcacctgtgaaacgggctgcaggggtgcggtgggctgaggaccgtggcgctcacagcccagtggctgctacttcccgagtgctgtgaacgccatggacgtcatcactgccctccccgtggtggttaacggtcatgcctcctcatctgtaaactggggacagcattatgaagattaggcgagaggatgttgcgggacgctcgcacagtgccagctcgggaggcgccgcttgccggccagaatagccatctttatttccaccgcgggcacctgcatcccctctcagacttgggcttcctcaaaccacagcagttgtttgctgaataagtaagggcatgggcagattcagcagtctcatcttccaggcccctgggcactgtaagaggtggcacagggtgcccccgtctgaaccttcattcccaccctggtggggctgatggttgtaaatgttgtcccagaggacagcccagggtttttgaaaactcccgcccctccaagttggctcaggcaggcagggcgcttgccctgtgtgagtctcttttggagcagtttgctgggagccagcagaatcctcccctgagatccgaaacctgcttggtggctcccgagggctctgccgatgttcgcaactgtgttaggaagcacttgccccaggcaggtaccatggtttctgttctgttcccctctgttaaggggagcatgtgatgctgcgccctggagcttgtctcaggcctggatgttgctagtgatgcccagcatttccgttccttggctgtgatcctcagagaatgggacacagggggcctccctgcaggtattttgtggtgagaaggaagcagactcagttggggcggcagctgctttgtgaagcagacaccactcacatcccagcctctctcagtagtgccacagcagcctccacctgggcggcagccttctcttctcagtttgcagacagggaagctgaggctcagggtggaagcggtctccgggactcagcctgaggccagactcagctgggcctcaggagtatttattactccaagtgtgtggagctggctttggtgctgctacctccagccacgccaacatcccctgcacatgtactggcttttaccatgcaagtggatgggtgggtgagacagtggagctgtgcctgagaggaacagggacaagcaagtttcatcctcagctcaggttcttcagcttctcacaccctggcaacagctgaaggtcgaggagcacgcacctggttgggcgtccaagctttttgactcccctcagccccccttatctgctgagcctcacgttttctctgtaaatgggacgctgacagcacaccctgcctcatcccaggagcccatcggttctgcctcctcctcctcctccctgcatgatgcgtgcccctggctcacgccccttgtgctgtctctctcccacccccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttcacacgtgtttacacatgttgctcaagtttgttatgtcatactcccagtccttaaaagacgtttaataaaacagctttaccttttaaaaataaaatttcaatcccagtctgcctcaggtacgggtgggggtgtgcagcgtgactcctggctgtgttcctgtaccgtttgtggcctccggggtcttgcgcgtccagggcccagataccgagtaactgccatgtggtgtcgtggtggcgtccataggcctccgtggtggggcgggggcggggctgtgggtgtgcagggcagctgcattttccaagagtggagatggaggatggagatttgcttcgtaaaggcctgggagctacatgggaggtagggaggggccagccacacccagggctggggggccggtggactctgcccagtgaagccaggggagtgtcagcaatgaggggcctggacagcgacgcgggacccgcacctgggagcggcagagatggagcccagctcgctaaacgtaccctaagggtgcacgctgaccatctttgatccctggacagtgtccatagagttgtctccccttcggtcacattgtccctggccttggagtttctgcctcagggaaagacccactaaaaccacccgggctctggcggcctcctcttctccagagcatggtggcgctgcctcctgagcagagtcactgagagtgtctgggtccaaggaagggacccacttagcaaaggttgttgtgtggtgctgtgcaggcacggcgcctggagttggccccgccagcatcggggtggcttggggctctggttcctaagcttctgcttctgagttggtcagcacgttggctctgcgccctgcagtgcctgtcttgatggtggtccctggatgtgctgaagggctccaggagcaaggggccagaccacactttggctgagtccttgggtagtttcagagggtcacctgcacagtctgcattgagcaccctggggctgaggccgtgggtcaagttctgcctgacagtgctttgattatatggtgatgtgattctgcaaacataaccccccaactgagtgccagctgctgggtgtccccaccccaagagccaaggggaggccaccctggaactggtgctttgcccttggtgtcatggaggtgtctgggtccacacgtggtgggtgggctgggcctgcagtcacccagcatggccggcgggattggacccagctgcaacctggcaggttccatggggcttcctgtgcctgggcctgcctgtgtctcatgcctgtcaataaaggagaaagcaacctgggaaaaacattcctctctgtacccaggggactgccaagtgtgctttatagaaggctggaagaccgactgaagtaggaagctgtcacatgtttgagccaactgagcaaagcagctgttgcctgccagacagccaccccaagaccaagggagccagcctgtcgtttgtccttctagcctggaagaccagttcttggctcttgggcactcacattggccactggccacaactgctgaatggcttcactaatgtccctggggtctgtatctgccctctcttctattccctagaaactctggccgggcatggcggctcacgcctgtcatcccagcacttagggaggctgaggcaggtggatcacaaggtcaagagatcgacaccatcctggccaacatggtgaaaccccatctctactaaaaatacaaaaattagctggacatggtggtgggcgcctgtagtcccagctacttgggaggctgaggcaggagaattgcttgaactcgggaggcgtaggttgcagtgagccaagatcgcaccactgcactccagcctggcaacagagcaagactcctcaaaaaacaaacaaacaaacaaacaaactctgatcattcacccggtgggatccccggcagctccttctccttcccgagctgtggctcatgggccattggattcagagaccttgagctgggtgctg

SEQ ID NO: 12734 - DNA, 5948 bp, Human
tgcggagaaaaaccttcatggaggtgagatgagtgcccgttttcggtgagaatggcaggatgtgctacacgtagattgggttaactatgttggcccctctctgctactcttctgcttaaaacgtttcacaggttctctatggtactaatgcatatttatcagaattctgttggtagcaaggcacaaaaacctaacttaaaaagctttagcttaaaagtatgtttattggttcatgtggctgaaaattccagcgcatgggactggtttcagctggatccaggagttcaaataatactgccaagattttctctgtctcagggtgaggtctgggcaatctttgtgcctggggtgcaagatttcaggcagcaggtcatgcaagtactgactctgctctagcagggccctgagagacagagcccatgtacacaggcttgccttcttaaatttgcactgtaggcatcttgcctgccttaccctggaccctctttttctcttagctttttttttcatgttcctttctttcttgggtgagttcttctcactcggtgcgcagaagctcaccaaagcaccagacatggttctaccacatcaccagactttttccttatcacctctgcctccctaaaactctttttccatttatttcaggaaagaatgaccccaagacttgggctcattggctcttattagccccacttgagtgtggaagagtcactcaatagaatgtgctccccaaactgtttccttttcctcccgagcacacagctaagcacattccccaggttcctcgcatctaggtctggtcatgtgcacagtgccaggtagggaaatgtaagtaaaaataaagaccatctcctccagacctggacccactccacattcacttcttcactcattgtctgggcatagaacattcagcaggtgacagcgccattagttgaaatgagcctagatccctgagtcaccacttggaggaagccatactgaagaaccacctgatcaggagcgtgcacaatgttttgtttgtttgtttttgtgagggggaaaccagccattgagatttagagactgttacaacagctagtgttactcattctctgtaatccattgagtgtttgcctcttgttgaacccattagtagtatcaaaaatgatgggatgttctgagcagccagccattggtcatgtgctcatctttggagccctgagttaggtagagccctatccccaaccataaaaaagttagagcagaagtaattcccccaaagaaaaccaagatgccattactagaataagggggagaagatgcagcacagacaacaaacgtgacgtgcacaacagccccacacgtccctctcaggctggcctctaatgcagtgcttgaggaacacccagcattttgaggtccttttcaagccatatccctgctctcattcttgctcttcctctccatcttccctcttgctcaccttctcagcccccactctcttaccctccattcaccttctggaaattctgctgatttttaaaacgcggcttggatatcccttccttcctgacgtttcttcacattcaagctaagttttatgttcttctctttctctcatggggccctgtgatttctctttctttgtctttacttcattatttagaaattattaactgtgaaactctcaaagccgggataggcctagtcatcattttgtccccaacacctagcacagtgcttccatctggttgaaatgttcagatgaataaagaaaggaatatagtccaatcatcaaaccgtgggctaaattcatctttgcagtggctatccacaggatagctaaatccacatttccactcctatcattaaggaagtaagaaattttataatcaaaaacaatcagttacatgcatgtttctgaaaccatatgtctattttgcaactcttattgtgttagtaaatctaagggctaacttttgagtaagataaggtcttattaatttatttttttaatctaaaatagatttattgcatttcacgcagtttgaaggccatggaaaggggactagcacagtttttaatgcatttaaaaaataaaagggaggagggcagcaaacacataaagtcctagtgtcctgggtccctgggagaaaagagtgtggcaatgaacccacccactctccatggggaataaatctgtctcttaaatgcaaggaatatttccatggcctctggatgcaaatacacagagctttggggtaagagcaagggatggggagaggaccactagtgaaaacgcagctacacatattgacctaattcaatctgagggtagaacaacatggcaaatcttgggggcagcagctgttccaagggtcaagaaatatcgtacacccacggggagatttgcttctaaaaagaagtggcggtgagaaacaaaacaaaacaaaacaaacaaaaggagaaatatttcttcagccacactcttcaagaaaatgccacaaatatgtgatttaatattttaatttcatagcattggacacacagctcaacatattgaaatattgattccttggagaaaaaaggaaacaaaaaatattgcatctttctgttggagaatctcggcccccaggcatgaggcctagtgcgccattgtcctagcctgcaggaggagctgaggtcggccgggtcctctggggaagaaggctgtgttcatgacctggggctgtacggcaaaaattgtgttgagtgtcctcggccttgccagctccggccctcagccgccagtcacccggggggcctgcccatcagagggctggttgactgactggaaaaacatgggctgggcaggtcctggcccgcaggtatggatacttgctggatctggtagagctgctgtccatctgtgaactggctgaactactgctgtctttgctggacctctgtctgtgtaatcggttgagcgctggtggcaagtgtctggatctgtccctgcagaacgtgggtgcctgatacagactgggctaagcggatacactgcagctggccagccttcagctgcaccgggatctgctggatctctcctgtgttagtgaggatctgctacatcacctgcacggtccatccagtaccactctgggcctactgggcttgaccctgtggctgggcctggacaatctgcacctgctgaccttctccaacctgcgtcgtcacgggcgtggtctggccctgctgaagctgtgcgatgatgatctgcccaggctgcatggtggtcatggagctggcggtggtctggccttgctgctgtccctggacttggacgggcggtgggctgctgagccagcgtgaaatagtattggactggctcagcaggagttacagactgcagcacctcctcctgacactttggaggtttcagttcatctcttagaacaatatcgatgagaaaatccaattgatcaaatttcgtaattgccatggcgacataagtccggcagttgttatcctctgtgtgaatccaggctcgaagagtcaactctgtgataaaaaatctgggctgccctggcaaagagcacaggggcctctgcactgatcatcttcacatcttcatccagtttcataatcttcttaatacgagccagtgggagttcctgcattcagaaatctttcactgctaaattccagatttcttccatgacccgaagccagaaggactttaggctttgctgggcatcactgcggctagtaccaccaaatcctccttctgtggacatttcgacaaacgcctcttcagggagtccaggaagagcaggagccgccctggcgctcctgcggagtcgggcactgcataggctcaggcaccgcggaggtgaggggggaagcgggagtctcggagaacgcagcacgcgcgaagctggcgcataaacgagatggcggccacgccgtttgcacggtctccccttttcccctccccctcccctggcgccccgactcctataattaatttcatgtaagaggtattctgagagcgtagttatatcaaaaacttacctgcgttatttgcgtgtgtgtgtgaaaaatgaagataaagagcatatttaaaagtaaaatctactttgtgggaatagaatttacttttcacttttatttttccttcccttttccaatgtttgggatccgcagaggatgagtgctcaacgtacagcagagaggaggataaagctgtaagcagtgtctcagatttgattgtgatctctctcttaaataatgtcctcattgtctgattgagacagaaactccccacctccctattaaaaattttttttataaaccctgacccagaggtttctgaagcctccattgataacacacaatggcctgttcttctaggatgtttcatggcctttaaggaaggctctgttcgcccgcatgatgaaagggtgagagatgagcaaggagaagccgaggttcacccgcctcgccctggctaggcagaggactgtgggcaagtgcaggaatccataaaggacgagctgggccgagggaagccacgtttgtatctcaaggacaagaaataggcaaaccttcacaggaaatatttcccggcacctttcagcttagaggacagaggaaagaggaggcaagaaggaaaagggaaataaagtcacagaagggggaggaaagggagggaacctaagcaagcaccaccatgagccagagccagtgttcaaggtggctttgccccttttctcgtcgtgggctttccgatgccagtcctctccgccctggcctttggctgaggccatttttcaatggtctagaggtgaagtatcccaagcggatgtgtcgtgctgagctgtatttgcactctctgtcagcttggcctagtgcccacccattgtgaaggccctcactctaatccctgagcctgtgaatgtgtcaccttacatggcacagcggactttaccgatgtgagtaaacttacagtctttcagattagactgggctcatctggattatccagatgagatacaacgtcactggctttgaaactggagggagggaccacaagccaatgggggaatgtgggctgcctctaggggctggaaaaggtcatggattcttcccgcattggacttcagaaaggaaagtagccccgctgaaacctcgattttagcccagtgagacctatgtcagacttctgaccgacagaactataaaataataaatttgtattattttaagccactaaatttatggtcatttgtggcagctatggaaagctgatatattcattaacagatcttcagaagagctagaggccagaggccaaaaaacacttcatagtctgcttggcagctaatagcaggaaacaagcattaaattgtgtgtcctgtgcttctctgcactagtcccactctgcttagttataaagggctgtaatgagaggagggagctgaaaaagaactgaaagtatttaccgacgtggagaggaaggagatgacaaaggtcagcataaatggggctgtctcccatcttttagggcaagtaaaaggctggtgagccatagagttgtgaaaattatattttaaaatcaaagttgggaaagatttcaaagttggattacttttttcaagctctgggattgtaaatatattaaggtgataaaataaaatggtgcatgtgagatctctttgaaaactgtaaaatataagatgtagtgggctagatagttgtctccaaaagagtaagtccgggtcctaattcctagaacatctaaatggacctcatttggaaaaaggggctttgccaaggtgatcacattaaagatcatgagaaaaggtattctgaattacccctaaatgcaatcacatatattttcccaagacagccacagataggagaagaggaggaagcaatgtggccacagaggcagagactggagtgatggagccaaaagc

SEQ ID NO: 12735 - DNA, 80355 bp, Human
agccaccacgcctggcttgttttgtattttatttatgtatttgcttttttagacggagtctcactctgtcgcccaggctggagtgcagtggcgcaatctcggctcactgcaacctccgcctcccgggttcaagcaattctctgcctcagcctcccgagtagctgggattacaggtgcctgccaccacacccggctcatttttctattttcagtagagatggggtttcaccatcttggccaggctagtcttgaactcctgacctggggatccacccgccttggcctcccaaagtgctgggattacaggcatcagccactgtgcccagccgttttgtatttttttagtagagacggggtttcccccatgttggccaggctggtctcgaactcctggactcaagtgatctgcctgcctcggccgcccaacgtgctgggattgcaggtgtgagccaccgcgaccggccgctttctctttctttcgagacaaggtcttgctttgtcacccaggctagagtgcagtggtgctatcatagctcactgagcctagaactcctggtctcaagatacctccgccttattctcctgaatagctgggtttacaggcatgtgccaccgtgcccggcttttttttttttttttttttttttttgagtctcttgctctgtcgcccaggctgcagtgcaggtggtgcaatctcggctcactgcaagctccgcctccagggttcacgccattctcctgcctcagcccccggagtagctggaactatagcgcccgccactacgcccggctaattttttttgtatttttagtagagatggggtttcaccgtgttagccaggatggtctcgatttcctgacctcgtgatctgcccgccttggcctcccaaagtgctgggattacaggcgtgagccaccacgcccggagtttttttttttttttttttaagagggaagtggggtttctctatgttgcccaggctggtcttgaatttctggcctcaagcgatcctcttgcctcggccttccaaagtgctgggattacaggtgtgagccaccacacctggccaattcagtcttaaaccaattttctgaggcttcgttttggcaaggctacttatctgttttaaaaataaacgatgtattttagtaaaagaaaaaaaatggaggaaaaaacagggttttgatctcatggaataattatgaggctaatctaatgagcttcataaaatactatacccatacatagtatgcttgttattttattgttttgtcagggtccagagaactaggccactgtgttgcttaggcaccgtgtctgcacatagttcattccggtgtacattcattcatctttacactagaatgttagtttcaagaactcagtcacctcgtctacactgtcctttaatccccaatacctgcgacagttcctggggcaaaaacaaatgcttgttgaattaaaaagaaaaactgggccgggcgtggtggctcacgcctgtaatcccagcacttcgggaggccgaggcaggcggatcacctgaggtcaggagttcgagaccagcctaacatggtgaaaccccgtctctactaaaaatacaaaaacattagccgggtgtagtggtgggtgcctgtaatcccagctacttgggaggctgaggcaggagaatcgcttgaagccgggaggcggaggttgcagtgagccgagatcacgccattgcaccccaacctgggtaacagagcgacactctgtctcaaaaaaaaaaaaaaattcctgtagaagctcccaagcccaattaaagctcaaggctatcgtccacgtagtgggttccaaatcgctaagttcccaggccagcagggagagcgagccgagcgaaggtcgcctgtgtcaaaggcggggatttgcacagtatttacatggaagcggaggaaaggctgcttagcaaccgggctgaggggacgggctgcactgcgcacgcgtacatgggcggggcatcttgcgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagagtgagtggggccggggaaaggggcagggactggagagcgagtggcgggggagggagggactgggggagcttgaggagcttgaggggcctgtggggccgggcgtcgtcgccttctgccgtggctcgacaggcccgggaggctccgcatgtgggccccgaatccccctcggctgtgagaagccggtgcccctgggggaagcttgaggggttggggctaggttgggaactttggggtctcggagagccgactcgagttcccgctcaggcatattttggtgcaggtgcgtggttcttacattggagtttagggagttgactgtgattcattttattttattttaaatgctggcttgaacctgacactcttttcctgaacattcggcagaaaacgggggagcgcttacagcgtggctccctgccttttcatgatactggtttagtgaccaattgagaggaaagctgggctgtgtgctttattttattttttgggtcaagcagtagtgttttataggaaccactttttaatagtagttttgaagcaaccttttagttaaaagctgttacttcaaagttgggaaatgaggtagtcattctagaaaatgtaacgggtaaaaaattttctttagtgggatttgtggattattgacaatccaagtgcaaccagctagaatgatgtttttaaaattattattactgtacagatataattgtttatggttgtgaaccagaggtgcagtaaaaattcagacctttgctgtgaaaatattatgttaggagtagttataatgttaaatttgcattgtatcctaattgtcaatggtgtacattgcataacatttaaaataattaatctcattcaccctttacaaggcatttttatttttattttattttgttggatattgtttaatgtttacctttttcattaatgcactacaaagctgtagttagaatccaaggtctacaaaagactttacacttttacttacagtgcagactatgatactgcacatattttgtactatattcatttttttcttcccatctgtttgttttgaaaattttcagatgtacaggaaagttgcaagagcagtacattgaatatttataaacccgtccttcacttagctgcaccattttgccttatttttgtgtgctcgctttcgctctggtgttttctctctcccatttatgtatttattttcactggacctttcaagagttagttgtagactactaataattcaccacttctttcagcagttatctgccaagaacaaggacattctcctacatcatcacagtacaaataacacatttagaaaatttaacaatgatacaatactctgatacacagtccatatttcagtttttccatttatcccaataacatgtgttatagttgtttatattttttctatccaatcaagaatcaccaattgtattctgttgtcatatctctttggtctcttttaatatggtgtccctgccttttgtgtctttcatgacaatgatattttcatttttatttggctgtcctctgtaggccaaatgacatttttaaagaatccagcccagtgttttgcagaatatcgctcaatttggatttgtctgattttcgcctcatgattagcttcagcttaaatgtttttaccaggaatatgtgagaggcaacgttgtgtctctgtcagtgtggcccttccagagtgcctgatgtcagttcgttgcagttttgctgaagttagatttgatcatttggtttatttatctaccttctttttctcttagactctttttttttttggacagggtctctctgtgtcaccctggctggagtgcagtggtgcaatcttggctcactgcaacctctgcctcccgggttcaagtgattctcctacctcagcctcccaagtagctgagattacaggtgtgcaccaccacgcccagctaacttgtattttttggtagagacggggtttcaacatgttggccaggctggtctcaaactcctgacgtcaagcgatccacccgcctcagcctcccaaagtgttggaattacagacgcgagccactgtgcctggccttcctcttagactcttcataccccactacctagaggcatcactttcagtaatttactctctatatatatattatatataaatatataaatgtgtatttctccctttttaaaagactaatgttagcactgcatgtgtatacctatatagaaatatgtacatatgctgcctgggcgcagtggctcacacctgtaatgccaacactttgggaggccgaggcgggcagatcacgagttcaggagatcaataccatcccagctaacacggtgaaaccccggctctactaaaaatacaaaaaattagccaggcgtggtggtgggcacctgtagtcccagctactcgggaggctgaggcaggagaatggcgtggacctgggaggcagagcttgcagtgagctgagatcgggccactgtactgcagcctgggcaacaaagcaagagactccgtctcaaaaaaaaagaaaataaatatgtatatatgcgtatatatatataaaatttacatttgtgggccgggtgcagtggctcacgcctgtaatcccagcactttgagaggctgaggtgggtggatcacttgaggtcaggagttcgagaccagcctggtcaacatggtgaaaccccgtctctactaaaaatacaaaaattagtcaggcgtggtggcaggtgcctgtaatcccagctacttgggaggctgaggcaggggaatcgcttgaacctgggaggggggcgttgcagtgagctgagatcgcactactgcactccagcctgggcaacagagcaaaaaaaaaaaaaaaagtatatgtgtgtatacatataaaatttacatttatggggcgggtgcagtggctcacgcctgtaatcccagcacttcgggacgccgaggttggctgatcacttgaggtcaggagttcgagaccagcctggccaatgtggtgaaaccccatctcaaccaaaaaatacaagaaaaaaaaaatcaaaacaaaacaaaatacacaaaaaatgtacatttatgatttacttcttgtaaacttttgtttttaaagtatatttagtattgtttggtatgttcttttagatggtcattttggtagttttcggttacttggtttagtggtgacatctttattctccctttcttccttctaccttaaaatgtactctaagaattattgtaaccttttatccccctggtttacatcctgatcattaaataaatgatttaaaaatagttaacaatggagagaatattccagaactggaaatcacagagacagagttatagaagtagaatgatcaggaaaagtgagtaatggtgaaattggatccatagcttggggtcagagtggggctgggaatgctagattattacaggggtctgtcaggattttctaggtatatttttgtacttgttttctaggtgatgccctgtgtttaggggtgtgttattctgtggagtattcctgtccttctttttatttggcatcgtttgcaacagtagagagcaaagagtgacacagtgcagttgataagagcgtgggctttggaaccgggtgggcatggcagcttcaggcatgttactttttcttatactgcttttcttcattgttccggttatctattgctgcgtaacagatcacttcaattttgtggcttaaaggaacaacagtccttcttgtggttcttcaggttgcctggattcaactaggcaggtcttactggaagtctctcatgcactcagatggtggctggagctgaagtcatcttaaaagtttgttttttattttgagatggagtctcactctgttggccaggctggaatgagtacagtggcacaatcttggctcactgcaacctctgcctcctgggttcaagcgattctcctgtctcagcctcctgagtagctgggattttaggcgcaccaccacacctggctaatttttatattttgagtagagacggggtttcaccatgttgttcaggctggtcaagaactcctgacctcaggtgatccacctgccttggccttccaaaatgctgagattacaggtgtgagccagtgtgcccagcccacattcatctttaaacagggatgataataccaatcacatagcattgtttcaaagattaagtgaaatcatctatataaagctcatagcacagtgtctgatacatgataaattgtgaatgaattattatttgctatttcagcagatggaaggcagggatataaaaagggaaagaatgaaaacatcagtcagatcctgacttggaaaagtttccccttatctagtctagttaaagtaccactcttttttcctgtctgaactttcttttttgtttgagatagagtctgttgcccaggctggagtgctgtggtgtagccacagctcacgacagcctccatctcctgggctcaggcaatcctcccacctcagcctcctgagtagttaggaccacaggcatgtgcctcctcgcccagctaatttttttttttttttggtggagatggggttttgctgtgttgcccagcccaggctttttttttttttttttttttttgagatagagttttgccctgttgcctaggctggagtccaatggcgcgatctcggctcactgcaacctccacctcccgggttcaagtgattcttctgcctcagcttcccaaatagctgggattacaggtgcctgccaacatacctggctaagttttgtatttttagtagagatcgggtttcaccatgctggccaggctggtctcgaactcctgacctcaggcaatctgcccgccttggcctcccaaagtgctgggattatatgcatgagccactgtgcccggctccccggcttaagtttttaattgtttactagagatgggggtctccctatattgcccaggccggtcttgaactcctggattataggcatgagccactgtgcctggtcctgtctcaactttttaatgaattattcaaaacatacctataaaaagagaaaagtggccaggcatggtggctcatgtctgtaaacccagcacttcgagaggctgaggcaagagattgcttaaatccaggagtctgagaccagcctgggcaacatgacgagactctgtctctactaaatttaaaaattggccaagcatggcagtgcatgcctgtggtctcaggtactcgggaggctgagggaggagcattgcttgaacccaggagtttgaggctgtagtgagctgggatcacaccactgctctccagcctggatgtcaaaggaagaccctgtttcaaaaaaataaaacaaaaacccagagaagttacactctgaagacggtaacagtttgctattgtatcagagagaatttttctttttttttttgtaggtagtctcactctgttgcccaggctggagtgcagtggtatgatcttggctcgctgcaacctctgcctccagggttcaagcaattctcatgcatcagcctcccgagtagctgggatttataggtgcaaaccaccacacctggttaatttttgtagttttagtaaagatggggtttcaccatgttggccaggttggtctcgaactcctgacctcaggtgatctgcccgcctcggcctcccaaagtgctgggattacaggcgtgagccactgcgtccggcccagagagaatttttaaaagtatctgttgtaattacaatgaggtttaaactgtctttttttttttccgccatggaaagagtcaagtaatttgtctttcttaaatgctggtgtgtccgcagttggtgggttcttggtctcactgacttcaagaactaaacctcagaccctcacggtgagtgttacagttcttaaaagcagtgtgtctggagtttgttccttctgaagttcagatgtgttgagagtttcttccttctggtgggttcgtggtctcactggcttcaggagtgaagctgcagaccttcgcggtgagtgttatcgctctgaaggcggcgcatctggacttgttcattcctcctggtgggttcgtggtcttgctggcctcaggagagaagctacagacctttgcagtgagtgttgcagctcataaaagcagcctggacccaaagagtgagtagcagcaagatttattttaaagggtgaaagaacaaagcttccacattgtggaaggggactggagcatgttgccactgctggcttgggcagcctgcttttattctcttatctggcaccacccacatcctgctgattggtccattttacagagagccaattggtctgttttacagagagctgattggtccgttttgacagggtgctgattggtgcgtttacaatccctgagctagacacaaaagttctccaagtccccgtgagatcagctagacacagagcactgattggtgcatttgcaaaccttgagctagatacagggtgctgattggtgtgtttacaaactttgagctagatacagagtgctgattggtgtatttacaaaccgtgagctagatacagggtgctgattggtgtgtttacaaactttgagctagacacagagtactgattggtgtatttacaatcccttagctagacataaaggttctgcaagtccccaccagattagctagatacagagtgctgattggtgcatttacaaaccttgagctagacacagagtgctgattggtgtatttacaatcccttagttagacataaaggttctctaagtccccactagactcaggagcccagctggcttcacctagtggatcccacaccagggctgcaggtggagctgcccgccagtcccacaccatgtgcctgcacccctcagcccttgggcagttgatgggactgggcaccctggagcagggggcggtgctcctcggggaggcttgggctgcgcaggagcccacagcgggggttgggaggctcaggcatggcgggatgcaggtctgaagccctgcctcgtgggtagcagctgaggcccagaaagaatttgagcacaggcagggccggtgggccggcactgcagggtatccggtgcaccctcagcagctgctggcccgggtgctaaacccgtcactgcccggggccagcagcaccagctggccgcacctagtgcggggcccgctgagcccacacccacccagaactcatgctggcccgcaagcaccacgtgcagccccggttcccgcctgcacctctccctccacacctcgcggtgcctcttcctccacacctccccgcaagctgagggagccggctctggccccggccagcccagggaggggctcccacagtgcagcggcgagctgaagggctcctcaagcgtggccagagtgggcaccgaggccgaggaggtgccgagagccagcgagggcttcaagggctgccagcacgctatcacctctcactagtattttcatggaatcaaaaaaggtacctcaaataatccttttcatctccttctgtgagcatcaatttttgtttttattttatttgtttatttatttgttattgttattattatttttgagacggagtcttgcagtgtggaccaggctggagtgcagtgacgtaatcttggctcactgtgagctccgcctcctgggttcatgccattctcctgcctcagcctccagagtagctgggactacaggcgcccgccaccacaccctgctaatttttttatacttttagtagagatggggtttcaccgtgttagccaggatggtcttgatctcctgacctcgtgatctgcccaccttggcctcccaaagtgctggtattacaggcgtgagtcaccgtgcccagcctatttattattattttttgagacagagtctcgctgtgttgcccaggctggagtgcagtggtgtgatttcagctcactgcaacctctgcctcctgggttcaaggtattctcccacctcagcctcccaagtagatgggactacaagtgtctgccaccacgcctgggtaatttttgtatttttagtagagacagggtttcaccatattggccaggcttgtctcgatctcctgaccttgtgatccacctgcctcagcctcccaaagtgctgggattacaggtgtgagccattttattttacttatttattattattatttttttagagatgagggtctcaccatgttgcctagactggtctcaaaatcctgggatctggtggtcctcctgtctcggcctcccaatatgttggaattacagctgtgcctggccactttctgtttttataagtagatgcattatctagcaactgtttctcttgaaataaaaacaaaatgaggtaaacttaatactggctttgtgataaatccaaaccatagaaggttttgagttagcctcaggaccttcccctatttgccacagtaaatcctggttaacattgtcttagatggacattcatacattttctatgcatatttttgtgtatatacacacaagttttatatattggtgtgtgtgtatatacatataaatatatggttgttccttacccaaaatcaaatgggattacattaaatatgttgtattgtagcttgtaggatgatgcatctatgaagatgcttgaacatagttttttttttgtaatagatcttgctattttttttttttttttttgagacgtactctcagtctgttgcccaggctggagtgcagtggcgtgattttggctcactgtactctccaccttctgggttcaagcgattctcctgcctcagccttccaggtagctgagattacaggcaggcaccaccacgcctggctaatttttgtatttttagtagagactcggtttcaccatattggccaggctggtcttgaactcctgacctcaggtgatcgacccgtcttggtctcccaaagtgctgggattacaggcatgagccactatgcctagccaggtgttgctatgttgaccaggctggtcatgaactcctgatctgaagtgatcctcccatcttgcactcccaaagtgttaggattacagatgtgagccatcacgcccagtccagaacatagatctttgaataattcttcaagtttattaacagtggacttactgggttaataggtgtaatttcaattttaaaattttaagaatttttgaatagttttgtgttcttttctgttttcacaatgtttagtaattcaggtcataattttcctcactatatcaaataattaattgtgtacagctcctcttcactgaagcttcctgaccttgttttagtaatttggtttgaactgtttaatctctcgaagagaatggaaattagtaagaagctgaaatcttcttcctcgcatactctagttgtagtcagcaattaacctcccccaattcttttcctccctctactggtgaagccccatagctctgatgcctgtcacccaccctgattaagaactttataaacagcacatgaataaaaatgtttggacttgaacgtgacaagttttgcatttcacaaaaagtgaatttgaccttcattttcacttgttaaataaggcttaaattccacttcaacaaacaagccttggtttaataaatgtgcatagaatcttaatacagaggtattcatttatctcccttgttctccctttttcatccagctctgttattttaacccctttgtccttgagtctgtttttctttttgttttggtgcttgtttactctattcccaataatgtggggcatgacgttcatttacagtatcatagctctgttcccttcagagctttgtatcatgctttgtctgcatttcagtgtttcttgtttaattttgaaggcctatgaaaatacgccagatcttgttggagagaacaggaacttttcccaggaattttttcatagaggtggtttcttttttaatccctgcctcttatccttgttttataccccatactttctgcctactagaagagccatgagggaaacaagtgacccctttatctaccaacagacacctccagtgcggcaagttccatttattgctggttgtgatggtttcgagccagcctgggacattggcacacactgaatttgtgtgctgaaaccactttacagttcacagttgacctattttttttaaagcaagtctgcttaatttatctgtgatgaaacacaaattggaattgattgtgtaaattccctcttctcttaaatctgaattccttagtccacagcttgactttgagtgattgacctccaatccctcctttgattttcttttttttttctttttgagacaaggtctctcgctgtctgtcactcaggctggagtacagtggcaccatcatggctcactgcagccttgacttcccgggctcagaggattctcctatctcagcctcccaagtggccggggctacaggcacgcatcacgatgcctggctaattttttttttttttttttttgagacggagtctcgctctatcaccctggctggagtgcagtggcgctatctcggctcactgccagctccgcctcccgggttcatgccattttcctgcctcagcctcccgagtagctgggactacacgtgcccaccaccacgcctggctaattttttgtatttttagtagagacggggtttcaccatgttagccaggatggtgttgatctcctgaccttgtgatccgcccgccttggcctcccaaagtgctgggattacaggcatgagccaccgcacccggcctcacctggctaatttttttgtatttttggtagagacaagatttcaccatgttacccaggctggtctcaaactcctgggatcaggtgatccgcctgcctaagcctcccagagtgctgggattacaggcatgagccaccacacctggccccttcccgtgatctttatgactgtcttcctttaaaaggatattgtagttttaagacagttcattttaagttcatgtttttcgtggcacttagccaacactttcactgatttcttaaaattcttgaaatgttcacctttacacacatttaaagtaatgtgtattcattgcgaacattgagtaatgtagataattataatgaagaaaatttaaatcaccttcagtcccactcagatacattaaaaaaattacatatttatattcagtctttttcttttttttcttttcttttccttttttttttttttttttttttttgtgatggagtttcgctcttgttgcccaggctggagtgcaatggtgctatgatcttggctcaccgcaacctccgcctcctgggttcaagtgattctcctgcctcagcctcccgagtagctgggattacaggcatgcaccaccacacctggctaattttgtatttttagtagagacagggtttctccatgttggtcatgctggtctcgaactcctgacctcaggtgatccgcctgcctcagcctcccaaagtgctgggattacaggcgtgagccaccgcacccagctgtattcagtctttctctgtgcatgtgttgtgtgtatgatcattatcatcctttttttcacttaacatgaaattatggctgaacattttcccatgtcatgaaatattatttgaaagcatcgttatcaatggttacataatatttcagtctgtggctatttcatagtttgttagaacatttccttgatactggatatttaagtttctggcattcttacttttgtgacactgtgaataccatctttgtttatgaagttttttgtttgttcatttgttttttgtttttgagatggaatctagctctgtcacccaggctggagtgcagtggcacaatctccgctcactgcaacctccgcctcccaggttcaagcgattcttatgcctcagccttgctagcagctgggattgcaggtgtgcgccaccctcctggcgaatttttgtatttttagtagagatggggtttcattatgttggccaggctggtttggaacccttgacctcaggtgatctgcccacctcagcctcacaaagtgctgggattacaggcatgagctaccacacccagcctcaatgtggctgttaatgtacagattcactcatatacaaattgaatggttttaatactaaaataatatttaattccccaagctttttttttttcctgttggtttttgtttctctaagtgtaatggcacaagagagaacagattgtggactttctatttaagaggtttatggctttatgaggagaaggtgcatagtggagcatgagcagttctgtaacaggaggacaaggtgcacacagaaggaagaaagacatctgcttgaaagcttcccaggccggtcctggaagattggaatccagagcaccatgtatttggtattacacactatgtactccataattagttgtttttttgttttgttttgttttgttttgttttttgagatggagtcttgctctgttgcccaggctagagtgcagtggtgctatctcggctcactgcaagctccacctcctgggttcacgccattctcctgcctcagcctcctgagtagctgggactacagctgtctgccaccatgcccggctaatttttcacatttttagtagagatggggtttcaccgtgttagccaggatggtctcgatctcctgaccttgtgatccacccgcctcagcctcccaaagtgctaggattacaggcatgagccaccgcacccggcctatgtactccataatttgaccattgatattttctaaacaaaaatgttccatttcctccctccctcttttataaggaaaggacctaaaattaggggtatagggacatactgtaaattctcaagactagggattacgtcttaatgatatttgtgtctacagtgcatggcacagtgtgtggtatatagctggtgctaagaagtctttattattattattgttagtttttttttttttgagacagagttttgctctgttgcccaggcttcagtacagtggcgtgatctcggctcactgcaacctccgcctcccaggttcagacagttcttctgtctcagcctcccaagtagctgggattacaggcacaggccaccatgcctggaaaattttttgtatttttagtagagatggggtttcaccatgttggccaggctggtctcaaactcccgatctgaggtgatctgcccaccttggcctcccaaagtgctgggattacaggtgtgagccaccgcacttggctgcaagcagacctttctaaggagagaagtcccaggcctgctgtgtgagctcttctgcacaatgaagacactgatcttcttgtagagaaatttctgggctttccagtttaattcatttaagagaaggggtaaattttggtggtgttttagcaagcaacagctatcccttgactagtatgaacagggcctggtaggtcagtatgagggtctgcttgagggcagaagatgtttaggctgttgaattttcccacaaagtttcaagtttggaggctcctcaagaaacttgtcaaaattacttaatgaggttttaaactgtacaaattagtggtcagggccagggcctgtattttggtccatttcttttgcagaagcttcttggagatgcaccaaagaatctttattgcctggttttaggatttaatggaatttaattaggtttccagttgtagagaggctctgggacttagttaagctatagttgtcaagcaagttatggcttccggttttttgtcagaagggatatggtaccgtgctctgtcctgaagcctcagcggggctcactcctgccttacattagccagtttctcccagaaggcaagtgagaacaataaagctagcagaatagttctgaaaccctgccttgctgggagctagattagttcctcttttattcagggaaaacttggataaaagggattctaatagcatagtttgaagatcttcggtttggggatctagagcggtgctgggggatgttaactggtgttctctggttgtatctcacacccctctcatataccccacctccatttggagactcatctcatatgcagggaaaggcattgaggaattctgcaaacacattttgccgtatttaactctgtatttcctaaatttatttgcttatggaaccctcttttgtggaatacccattagggttcagggatcctcgtgttttgtagtactcagtttggaaaatgctagtctggagattcagcatcctcaggttgtttttcctggaagtggtaatggagagcagcccttcctggtgcagtaggccacctttcttttgctcataacacagaccagttgtgacacttggctctgtctcaggctgtgacttttaatataccgatttacttatacacaaattgaatggttaatgttccattccccaagccttttttgttcatttttactattttttttgtttgtttgtttctctcttttttttttgagactgagttttgctcttgttgcccaggctggagtgcagtggcgtgatctcggctcaccgcaacctcctcctcttgggttcaagcgattcgcctgcctcagccttcctgagtagctgggattagaggcatgcaccaccacacccggctaattttgtatttttagtagagatggggtttttccatgttggtcaggctggtcttgaactcccgacctcagatgatctgcccacctcggccttccaaagtgctgggattataggcgtgagccaccatacctagtcttttttttttttttctctaagtgtaatgcattttatctcctgcttcttgtaagtttccaggaccaagtaatactcaaacccttcccagagggttttcatttcgaacaaggaagccacctgggaaatagggtggagacctgttttgagaaaccagaagaggatgtctcgttctaaccatggagaaaaagaatctagtctccttgttaggaagactgttgaagaagtgttctttatcctttagttcttattaagagaattgttttagtttcaattgtaaggaccagtaaatctccttacacctcacagtatggagacatattattataactgttgacaaagaaggagcttgagggctgggtgcagtggctcacgcctataatcccagcactttgggagggtgaggcgggtgggaagctgaggcgggtggattacctgaggttaggagttcgagaccagcctggccaacatggtgaaaccccatctctactaaaaatacaaaaattagcttggtatggtggcacacacctgtaatcccagctacttgggaggctgaggcacgagaatctcttgaacttggaagatggaggttgtagtgagccgagatcacttgggcaacacagtgagactctgtctcaaaataaaataaaataaaataaaaataaaaaacaggagcttaaaaataggaaaacccgagagcaggagggaattggccctcttaggaactagaatagtattgaaagcagattgttttgcaccttagcagtagggatttgtagacgtgcatattctgccattaatgagatttctcagtctgtgtttctttgtgattttccctgtatatacttttactgtgtatcatttctgttccttatactctctgcttattcctaactctgttttttttttctgattttattttggagtataacataatacagaaaactgcacaaattggccaagcgcagtggctcgtgcctgtaatcccagcactttgggaggccaagacgggcggatcacttgtgctgaggagtttgagaccagcctgggcaacatggtgaaatcctgtctctacaaaaaatacaaaacaattagctgggcatggtggcgggtgcctgtagtcccagctactcagaaggctgaggtgggatgatcgcttgagcctaggaggtggaggttgcagtgagccgaggttgcaccactgctctccagcctgggcaacggagtgagaccctgtctcaaaacaaaacaaaacaaaacaaagctgcacttacatttaagtatacaagttggtgaagtgaacatgccaatgaaacctgcttccagatcaagaagcagagtgttactggtatcatgggtgtccccttcagcccattctggtcacttcaccccacaagggtaaccactttctgatttccaacaccacagagttgtctgttttaatggagttattgaaatatacatactataacgttcactcatttaaagtatactgctcagtgattttaagtatattttctgagttgtgtaactataactataatctaatgttaaaatattttcatcatccccaaaagaaacctgtaccccaaaagaaataaggagtggttactcctttatcccacattccaccagccctaggcaattacaaatctatttcctgcctctatagatttgcttattctggacatttcatataagtgggatcacataatatgtggcattttgtgcctgatttctttcacttagcataatgtcctcaaggctcatccatgctgtagcatgtatcagtacttcattccttttcatggctgagtaatattccattgtatggatagaccacattttgtttatccgttcatctcctgatggacatttggatgctttccacctttcagatattatgaataatgctactgtgaacattcacttacaggtttttgtttggacatacgtttttgtttctcttaggcatatatgtaggagtggaattgctgggtcatatggtaactctgtttaacatctcaggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtaatcccagctactcgggaggctgaggcaggagaatggcgtgaacccgggaagcggagagcttgcagtgagccgagattgcgccactgcagtccgcagtccggcctgggcgacagagcaagactccgtctcaaaaaaaaaaaaaaaaaaaaaaatctcaaagaactggctaaactgtttttcatagtgtctgcaccattttccattcctgccagcaatgtatgagggtcccaatttctccacatcctcaccaacacttgttattatctatgtttttgattctagtgagtgtgaagtggtatctcatcatagttttaacttgcttttccctaatgactgatgatgttgagcatcatttcatagcttattggtcatttttatgtcttctttggagaaatatctgtcaaatcttttgatcaccttttagttggattgtctttgtattgagttataagacttatttatatattctagatataagtttcttatcagatatatagcgctgccatgctcagctaatttttatatttttagtacgatggggtttcatcatcttggtcaggctggcctggtcttgaactcctgacctcgtgatctgcccgtctcggcctcccaaagtgctgggattacaggcatgtgccactgtgcctggccaagttttgtatttgtagtagagatggagtttcgccatgttggccaggctggtctcgaactcctgacctcaggtaatctgcctgcttcggcttcccaaagtgctgggatgacaggcgtgagccaccacgcccactgaaccctcataaatccatcaccgaatttcagcagtgatcagcattttaccattttccccaccaccatcttttctgggggaggagtatttagtttttgttattttgaaataaaacagtgaaaatcatgctcttatttcaaaaaacaacattgtggaaaatatctaacttagaaaatgagacacctgtaacctcagacagagccagtattaattctgtgtgtgtgtatagtttttaaggacattattattattattattattattattattattatttttgagacggagtctcactttgttgcccaggctggagtggagtggcgcaatctcagcttactgcaacctccacttccctggttgaagtgattctcctgcgtcagcctctcaaatagttgggactacaggcacctgccacccattattttaaatatttacagtatattccgttatacaggtaaaccatattaatccagtttcctatgggggccatttgggttatcagctttactgtattgattaatggtgcaatcattaatcttcctgtcatatgtacttgagcaagttatttttttttcttttagacagggtctccctctgtcgcccaggctagcgtatagtagtgcgatccctactcactgcagcctcaaactcctgggctcaagtggttctcccacttcagcctcctgagtagctgggatgacaggcgtgtgccattgagtctggctaattattttttgtagagacggggtctatgttgcccaacttggccttgaactcctgggctcaagtgatcctcaccttggcctcccaaagtgctgggattacaggcgtgagccactgcgcccggccggaggatgcacatctttttttttttttttttttttttttttgagacggagtctcgctctgtcgcccaggctggagtgcagtggcgcgatctcggctcactgcaggctccgcctcctgggttcacgccattctcctgcctcagcctcccgagtagctgggactacaggcacccgccaccacgcccggctaattttttgtatttttagtagagacggggtttcaccgtgttagccaggatggtctcgatcttctgacctcgtgatccgcccgcctcggcctcccaaagtgctgggattacaggcgtgagccaccgcgcccggcccggatgcacatcttaaagatttaatagctgctgccaaattgccctccaaagagactatgccagtttataatttcagcagtagtgaatgggaatgtacaggggtattgtattttattttattttttgagacagagttttgctcttgtcccccaagctggagtgcagtggtgcgatcttggctcactgcaacctctgccttccgggtttgagcaattcttctacctcagcctcccaagtagctgggattacaggtgcgcaccatcacatccagctaatttttgtatttttagtagagacgtggtttcaccatgttgtccagactggtctcgaactcctggcctcaagtgatccaccgacctgggtctcccaaagtgctgggattacaggtgtgagccggccagggatattttaaagtaaattccaattattgtatcattttcacctggaaatacttctgtatttcttgctaacagataaggacattttttgtgttttgacataaccgttatcacttctgaaaaatgagtacctttttaccgatggtttgttcaaatcagaattcagacaaggcatttgaaatgtgcatgtggaaaggaatactgaagaggatgcccaccttcagcgctgcagttttgaaaacctgtgaattgggtgcagtggctcatgctagccacttgggaggctgaggtagaagtttaggcttgagcccaggagtttgaggccagcctgggcaacatagcaagaccccatctgctttgtgcaggtgcaggtttggggcctgaagtgaaggcctcttttactctaggcttgtttctgccacaatctaagtgatgtttaaagatttctggtctgtttgcttctggtcagttccacacccaaggttctcttctagatctagttctcaagcctgcattttctttttttttttttttttttgagatggcatctcactctgtagcccaggctggagtgcagtagtgtgatcttggctcactgcaacttccacctcctgggttcgagggattctcctgccccaccctcccaagtggccgggactacaggtgcatgccaccacgcctggctaattttttgtatttttagtagagacagggttttggcatgttggccaggctggtctggaactcctgacctcaggtgggtgatctgcctgcctcggcctcctaaagtgcagggattacaggcgtgagccaccgcgcctggccccaagcctgccttatttctttgtggcctcgctcatatgcctctgggtctcaatttgtaggagcttccttgaagctttctgaaacaaatgcccagagattgtaacagccttcctgtgatctctgccgcaaagatgagccatttgttcaatggagaaggctcacagaccgttctctgccaatgttgttgcagtcttactctcctattatttgggctgtagaaacttttacaactggtgagacttttgctctctagattttacttattccttccatttctgcttgaaaagtggtatagccattcttgcctgtacttatctttgtcttgaaatagcttgttaaggcagtcagtagtaattagcgtactccatcattctgactcttcccaccactttccttaggccagcaggctcagcggacactgggtccatgaaaggcagcagtgagtgcaggcattcctttaagtgggcgatatttcatcatgatatgccaggctctctagcattttgccacctgaccaataagccaaactaacatattttagacttttgttcacagcagcaccccacatcaaggtgctcatttgttgtcagtcagggtttggtcaggaaaatggaaactaccctaggtatcaagcaggaaggcatttaacatagtgatctagaggcttccaaaaccattatcagggctggggtgatgtggtggcagcacacccagggaaagttgctgttagctttcagaaaattaggaagtgcaagaattgtaggaaactgttgcggatcagctgggccctctataggaccagggaaggtcaatttcaggagggtccttagaggctgctgctgcaatatgacatcagcccagagcctaagctcatgcccatgcccacccctgctggaagaatcccacgtctgctgctcctctatcttctgaatcttgtagggtagctgagcctctcctcactggccaggatccaggtaaggtggttcctgctatacaagggagggcacagactggaaggaaatgatgctttgttccagcttcccctaaagttgaggggaccactaaatcttacaaagataggagaaacaattctcagtatattgctgtttaaattatcttatagattaaaagtttgctgtctggaagtgaatacaagtgtatgcataaataacattttatttttgtaatcatttttatttatagactataaagcaattggcaaaataggagagggaacgttttctgaagttatgaagatgcaaagcctgagagatggaaactactatgcatgtaaacaaatgaagcagcgctttgaaaggtaggctacagagatgcacttgggaccaaacacagatccaagtttcagtcaataacggcaacttaatattaggggggagctttattaatttaataatatgtaagatacaatcagatttctttgggcagtgagggttatatgctaatgttatgtttatcatactggagtttactcatatccaggcttactgtaatatcagtgatgaatgaccacaaaaaagtttaagtttcaaaagtgtgtctcaccttaaacagtctgtatgttcctaaaagttataaatgtgttggatttcttttttttttaattaaaaaaaacagcaaaaaaatgatatatcaaccaatggaacaggatagagagctcggaagtgaaccctttatgatccatttgattttatgatccattgatttttttttttttttttttggagacagagtctcactctgtctcccaggctggagtgcagtggcacaatcttgactcattgcaacctccgccaccccagttcaagcgattctcgtgacttagcctcctagtagctgcaactgcaggcatgtgccaccaagcccggctaattattattttttttaagtatagatcaggtttcaccacgttggccaggctggtcttgaactccttggcctcaagtgatccgcccgccttggccttccaaagtgctgggattacaggtgtgagccactgtgcctagcccattgattttgtttgtttttgtgttttgttttgtttgagacagggtctcactctgtcatccaggctggagtgcaatggctcgatcttggctcactgcagcctccacctcccaggcttaagtgatcttcccacctcagtctcctgagtagctgggaccacaggagcacaccacacgcctggctaatttttgtattttttatagagacggggcttcaccacgttgcccgtgctggtcttgaactcctgacctcaaggtatctgcctgccttagcctcacaaagggctgggattacaggcatgagccactgtgcctggctgtgtgttggacttctataaatgcaaccttagtctaaatgtattagaggtccttgcaatttaactaactgtgaataaattaatatattaatattatattaatataacataagtgacaggcatgagccaccatgcccaacctgagccatcacgctcagcctgagccactacacccagccttcattttttaattaattagttaacttttaaaatggagatgggatttcactgtgttgcccaagctgaccatgaactcccgggctcaagtgatccttctgcctcagcctcccaaagtgctggaattataggtgtgagccaccacacctggccaagaacagtaatttcatcctcatgacatctggatagggtagttatccttgtttcatatatgaggataggtgcttagagatgtgaggtaatttgacattttttctagattactgggtgggcagagccagatgtgaacccagattctgctaaggcaaatccttgttcttcactgcccaatgcatatggtagtttacctaccactaggaagactgaagccaccaggtgttctgctccttctcttctagcacttcttcctctctatgcattctgcattctctgtgtttctttatctttccccgactccatctttacttgtaaaccactgatgagagaggatttgatgcacagtatactgattatcccgtatctaaagagcagacagctgggtgctgtggctcacacctgaaattccagctacttgggaggctgaggcaggaggattgctagagcacaggagttcaagatcagcctgggcaacatagcaagaccccatctctacaaaaattaaaaaaaaaacacaaaaaaacagacttccttaaacagccacctttgacccaaagttgccagtacaggattttgaacagtagggtgtgatgcttttttttttcttttttttttttttttttgagtcagggtctcattctgttgcccaggctagagtgcagtggtgtgatctcagctcactacaacctctgcttccagggctcaagcgattatccagcctcagcctcatgagtaacagggactacaggtgcaagccaccaaatgcctagataatttttgtaatttttttttttttttgagacagagtctcgcattgtcacctaggctggagagcagtggcgtgatcttggctcactgcaacctctgcctcccaggttcaagcaattctcctgcctcagcctcccgagtatctgggactacaggcgtgcgtcacagcactcggctaatttttgtatttttagtagagatggggtttcaccatgttggccaggctggtctcagactcctgacctcaagtgatctgcccaccttggcctcccaaagtgcagggattacaggtgtgagccaccatgcccagcctaatttttgtatttttgtagagacagggtctcgccatattgcggctggtctcgaactcctgagctcaaagcgatccacttgccttggcctcccaaagtgctaggattacagtcctgggtccagcctctatcagataagtttagaatgttctaaggagcagttctctagcgggtgaagaacgctcagtttattgaagttctttctcatgcctcctcagcccctgggaagattgtgtggttacgtaacggacatggtttcccggtgatgaagcacatcctgggtctgccatctgccagattcctcacacaccaaaagtgcctggtccaccagaatcttggcttccttgtcatagtgcttgacgactaagcaaaggaatgaacagaaagctaacaaggtgggacacatggcaaatgtgcagtggatgctggccttccttactgtatgcagaatcattcgttgtatttcagaaacaatttatgttctttgcctttaacttcaaaagcagttgattagaacacatcccacaggttggcccagcatggtggctcatgccttgtaatcccagcacgttggaaggcctaggtgggagaattgcttgagcccaggagtttgagaccagcccaggcaacaaagagaaactctgcctccatgaaaaaattttaaaaatcagccgggcgcggtagtgtgtgcctgtggtcccatctacttgggaggctgaagtgggaggatctcttgaatccaggaaggtgatgctgcaatgagttgtgcttgtgccactgaactccagcctgggtgacagagtgagaccctgtctcactctgccttctttgacaaggaagccgaaattccgctggaccaggcacttttggtatgcgagggatttggcagaaagcagatccaggatgtacctcaccaccaggaaaccatgtccgttaggtaaccgcacacacgcaaaaatccgtttctgcttgcttatcattgtgtaagtgaatccccagagtcaccttgcacagttgtgtgggtggtgtgaggaatgtgaagcattagtagcagaaagtcatactgagtcacttgggcagcatgaggttggtatttggagcctctgacccctaccccctccagtattacttctgctcctttcctatgctttaattcaaatagaaacggatggcttttgcagtaatcttagttaatatgaagttaaagaaaggtaaaaaaatacacataatggattagtactgtggcagggagggcactttcactcctgagcattgtttgccttttgagtcactcaaggacttagttagggataaggaagttagttacttgcctgaggcctcaacagaactgagtcgttttgtatcttttctggtatatcctcagaattttcctccaccaatacttgccaaaagtacacaattaagaataggctctctttgggcacagtgggtctcacacctataatcccagcactttgggaggccaaggtgggcagatcagttgagcctggaagttaaagaccagcctgggcaacatggcaaaacccccgctctaccaaaaaaagaaataaaaaagttagctgggcatagtggtggtgcctgtagtcctagctactcaggagggtgaagtggggggattgcttgagtcctggaggttgcggttgaggttgcagtgagccatgattgtgccactgcactccagcctgggtgacagagcaagaccctgtctcaaacaacaacaacaacaacaacaacaacggttctcttgctatgcttttagtctatatttttcctatagaaatagaagaaatggagtgagtctcttaaaaaaaatccctagtcttggtatttgtaggatctccctttgtgccccgaggcagtgacattggcacaagtctgctaaacccggggttcagtgtagggttaccagctctgactctaaaggtcggaaccagcagctcctccattttagttcatgcaatcttggacaattccctaatttctccgtgcctctgtttctttctttatacaatggggataaccacagtatctaccccataagattgttgtgagggtcaaattaaataatgcagatgaagcacttagtgcagtgctggcacaccgtaataaagcaacttgctatgtaaatcagtttttccataacagataatacaagttagcagagcttgaagactattttggagatggacgtgagataataatagtaagattaccgcagttgttcactacatatctggtgtcatgaacagtactaggtgaattatatgcatgtgtcattgaatcctcactgcggccctgggaggaagatccattgttacatctttcagactagggaattgaaattcggagagatcaagttccccacctggcccgttgctacccaacctacacgtcgtggagctgactctgagcccaggtctgtataggtcctgagctggtgatcttcccaccgttcttcccagctgcagatgctgatgccaacgtcaggtctacatgtggtacatggtttttctcaagtcacacctctaagcagtcctcaaattacttttacaaaaacaaaaagtctgctgtgtaaggttataaatagaaacaaaggcaaggaatttattagtctctctaaaagcctttttttttttttttacttaaaagtataatatgaaaaacctcaagcatatacaaaatgaacagcagccctaggtatccagcagccagaatcaacatccctgctatttttatttaatctatacctccacccagtgtccttcctctacttgggctgctataacaaattatactgtattctgtctggcttaaacagcagacatttatttcttacagttctggagggtgataagtgcaagattaagatgctggcagacaggtctggtatctggcgagggcttgctttaggatttgcaggtggccctcttcttgctttgtcctcaaatgacagatagcagagagagagagagaggtcgcatgttctctagagtctttctggcatttcttcttagagccactaatgccatgtgctctaattacctctcaaaagccccacctcctcatatcatcccattgggggtttagggtttcaacgtatgaattttagaggacacaaacatgcaatctataacgttatacagttttttaaagtcaaaatttgtatatcttgaagtgcacattgtttatctgtacaattttggcaaatggatattctcgtgtaatcaagatgtagaacattactataaccctagaaagttcttcttgttccttttcagtttcccactgccatcccaggcaatcactagtatgtgctcttgtgtccacctcctttaactcagcatcatgtctttgagattcatcattactgttgttcagtagtttatctctttttttttttttttgagacggagtcttgctctgttgcccagcctggagtgcagtggcacaatctcagctcactgcaacctctgcctcccaggttcaagcagttctcctgcctcagcctcccaagtagctgggactacaggcctgtgccaccacacccagctaattgttatatttttagtagtgacggggtttcactggacaggctcgtcttgaactcctgacctcaggtgatccacccgcttcagcctcccaaagtgctgggattataggtgtgagcaactgcacctggccagtttatgcctctttaatgctgagcaacattcattacaatctgtgagtacaacacaatttctttatccattttcctgttaatggactttttgatagtttccagttttgggctaccatgaataaagctgcttatgaaattcgacttcttaggctgggtgtggtggcttgcttctgtaatcccagcactttgggaggctgaggcgtgaggattgcttgagcccaggaatttgagaccaggctggatgacatatagcctggtctgtatgtcgtatgaagaaagacttttagtatctttttttttcctctacaaaaaaaaaaaaaaaaaaagaccagggcatagtggctcactcctgtagtcctagctacttgagaggctgtgatgggagcgttgctgagcctaggaagttgaggctgcaatgagccatgatcacaccactgcactccagcctaggtgacagagcaagaccctgtctcagaaaaacaacaaaagaaatacagaaattctactggtgcatatttcattttttctttttctttttttttttttttgagacggagtttcgctcttgttgcccaggctggagggcactggcatgatctcagctcaccacaacctccgcctcctgggttcaagtgattctcctgcctcagcctccagagtagctgggattacaggcatgcaccatcacacccggctaattttttgtatgttttcattttttcttaggcagttacctagaaacagaatcactgggtcaaagggtaggtatatgtttaactttataagaaactgacaagccttttctcaaagtgattgtaactttttatttttttatttaatttaattaattaatttatttatttgagacagagtgtcgctctatcacccaggctggctatctcggctcaatgcaagctctgactcctgggttcacgccattctcttgcctcagcctcttgagtagctgggactacaggcgcccgccaccacgcccggctaattttttttttgtattttttagtagagatggggtttcaccatgttagccaggatggtctccatctcctgaccttgtgatccgcccacttcagcctcccaaagtgttgggattacaggcgtgagccaccacgcccggcctgtagctttttatattaccaccggcaaagaatgaaagttccagttgctccatattcccaccggcatttgatgttgttattcttttaagtttaagccattctgatgattgtgtggaattatctcatggtagttttagtttctacttccccgatgactaatgataaacacttgatcatgtacttattggccattcatgtatcttcatttatgaattgcctgtccaagtttttgtccctttaaaaatttagaccttaagaaacaagccatcctaagggagaaaaaaagaaaaaataattttaaaaattaggctgtttgcctttttattgaatttaggagttctttatatattctgtatagaagtcttttattaaatgtgttttgcaggtagtttctccaagtctgtggtttgcctatccattttctttatggcatctttccatgtgctgaagttttttaatgtcagtgaagtccaatttatggagttcttttgtggttattgttttttgttttctgtcttagaagaaatttttgtctacttctaggttgtgaatgtattctcctgtattttctcctgaaaaccttatcattttaactttttacatttaggtctgtgatccatcttttttttttttttttttttgagatggagtctcgctctgtcacccaggctggactgcagtggcgctatctctgctcactgcaagctccgcctcccaggttcactccattctcctgcctcagcctcccgagtagctgggaccgcaggcgcccaccaccacgcccggctaattttttgtatttttaatagagacggggtttcaccgtgttagccaggatggtctcgatctcctgacctcacagtccacccacctcggcctcccaaagtgctgggattacaggcgtgagccgccgtgcccggccaatccatcttaaattaatttttgtgaatggtgagcggtagggatcaagcatcagttttttcccccaaatgaatatccagttgttccagcatcatttgttaaaaaaagactttccttgccttcagtggattattttgtcaaaagctaattgactgtaaaagtataggtctgttttggactctctattctgtttcattgctctctttgactgtcattatgccaataccatactgttttgattaatgtagctcaacagtaagttttgaagtcagatactaaaagtctttcttcttctttttttttttttttgagacagagtctctttctgtcatgcaggctggagtgcagtggtgtcatctcggctcactgcaacctctgcctcctggtttcaagcaattctcctgcctcagcctcctgagtagctgggattacaggcacccaccaccatgcctggctaatttttgtatctttagttgagacagggtttcaccatgttggccaggctggtttcaaactcttgacctcaggtgatccgcctgcctcgtcctcccaaagtgctgggattacaggcgtgagttaccgtgcccggcctcttcatctttttaaagacagttttgcctactgtaggtcctctgtacatccacatacattttagaatcagctcaattttttttttctgtgaggattctaggaatatagctcatcaattctattaaaaaataaaaccagccgggcacagtttctcacgcctgtaatcccagcactttaggaggctgaaagtgggctgatcacttgagcccaggagttcaagaccagcctgaacaacatggtgaaaccccatctcgattgaaaataacaaaaattagccaagtgtagtgtcacacacctgtagtcgcagctgcttgggaggctgaggtgggaggattgcttgagcctgggaggtggaggcttcagtgagccaagatcatgcagctgcactccaacctgggtgacagagtgagaacctgtctcaaaaaaaaaaaaaaaatgcaggtacggtggctcacacctgtaatcccagcactttgggaggccgaggcgggcagatcatgaggtcaggaggtcaagaccatcctggctaaaaccatgaaaccccatctctactaaaaatacagaaaattagccgggtgtggtggcaggcgcctatagtcccagctactcaggaggctgaggcaggagaatggagtgaacccaggaggtggagcttgcagtgagtggagattgggccactgcactccagcctgggcgacagagtgagactctgtctcaaaaaagaaaaacaaaacaaaaaaaaactattgagattatgaataggattgtattgagtctatcgttcaatttgggagagaatgcatatcttagcaatattgaactttgcaattcataaacatggtataaccgtctctccatttatttcagtttgctttagtttcagctatgttttgtttttgtttttgagacggagttttgctcttgttgcccaggctggagtgcaatggcatgatctcagctcactgcaacctctgccttccgggttcacaggttctagagattctcctgcctcagcctgccaagtagctgggattacaggcacgtgtcaccatgcccagctaatttttgtatgtttagtagaagacagggttttgtcatgttggccaggctggtctcgaactcctgacttcaggtgatccgcccaccttggcctcgcaaagtgctcagattacaggtgtgagccaccttgcctggacggtttcagctgttttgtagtttcactgaaaaggtcttacgtgtcttttgttaaatttatatctaagtgttttatgttttataacattattataaaaggatattttaaacatttatttcccattgttagccataagtatgtagaaatgcaattaatttttgtttactttgtattttgagaaatttctcaggattcacttattttttttttttttttgttctagtatgttttggttgctttcttaggattttttacttaaagaaatatgtcacctgcaaatagagacagttttactcttctttcccaatgttgatgacttttttttttgagacggagttttgctctgttgcccatgctggagtgcagtggcgcgatctcagctcactgcaacctccacctcccgggttcaagtgattctcctgcctcagcctcccaagtagctgggactacaggcacccgccaccacgcctggcgaatttttgtattttaagtagagacagggtttaaccgtattggccaggctggtctcgaactcctgactttgtgatctgcccaccttggcctcccagagtgctgggattacaggcgtgagccactgtgcccggcccatgactttttttctagcctttcccattagttcagatttccagtacaatattgaatgcaagtagcggggaagtgttcagcatttcaacattagaagcatgatgtttgctgtatatgtcttttatcaaattgacagagttccctttcatgaatagcttgctgagaatttttgtcctgaattggtatcgaattctgtcaaatgactttttggtattattattttttcctttttcttgtattgtggtggataacattcattcatttttgaataataactcaaccttgcattcccagtatagctgggattccccacttagtcataacatatgatcagttttacatgttcctggatttgatagtattttgtcaagtatttttgtatttgtactcataagggatacttttttttttttcgtgatggagtcttgctgtgttgcacaggctggagtgtggtggcgtgatctcggctcactgcaacctccgcctcaagcaattctgcttcaggctcccaagtagctgggattacaggcgcgtgccaccatgcctggctaatttttgtatttttagtagagatggggttttgccatgttggccaggctgtcttgaactcctgacctcaggcaattcgccagacttggcctcccaaagcactaggattacaggcgtgagctaccatgcttggcctatacttttcttattatataaaagtctttgttagggagttaggcgtggcgtctcatacctttaatcccagcacattgggaggctgaggtgggaggatggcttaagcccaggagtttgaggccagcctggacaagatgagaccttgtttctacaaataaaaaacagctgggcatggtggcaggcacctgtggtcccagccacttgggaggctgaggtaggaggatggcttaagatcaggaggtcaaggctgcagtaagcagtgattacactactgcactccagcctgggccacagagtgagaccctgtctcaaaaaaagaaaaagaaaaaagtctttattaggttttgcggctgggtgcagtggctcacacctgtattcccagcactttgagaggctgaggtgggtggatcacttgaggccaggagtttgagattagcctggccaacatggcaaaactctgtttctaccaaaactacaaaaattaggtgggcgtggtagtgcatgcctgtaatcccagttactcaggaggctgaggcacaagtatggcttgaaccctggaggcagagtttgcagtgagccgaggttgcgctcgtgcactccagcctgggcaacagagcgagaatctgtcttaaaaaaaaaagtttttgttaggttttggtataaaggttttcaggtctaacagaacaagttgggaagtgttcattcctccattttttgctgaaaaagtttgtgtaagagtatttcttttttaaatgtttgaaataattcaccagtgaaattgtctggtctaggagttttccttgtggggaaggtccctcccacaatgatgtttattataacatcattcgtagtgataaaaagatgggatcacgacgaagtggtggaacaaggaatgacctcaaggcacatctgtatcaaggaatattaaagaaaaaaaccagaactatgccaaataatttggaaggatttccatatgattttttaaaagctttattgaaggatgatttccttttgtttcttttgagatggagtctcgctctgtcatccaggctggaatgcagtggtgcagtcttggctagctgcaacctctgcctcctgagttcaagcaattctcctgcctcagcctcctgagtagtggggattgcaggcacctgccaccattaatttttgtatttttagtagagatggggtttcatcatgttggccaggctggtctcaaactcctgacctcaggttatccacccgtctcggcctcccaaagtgttgggattataggcgtgagccactgtgcccagcctgaagtataattttcctttcataaaattcagctattgtaagtgagtttcaggacatttatacggctgtgcaactgtcaccacaattccgttttagaacactttcatcatctgttgggaggtttttgataacaactaataagaataaaatagggctattttattaaatagggctgtttcaatttccagttttattttgtgtcagatttggtaactgtgttttttgaggaatttgtttaccctaaattgtcatatttattggcatacagttatttgtaatactctcattattattatttaattttttttttttgagatggagtcttgctcttgcccaggctggagtgcaatggcacaatctcgcctcactgcaacctctgcctcccaggtccaactgattctcctgccttagcctcctgaggagctggaattacaggcaccctgccaccacgcttggctaatttttgtatttttagtggagacagagtttcactgtgttggccaggctggtctcgaactcctgacctcgtgatccacccaccttggcctcccaaagtgctgggattacaggcgtgagcccctgtacccggccaagggggacatttagataattgattttaaccctttcttcctttagtatttacacataagtatctttctaaatcctgttttagctgcatctcataaatttctatatgttgtgctttatttggtttgaaatgttttctaatttcccttgtgatttcttctttactgtttaatttccaaatatttgagacttttctagataacttactgtactgatttctaatttaatccattgtggtctgagaacatgttgtgtaaagttttcagtcttgaaatgtattgagacttaccttatggtccagcacattatctatatggatgaatgtttcatatatacttgaaaagaatattttatatacagttgttgaatatactgttctgtaaatgtcttttaggacaggtagttaataatgctgttaagatcttctgtatctttactgatttttttgaaagattgttcaatcaattatgggagtaaggtgttaaaatcttcatctctttctttagtattgtcaacttttcctttatgtatattaaaattttctcatttaggccaggcacagtggctcacgcctgtaatcccagtatctttgggaggctgaggcaggtggatcacttgagatcaggagtttgaaaccagcctggccaacatggtgaaaccttgtctctactgaaaatataagaatcagccaggcatggtggcaggtgcctataatcccagctacttgggaggctgaggcaggagaatcacttgaacccaggagatggagattgcagtgagccaagatcactccactgcactctagcctggtcaacagagcaagactccgtctcacaaaaaaaaaaaaaaaaaaagctggttgtggtggctcatcactttgggaggccaaggcgggtggatcacctcaggttgggggtcgagaccagcctggccactgtgatgaaacctcatctctactaaaaatacaaaaatagcctgggatagtggtgggcacctgtaatcccagctactcaggaggctgaggcaggacaatagcttgcacctgggaggtggaggttgcagtgagcctagatcgtgccactgcactccagcctgaatgacagagcaagattttgtctcaaaaaaaaaaaaaaattctcttatttgacacatacacatttacaattgtcattgcttcctaatgtattgactctttttttatcatcatgaaatcataagtagtagtaatccttattttgcagtctattttgtctaatattaatataaccatttcttcctcccctttactttgaggactttcttcatatagattgtattggttagataaacttattttccataaaattcatccaataaaatgaaatgttgaaatttcatagttgatctttaaataatttttttttttttttgagacggagtctcacactgtcgcccaggctggagtgcagtggcgtgatttcggcttactgcaagctccacctcccaggtttacgccattctcctgcctcagcctccagagtagctgggactacaggcacccgccaccatcccggctaattttttgtattttttagtagagacggggtttcactgtgttagccaggatggtctcgatctcctgacctcatgatccacccgcctcggcctcccaaagtgctgggattacaggcatgagccaccgtgcccagccgatctttacattttttttaaaagtctgagtcctggtgatcataatttgttccatttgtagattccacttatggtaaatgtcatctggttcttttcggagcaaaggctgcctacattcctcttacattcagttctgtggtattttgtttccaacagaacaataaacaaaaacaaactgaatgtcacctgacaacaaaattcaacgcaactccaaggcaaagaaaagtagtttacttccaggtttttttagattttttttttttcatgattttaaaagaggggacagagttgatttgaattttattaagcactgttatttgaacagttgctagatcctgatatctagcaatatccaggaaaatgtgcctttctaaatatttgtcttagctcattatttctcagtgaatgcctgtggagacatgaaagaatcctatctacaataagcaaaatatgttttggggtgtgataactggttttcctattacagaggagaagaatggatatttgtgtaaatagcatagctgtttggctgcccggttctaaaaactaagtttttcagatcgggtgttcaaaaattggaactactgctagcttgttagcttcttgctctttccacctgaagcaggatttctctatctcaacactgttggcattttggcctggaattttttttttttttctgttctgtgcattgtagaatattgaatgatttgtattcattggtaaatagctgctgtcctgacccttctgagtctcgcctagcccccttgttcagcactccctagttctggccactttgaggacccagctccagcatggtgggctgtgtcttttctgattggttgtggacctggggtgcgagttgctaacactttcaataccaacttggatgtgagggaggaaatacaggatacaaatgaaaatgggggctagaacttttagtccaaaaatattcttaggctcttcaggctattctgttttcaggctcttcttaaatatcaggcttctatttgttggctaacatgagagtgacttaaaatattcagacatatttatttatttattttttgagatggagtctcactctgttgcccaggctggagtgcaatggcacaatcttggcttactgcagcctccacctcctgggttcaagcgattctcctgcctctgcctcccaagtggctgggattacaggcacgtgccactgcgcccggctgatttttgtatttttagtagagacggggtttcaccatgttggccaggctggtctggaactcctgacctcaggtgatccacctgccttggcctcccaaagtgctgggattacaggcatgagcgaccacgcctggcctcagccatattgattttaaactatacctatactactactgggtactcttcaaataaccaaacaaatgttgaactttccaatatatgttaaaagtttatagaacagaatttgccagttgaaaaaatagtcccacaattagttccttttggagcccctgagatgaaaatttctggtgaattgaattattcaattaggtgtgaccccatgggcctaccgtggtgaagtggcattctcaaaagaggtctgtctagagggcagtgatagctagcctcaggccttgggcctgattgcactgttttggcatgatttgtattggcagagcagtcttcataaagaagagcctgcaataaggcacacctgccaagagaatgcttgtcaccaagtgaatgaaatggaaaagagggccgggcgtggtagctcacacctgtaatgcccgcactttgggaggccaaggtgggtggatcacctgaggtcaggagtttgagaccagcctggccaacatggtgaactccatctctactaaaaataaaaaaattagccaggcatggtggcgggtgcctataatcccacctacttgggaggctgaggcaggagaatcgcttgaacccgggaggcagaggttgcagtgagccaagatcacaccattgcactccagcctgggcaacaagagagaaactccgtttcaaaaaaacaaaaaatcaaaaagagtatagcatcattaaagataagaaagaggccgggcacagtggctcacgcttgtaatcacagtactttgggtggctgaggcgggccgatcatttgagcctgggagtttgagagggcatagtgggatgcacctgtggtcccagctactcaggaggctaaggtgggaggatcacctgagcctggaaggttgaggcttcagtgagacatgattgcaccattgcactccagcctggatgacagtgaggctttgtctcaaaaacaaaaaaaaaaaggaggggtgggtcttttcttggaactttgaaatgctcattttcagatagtgtatctataaactgaagactaaatcttaattattaatcttattaattaatcataagttttaatgtctacttttatgtttgttaatatgtaaaataaactaccaagtattctttcaggatcttagatgggaaaaattttaacgtatgttctagctataagaaccttgattttttaatgcagcaatgaggtatgcttaacttcagtttctaatgggagaaataaaacctgattaacttgcttgaaatatttgtgagttttaaaattgtgatcctggataataagtaactctaattttgaagttgacctaaactgtgaatgagctatccatttttacctacacgatagtattgagcaagtcaacaacctacgagagatccaagcactgaggcgcctgaatccgcacccaaacattcttatgttgcatgaagtggttttgtaagtatatttggagcttgaaaagttatctaaatttgatgaaaataatctctttttaagaaagaaaaccatggtagacattttgaatatttactttgtagctcagagagtaaccatttttacttcatcttacatcacatttttatttggaaaaatgtgcatctgattcttttttttattattattttttgagaaggagtctctctctctgtcatgcaggctggagtgcagcggcgtgatcttggctcacaacaaactccgcctccctggttcaagccatctcctgcctcagcctcccgagtagctgggatcacaggcacccacaaccacgcccagctaatttttgtatttttagtagagatggggtttcaccatgttggccaggttggtttcaaactcctgacctcaggttatccacccaccttggtctcccaaaatgctgggattacaggcatgagccactgtgcccggccagcatctgattcttaattaatgtggaaatgccttcatttaggtgactccacatcataaaagcatccgtcatgcaaacagttcatctcctggagctcagttaggctgctaaggtcttgagtgtgaattttgacctactgggaaagcactgtttgtgttatttcagggattgtacattctcattctgtccctgccagttgccatttctgaacagtctcctgtagtctttcttactgtaattgataacatttctggggatttttcatttctgttctaattatagaatagtttccataaggcttatctatcattcaaaaaggcagagcacagcttgtccctcggtgcctgcctgagcctgggaagccttcttcctgacagctctgtgctgtgcttacagacctcactgaaccagggagtcaggctacagggttttgggaccttctttgctgtgggctagaatggcactgacactctgagagggtgcacctcagtgtagaagcttcgctgtggctccggagggagcctggcctgtaagatcggccaaggaactccagttaaacttcactgccagttaaagtctggtagattttaatcagagaatgaaacagttttaaactcaaaatgaaatgtcttgttataactgtgtgggttcctgtcctgtagcgttcttagaagtcaatttgggccaggtccagagagtgcagtttgtatgtaatagtctcaacactgcatgcacgtcgtgcacttcccacgcactttacaaagtactctgtccagaatctcacatggacctcggaacaaccgagacctcttccagccagattggaggcacccagagtagggtctgggatgatacaggctcttgctcaggactctgggaaccctttaagggcctgcttgaactcagaagttggtggctcagccagcagtctctgtccctattctgtgtcagcgttgatatcacacacttgtgatgtgactcgtttttctctttttcccctgactggtttttggtttttactctcccattgtgatttatcccaattacatggaaggaatttagctaaattaaaattaaatttgcagtcatggagcacgaattaatttttctttctttctttttttttttttttttttgagacagggtctcactctgttgcccaggctggagtacagtggtacgatctcggctcactgcaacctccgcctcccgggtttaagctattctcctccttcagcctcccgagcagctgggactacaggcacacgccaccacacccagcttttgtatttttagtagagatggggtttcaccatgttggccaggctggtctcaaactcctaacctgaagtgatcgaccacctcgggctcccaaagtgttgggattacaggcgtgagccaccacgcctggcctcttttattgttttgcttacccaactccccaacctttttcttctttctgctgataattaattatgtattttcaagacatatctgttttcaacttctagaattttgttcaaagttgggttttgctagtatttttagttaattttatctgaaatactgatttaaaatcaaaacctttactgtttcagcaattacactgtagtatttgatgtgggagtacctaatgtttactagaaatgtttacaaatgaattaaatattggattatattttctgattaaggccagaaaatttattttaaaaacttgctttcttcttcagtgacagaaaatctggttctcttgcactaatatgtgaacttatggacatgaatatttatgagctaatacgaggtacgtagaataatttgaaagctaacctaagatcctcttttaaggcttgtaattcatatatgcttagttattctcaacatcattagtcaccatagtgctgtagttatatataatacacagtacagggtcacttcattcaccaggaggcatttttctgactgctcatctactcagaacatggctgcaaacaagaaaggaagccccaggccctctgggtgcccatgtgatctgggggagagtggcgggaggcagcaggggcagctctgctgcagagcgcctgcagccagccccgccgtgggcatgtgtgtgcaggcccgctggctcaggggcctctctgctccccagatctgctgttgctcgacattctgttccatgcctcttaaggcagagctttccctccaaaatactgccctgcatgtgagggaagctcctaccattttccaggatgctcgttcatttccttttttctgaacaataaagcactgtttaagagagcatgtttgcctgaggtgacctcagtcagggctggtttgagatacttatagaggttgcctgaggggaacaggagaaaaggagaggctggcccacactgagccaattgttcctgggggtctgactaatggttgtgttagatgtcagaacaaatgaaccttgtatatctcactaagaaagcaacatagcaagtgttacattttacaaatcacattatacctagaggacagataaaaaacaactgtcctactgtcacatgagtgactacttatgacttggaaaagaattttagtgacagcatcatagatgatttagatggtgtattatcttacaatttgagccaaactgaagatgatgtgctatggaaaatttttagattgataaactatttttgtgatggaagaagacactgatgttgaagatatatatgaagagttcaaataaaattgtttttatgaagttggatagtggaaaaagcattatatcaatatttattttatatgtgacttaaaatatgtgtgtgatagtaaattactaacaaaacaaatagcataagtagccaagtttttctacatccataaaagttgatgtatataaagctgggtgcagtggctcatgcctataatcctagcactttaggagggacgccagtgcgggtggatcagttgaggtcaggagttcaagaccagcctgactaacaaggtgaaaccctgtctctactaaaaaatacacacaaaaaaattagccgggcatggtggtgtatgcctgtagtcccacctactcaggaagctgaggcaggaaaatcgattgaacctaggaggcgggggttgcagtgagctgagattgttccactgcactccagcctgggcgacagagcgagactctgtctcaaaaaataaaaataaaggccaggggctgggcgcggtggctcacgcctgtaatctcagcactttgggaggctgaggcaggcggatcacgaggtcaggagattgagaccatcctggctaacacagtgaaacctcgtctctattaaaaatacaaaaaaattagccgggcgtggtggcgggcgcctgtagtcccagctactcgggaggctgaggcaggagaatggtgtaacaggaggtggagcttgcagcgagccaagatcatgccactgcactccagcctgggtgacagagcgagactccgtctcaaaaaaaataataaaaaataaaaaaggccgggcgtggtggcttatgcctgtaatcccagcactttgggaggctgaggcaggtggatcacttgaggtcatgagttcaagaccaacctggccaatatggcaaaaccttgtctctgctaaaaatacaaaacaaattagccgggcgtggtggcatgtgtctgtagtccaaactacttgggaggctgaggcaggagaatcgcttgaacctgggaggcagaagttgcagtgagctgagatcgtgccactgcactccagcctggacatcgcagtgagactccatctcaacagaaaataaaaaaaaaataaaagtcaacaagaagggagaatttttggcaagttgctgtgtgtttagacgcttgagaaagctttgtttagaatatatatatatatatatatatatatatatatatatatattttttttttttttttttttttttttttttttttgagacgtggcgcgatctcagctcactgcaacctctgcctcccaggttcaagagattctactgcctcagcctcccaagtagctgggactacaggcatgtgctaccacacttggctaatttttttttttttttgtaggcagagtctcgctctgttgccaggctggagtgcaatggtgcaatcagctcactgcaacctctgcctcccaggtgcaagcgattctcctgcttgtgcctcctgagtagctgggactgcaggtgcatgccaccacgcccagctatttttttgtatttttagtactgacagggtttcaccatgttggccaggatggccttgatctcttgacgtcgtgatctgcctgtctcggcctcccaaagtgctaggattacaggcatgagccaccgcgcccagccaattgttttgtatttttagtagagacggggtttcaccttgttagccaggatggtctcaatctccttgacctcgtgatccgcctttctcggcctcccaaagtgctgggattataggagtgagccactgcgcccagccttagaatatatgtatttttaggatacatttatatttattttcagtagtagaggaattgtataattgaagaaattgaatctatttctttcaatatctgtctacagcgattgtagaaaacagacctcgcagtagacctccattcattatataaatattgtcttccataggccaggcagtgtgttcagtgcaccaactctgagatgctgtgagcaacatggagcatcctaggttcagagatgttaaaatgtaaggagaatggccaacagtgcttgtagggtagtaaatattgaaatatgcatcctgattttagagttggtaaaatttgaaaaaaaagcctgtcctagaattgatgaaatataatgataatgataatagctaacagttcatgaatggtacccatatggccaggcactgttcttaatactttataggaattaactcattttaaccttccaacaaccctgtcaggcagatacggttattttttatttttttaagatggagtctcactctgtcgccaggctggagtgcagtggtgtgatttctgctcactgcaacttccgcctcctgggttcaagcagttctcctgcctcagcctcccaagtaggtgggactacaggagcacgccaccatgcccagctaagtttttttttttttttttttgagatggagttttgctctttttgcccaggctggagtgcaatggcatgatctcggctcaccacaacctccgcctcccgggttcaagcgattctcctgccttagcctcccaagtagctgggattacaggcatgcgccaccaccccagctaattttgtatttttagtagagatggggtttttccatgttggtcaggctggtcttgaactcccgacctcaggtgatccgcccaccttggcctcccaaagtgctgggattacaggcgtgagccaccgcgcctggctaagttttgtatttttagtagagacaggtttcaccatgttggccaggatggtctcgatctcttgacctcgtgatctgcccgccttggcctctcaaagtgctgggattacaagcgtgagccactgtacctggcccagatactgttattatcctcatttgaaacatgaggacattgaggcatggggagataagttgcttgtccaaggttatatacctagtaagtggtagaactggggctgaacctagataacctgatcctagagtgcatgttcttaaccaccacccataccgcctcatgacaaccctgtgtggttggcactatttattattcccattttacagatgaggaaattgagtcttgaaggattaagtaataatccaaaattaagctgttaataaatggcagaactgggatttgaactcaagcctgactctgaaatcctaagcattaagctctgttgctgccctgggtctctatttctgggcccagctcagtgccttaaatgaacagaggcacctaattatttacggttattgatgatgatgcttctttagtgaaaactgaatcaatcactaaggctttagataccagaatggcaatttttgtgacttaaattgctgctctcaggttattagaatattgaggagcactattaaagactaaagaataagataataatgaaataagggaacgatcacatagccattattgaattgtctactttacagcagtgtgcaaggtctggcaagaactgggaagataaagaagcagcatgtcagatgcatgttttttatattgaaagagtatatagtctttttttttttttttcttgagatggagtctcactctgttgcccaggctggagtgcaatggcacgatctcagctcactgcatcctccgtctcctgggttcaagcgattctcctgccttagcctcccgagtagctgggattacaggtgcccaccaccacgtccggctaattttttgtccttttagtagagacggggtttcactatgttggccaggctgtctcaaactcctgacctcgtgatctgcccgcctcagcctcccaaagtgctgggattataggcgtgagccaccgcgcccagcctgaaagagtatatagtgtagtgtccacataaactatatgaaagtgatatcataagagaaaaggaattgctggggtagatttctttttgttgaacaggtgtcagatgaggcagagatggtgtgggctgggaaaataaggctttcctggaggagtggtagaattggacaggtgcgggagaggatgtcccatttgcagtgacatgccatgggctattccagaggcagggacatggtggggaacacagcagacacagttcccacccatgtggagctcacacttgatgaggagagacaggaaacaaatgaagaaattatcaagaatatcagtcaaaatgatcaagaattccagatagggataagtgctgtcagtgaataaaacaggccaatgtgttagagagtgatgaggatagagtacttcaggcagagggacagccagtgcaaaggccctgaggccaccgtgagggaagaggcccatgtggctggaggacatgaaggagagttgcaggaaacggagtaggcaggcatcgatgaggctggtagggcgagggtaagaattttcgttactctaagttcaatgggaagccattattgggctttaaagcaagggagaggtggttttcaattggtgtttagaccagtgtttccaaaacgatcacagaagaccagttgttttatttctaatatattgcagaccagaatttttgtaaaatatagtaaaaatgaattaccagaaaagtgatcacgtgcttagatgtcacagcatgtcaaattgctataagtggttctaaacaggtattcttttttttttttttttgagacagagtctcactctgttggcaggctggagtgcagtggcgtgatctctgctcactgcgacctctgcctcccggattcaagcaattctcctgcctcaggctcccaagtagctgggactacaggtgcgtgccaccacgccctgctaatttttgtatttttagtagagacggggtttcaccatgttggccaggatggtctcgatctcttgacctcgtgatccgcccacctcagcctcccaaagtgctgggattacaggcgtgagccactgcgcccagccctaaacagttattcttaatttatgtcatctcctcttagaccagtaacagtccctgaaccatcatcagctcatggactgtgctttgagtagcatctttttagaaggaattctccagttgctgtttaaagaataaatgtgctgtaggtggatgtgttggttctcccttttagttgcaaataacagcctcccctattctctgattaactcaagaggggttactctgtgatatggatagattgccagaattgttgggaggactgaagaagcagactctgggcttggcctataggaagttgcttctcacaactctgctctccatgatcaggctgctggccctgccgctgacaacgctctgcagaataaagctgctgcagctaccaggcctggaatcatgcctcttctgccaggatcaggaggcagccgtgatccatgccgtcagaatagatgccttccctcctctcatctgcccccatacctgggccagaagcatctttcccaagtgttcccatttaggcagagcctaagtcacatctggaacactcagctgcaaggcagcatgaagaatgtcatttggacgttcaggcctggcatgctagatgggggtttgggataggacctgagcaagccaatctgcgggtgtgccatgaaggcaagagtggtgtgggagcctggggaagggatggcgaaggccctttgcccaccactgtctctggatgaatgtctctgaattctttggcgtgagttagtaattggggtgaatagagcatggctacccgccagcgatcctagtttgtgtatttgggcgcgtgtgcttatggctctgggctcatgccatctgcagtaggaaagcctgtcttggaatttatgaaggaaaaaccgtaaaggaggtttagtttccctcatactctgactatagaggcagctactcttttacaaaattgtatctgattctgctctttttttttttttttaactgtttcaagttaaattcatagggccaggtgcagtggctcacgtgtgtagtcccaacactttgggaggccaaggcgggaggattatttgagcacaggagtttgagactagcctaagactctgtctgtacaaaaaaacaattttttttttttgagacggagtctcgctctgttgcccaggctggagtgcagtggcgatctcagctcactgcaagctccgcctcccgggttcacgccattctcctgcctcagcctcccgagtagctgggactacagacacccgccaccactaaattagcctggctaatttttttttgtatttttagtagagacggggtttcaccgtgttagccaggatggtctcaatctcctgacctcgtgatccgcctgcctcagcctcccaaagtgctgggattacaggtgtaagccaccgtgcccagcccaaaaaattaaaaaaaaaagcatccgggtgtggtggcacacgcctgtagacccaactactcaggaggctgaggtgggaggatggcttgagcccaggaggtcgaggctgcaatgagctgattgtaccactgcactccagcctgggcaacagagtgagaccctgtctcaaaaaaaaaaaataataataactcatttgccttaatgaatggctagttcgtagttctctccaccctcgctggaggggcgtgtgctggggatgccgtcattctgcaggctacagtggcagctgtattccttcagttagtgctgagtcacagtgaatgccttggtttatcactgtgttcacttaagtttttaaaattattagtatcatatatgacattccttcttaatgagaatatttggtaaaaattaacttgtaaaaattaccttggtcaggatagctagagcagatgagggaaatgcttttggggcctgctggaattcactaaggggcatataagaaacttctgagtaactcgttaattgtactctattttacttgtttcaaactgtttgaaaacaagaatctgatgggaaccagatagtcttgggcccggaaagtttgttctggagaagcttatggagagtggctaggcagtgctttcctttgcaagggtgtggtctccagcacttcagactactgggcccacactgttgctctgatacctcatgccagcagtaacacccccaactactggcccgggaccaggacggctccctacccctagggctgtgaatagggagtttccaggaggagacccagggaggcaaggaagggtgggcacctgaagaggactcttacctgggactgaaggcatctgagaagcacagattcctggcccgcatgcccgtttgtggctccattaggtctaggttcaggccttgaaatctgctttttttttaaattttattttattgttttttgagacagagtctcactgtgtcacccaggctggagtacagtggcacgatctcagctcactgcaagctccgcctcccaggttcacaccattctcctgcctcagcctcccaagtagctgggattgaaggcgcctgccgccacgcctggctaattttttgtatttttatagagacggggcttcaccgtgttagccaggatggtctcgatctccggacctcgtgatccgcctgcctcagcctcccaaagtgctgggattacaggctttttaatcagctttttaaaagacttctaggtgattatgaagattggatagattagacttttcctaaaagattccacgtttcccaagttcaagttcagatgactctaatgacaattttatgatacgagtaagatttaaatgtgtggacatggctgggaagggcgttcctggaatggaacatcatgaatataggtactaagcaggcgagctttgggagcaaccagagaagagtccatgagggaattcacctgagcattcgataaacaagaagggggtggtggggcatggttctcgaagcgaggacccaagactagtagctgcacctggggctctagttaggcgactgtggggccccattgcagaccttctgaatcagacatgtgggtggagatggggagggacagtatgtgtcttagcaacccactcgtgggagtctgagaacccttttggtggagaggaattggttgaagggggtcttgagtgccggggtaagtcgggggcagtgagactgggtttgatcacaggacccaggagcacctgatgagatgaaattccagcagcttcattctgctgcgtgtgtgaaggcaaatggaaagttgctttctttttatctgttatagatattaatttaataagattccagaattatcagcttgggaaagctgataaaggtcttacttttgattcttttgattttaattctggaaaattgatgataaatcatgtgaaacaataaaaagatgatagtatgacacaaaaaagttaattgcggccaggcgcagtggctcaagcctgtaatcccagcacttcgggaggccgaggcgggcggatctcgaggtcaggagttcaagaccagcctggtcaacatagtgaaaccccgtctctactgaaaatacaaaaaaattatcagggtgtagtggtggcgggtgcctgtaattccaactactcgagaggctgaggcaggagaattgcttgaacctgggaggtggaggttgcagtgggcggagatcgtaccaatgcattccagcctgggcgacagtgctacacttcgtcccaaaaaaaaaaagaaaaagctaattgcacctagacattttacaatttaaattactttctattatttatatattcttgttaagtagagaaaaagaataattttaatttttcaaaagaaattgtaaacttaggaccaaaagtgtcaaatggtatatgtgctcatggagggaggaagtggatttccaaactgttaggtgaacatggtcattgtgcagatttaaaacttaataacttaaaacacacactttgaaaattaaaatcaagtaaaattgacatcttctggaacaggggtaaactgtgatgctgggcatgtggtatgacgtcttcaagcacggtagaaagctgcgggcaccaaggcacagccagcccaggtgctgagtacagggcagctgcaggggactgtgccagccacgctaaacggcctctcctgtgaaagaagacatgtggactgtgactgaaagcagttgaactgcttcttgaactgtgatctgtccccctttaaagtggacatctccacataaacaggaaagcctagtggaacactgggttgacgagtgactcctaacattttcataatcagtgtaggctgaaggacagcgtcctggaaggcctccgaggccggctgaggctgtcagaccatgctacttgtgtgacgattgctcagtgctgttcccactgaaaccatagcacatgcgctctgaatgttcacagagctgacgcacgtgctaattgccccgatttcatccttacacattgtatgtatggatcaaaataacactctctgggtcccattagtaggtacaattactacatttccactaaaaaggaaaaaaattatcaacaattctgtcattcttcagtaacgtttattgtttattaattttttaattggcagtttcccaaacctgcttcacctgtttcaaaactcagaaaaaccacgtgtgctagagcagcagcagagtcactatgcagctgatagagctgactcgcccggggcttccaaaacaggcccttgcggtgtctccaccatgtttatagattttgttaaatttgcaaaaataagatatttcaaccacaaagttaagactgccatctcttctattttaacctctcctatgtcatatttcccctcttagcgtaaccgtgaaatagccgtggacatgtctggaatcttgttaagggttggctgggatacatttatatgctttgcagtctcttccatatattaatagttacattattgctggccatctcatttgggatgtcttctaggaatactctgaatatggtcaattcaaagattaaagagcattcactccatagaaaacttgaaatatgaaatcttatagctcagatatgaaggaaacttagcagtttccccagatttgacaattctaaaaattacatggtgctactaatacatagttgaggatgtaaaagaagcctctataaactgccaaaaagaaaaataaaaagggattttccattaaaaatgtatgtgctatgtaattttaaatgagatcatgccattatatagattttttttttttggacggagttttgctcctgttgcccaggctggagtgtaatggtgccatctcggcttgctgcaacctccacctcctgggttcaagcgattctccagcctcagcctcccaagtagctgagattacaggcacccgccaccacacccggcaaatttttgtatttttagtagatatggggtttcaccattttggccaggctggtctcaaactcctgatccacccacctcagcctcccaaagtgctgggattacaggtgtgagccaccgcccctggccagtatatggaattttaaatggtatgttttgtaggcacactacatatttcctaagactacttcagattattttttacaggggaacttagattttcacacattgttaaataaaaatagattatttttatttcaaaaaagaggatatgtaccatcagtaaccgtatttgcctatttccttgattgtacagggagaagatacccattatcagaaaaaaaaattatgcactatatgtaccagttatgtaagtccctggatcatattcacaggtatgctctcggagatttgacagctctgaaattaataaaatgtgttaacattcagattcaagaatttgaataaatgaagtgtaattctatttttcctttatactgaatgcagaaatggaatatttcacagagatgtaaaaccagaaaatatactaataaaggtaagagcttttacatgaaagctgggtatcagaataaaagctgaatagaaaatctttcccgaaaggttttctcctcctaccagaggaactttcagtccatgcggctagacagcctgtttgttacagtaatttttttccctctcaggttgtaaaaaatggtttatttaataaatgccatcaacataactgactgcacctggaagaaaataattgaaagcaccattttcacaccgcagacaaaaatgaaccctattcagacggccgttcaaaccttctagagggaaatgtggcagaggcaggatttgagctcaggtccgtctcactcccaagccactaaactacctgtgtttaaaccgtacaatttgctgtttcccagcacctgtcactggctgtcagcagagtcctctgaggctgtgtggctaaaagagcccttgctgggcaagctggcagcatgaccggacagacgactagtgtgtgttgttcatttgtagaagcgccaatgggttaaccagtttccaaacctgtaggcattttggaaatatatgtgaaacagccagaatatttgtaaacctgttccactgaatagacatcacttcctcatctgctggaggcactttgaggtgctcagaaagccagtaatttgtattttacagactactttagatgctagtaattttcctgctggtgcataaatatttggagtggtttgtattatgatagccacataatgggatgttacttgtccttgcttctttccccttccagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccaggtagcaccaggccaggctcctgcctggttcctgcggcggagcggtgcagcagccaggctcgtgctccttcctttacaatccagatgtcatggtcattctggtttttctttctgttttactgtttttaatttaacagaaaattgactaggctttcattttacttgttgtacatatttggccttgcctgcccttcccagagaagagcaccagccctcagttgttctccctcctgcacaccctggtggtgtgggcagctgcctccttggggttgctgtgaggtgcttgatggggctgctgtggggaggggtgagccaaacctcccctgagaggtgcagtcatattaggtagggtgccctggccacaggtgtgaggatgaggcaccttctggcacagttggactctagaaagccccaatcccacccctccctgctccatcctccaaaccccccactcccccccagcctttggcaaggagcagtggcccagggacgaggagatgggggccggtcccactccgaggtgaatggtgttgagttgaagacgcgcacaggggtggagagctgcacctcttgctcccagtgggcctccaggcaggtggcagtgaggttaaggtctgggggtgcatctgaggggtcaaagtctggtcccgcctgctcaacagactgctacagaaatgcacttcaggacatactctcctttgatccagatggttcatactggtaacttttcattttggaaagctgaatggcaatttcactgcagccagaagtgtcaaccaagagtcccttcccatgagcccaggtcctgtgagttcatctggagggggcagatgtcaggagcacaaggccacctgtatctcaccagcgcacaagacggcccacggtgcaccagccaccaaactgggctgaggcactcatctccccacttggagctgtttcctgctcacccgcatttcctcctctctcctttagtcacaagagcctgccattttctggaatagaagctaggcctactaccagagctgtatttttaaatattatttgtggcatgtaatatgaattgaatttatttatacaggtttaaaatctgtatttatttttttgagatggagttttgctcttgttgcctaggctggagtgcaatggtgcgatcttggctcaccgcagcctccgcctcccgggttctagcgattctcctgcctcagccccccaagtagctgggattacaggcatgcaccaccacgcccggctaattttgtatttttagtagagacggggtttctccatgttggtcaggctggtcttgaactcctgacttcaggtaatccgcctgcctcagcctcccaaagtgctgggattacaggcatgagccaccgcgcccagcacaggtttaaaatcttgttcccacaattccaaaatctataaaagctctggaaaccaaaaggtttcttgggactcatttgttgacaaaacctgacctgtctcaccctgaatttgtcagcaaaactccccttggccgatgggaggctcactgtggggttatttatcacggttactgtgaattagtcacatttcaccacagacatcatgctgaacagatgacggaatgtggatctgtcttttgcctcttagaaaacacatgtcggacctattggtaaagtggaaacaaaaggtcaagcacaagggagagtggagcctcccagcagctaaggtcgctgcacacgccaggctgagttcctcgtgttccgtgtggtgagggtcgctgcacacgccaggctgagttcctcgcgttccgtgtgagcgagtctgcctggtcgaggggactaggcagaatggagagacccatggccatgtcctgactgtagggtcagctgagagaaaggaaaaatagacccaaagtcaggcaagcaagtcagacagtcagaggaagcagccccaagcttatagaatgagggatttatattggggaggggaatttgagggagttctttggtatggccgcatcctggggttggttttttttttttttttttttgagacggagtcttgctctgtcgcccagactggagtgcagtggcgcgatctgggctcactgcaagctccgcctcccaggttcacaccattctcctgcctcagactcccgagtagctgggactacaggcacccgccagcacgcccggctaattttttgtatttttagtagagacagggtttcattgtgttagccaggatggtcttgatctcctgacctcgtgatccgcccgcctcagcctcccaaagtgctgggatcacaggcgtgagccactgccccggccatcccagggttgtttgctggttaattttgccacatatcaccttgtgatgtttgtggtagcaactagatgaagagcaggaacttacagaagggtgtagggaaagtttgtttatgcttcccacgacctcctgctgtgagttctggatggtttgtaattggggtttgcttatcacagcaaggtctgacaggtgaagtctgctggctttaccgtggcgcctagataaaggcttagaaatgtaaagaggcttgagggaagggtgaaccgcacggagaagggttgcagagcattagggggaggggtgggcagcaccaagaagcttttttggggcagtttgtctctaacattccagccctttaataggtaatagaagaggggcgccgttggcgtctggccacttcttgctgggaaggggtgatggttatgggggaaggctggacagtagggactgccgttcttggagctgttggtattcttggagcagcatcatatcttgtattgtattgaaggctccgatacggtcctgtaaaaactgagtgagaaggcgtaggagacaagggctgaatgctagaaaaagaagaatggttatggctgggcctaagaggggcattagccatggaaaccaggtactaaaggaccaggagggccacgctggccatcgggggacattttctttaattttttgtgctcggtcctttagtgtttttacaaaatctcgtactaagccagattggttacgataaaagcaacactgttcatctagaaagaggcagagtcctccctttttggctgtgagtcggtctacgcctctgtgattttgaagaagcgctgctgctaaagaatctatttgtgattggagagttgtgatggatttggctatctcttccaagctatctgtgaggtctttggagagggattggtaataggaaacagaggtggttaatcccgcagtctcagttccacctcctgtagttattctggggactgctaatagaggtatgagttgcatagcacggcagtgtcggatgcgggtattaactgggattggtaggggttggtctcctggagcaacattgatttttggagtgaggaaaaccagggtgcaggtaggtgcctgtccagttagaggggaggcaaatataagttgaggtactgcataggaaaagtatgccttggcttggtagacagaactggttgtgtatgctaaaaagatgtactgttttgttgtcctcatgcatccatactcctagggccccggctagagctgctgctctgagtggttgtaaagggtgtttgctttaggctgggggctttgggttcttttttcccagcgtaagaggaagcattttgtgtccactaagatccatgtgggagtgttgctgaatgttgggataaggacacagtcgcaggtggcgggtgcagggatggtgcatggagaggggagccaagggaagagggataaatgggggtgtcggccgttgcagtactctgagtttttgttaaggaggtgggaggtgtcaagggctggggggctagataaacgaagcctgtctttattgttggtggctttgagagtagtctgttcggtggagggtttgagttgtgcggtgtaagttgcacagtttggaatttaggtggctgaggggaatgcttgagggtggatgtcgctggcgcacagtggtgctggataggataagattgtgtgggttgttacggttcctactaataggcattcatcacagctgtggtagggccaggttgcgtaagtaggcatgtaaggttgtaacacctggaccgaactcgctagctaactgggggagatttttgttaatgcctgtatgtcgagtttgaggggcagttaatgaggatttcaggatggtagcttacttgggtggaagtccagttataggctgagcaggggttgcattgtatgttgtggagaggagggatacgcagagccagcagtctcttgccagagaggaattggagttttttagtaaggagtgtgtgagattaagtgttctgtataggtgttcaggggttgtaggtattggttggactgaacgaagggttggggtattgattatgagaagggttagaaaggcagatagtgagcagaaaaataaatagttcggttccacccagagtaaagccacagagagagccttggaagaaaaggtcgattatccacttgaaaaaggcctccaggtgtcgttccgtgggtggaaccaggaaatatcttgtgagagggcgtgaaggaagagagtgaagcggcaggatagacaaaagcagggcatctagggaggatgtgggaatgtttgatagtgattgtgattcctgctgtaagggtaacgattaggcagacggctaaagtgagggagacttttggctggtattccaattggaaggagttacactatataatcccactgcaaacaatagggtaagtattataatgcctgcagttagggtgtaatagagtgtttccattaaaggaggctagttgtaatagtactttaaacctgtttgagatggatggatttactgatgtgaagtttcttctgggatggatgtgaggcggagtcaggttggcccaaggagtgtgctggaataccagttagaagttggtgaggtgctggttggaggatcggaggtgggagctctctttaacctggaaaggtgatactagggggtatgtcctgagagtttggctgcagtaggggttgtaagtgtcacacacgtccatgtgaaaagaccaccaaacaggctttgtgtgagcaacaaggctatttatttcacctgggtgcaggcgggctgagtccgaaaagagaatcatcgaagggagataggggtggggccgttgtagaggatttgggtaggtagtggaaaattacagtcaaagggggttgttctccggtgggcaggggcaggcggagggggtcacaaggtgctcagttggggagcttctgagaaaaggaatttcacaaggaaatatcagttaaggcagggaccggccattttcacttcttttgtgattcttcacttgcttcaggccatctggatgtatatgtgcaggcttgggcttagaggcctgacattcctgtcttcttatattaataagaaaaataacataaaatagtattgaagtgttggggcagtgaaaatttttgggggggtggtatgaagagataatgggcgatgtttctcagggctgcttcgagtgggattaggggtggcgtgggaacctggagtgggagagattcagctgaaggaagattttggggtaatgggtggtattgtggggttcttagaaggagcatttgtcatatagaatgattggtgatggcctggatgtgtttttttatgaattgagagctaaacggaagacacaaggtccaaataagagaaggagaaaaacaggtattaaaggactaagaattgggaggacccaggacttccaattagggagtgcccaagggggttcagcgtaattacttgcttggttggtgagtttttgggctctatccttgacagagccctcctttttaagttggaggctgagtttggtgaggtgtgtttttaaaagaccattagtctgttccattctacctttcctgaagattgaggatggtaagcggtatgaaggttccactgaataccaagagcctgagaaactgcttgggtgatttgactaataaaggccagtccgttattggaccgtatagaggtgggaaggccaaaccgaggaattatgtctgacagaagggaagaaatgaccacggtggcctttttttgaccttgtgggaaaggcctctacccatccagtgaaagtgtctatctagaccgagacgtattttagtttcctgactcagggcatgtgagtaaagtcaatttgccagtcctgggcaggggcaaatccccgagcttgatgtgtagggaagggagggggcctgaacaatccctgaggagtagtagaatagcagatggaacactgagaagtgatttccttgaggatagatttccatgatggaaaggaaatgagaggttctaagaggcagactagcagcttgtaatctacgtggaagaggttatgaaatgacgacagaatagaatgggcctgtgaggctggaaggagatatgttccttagtccaagaactatttgccttgtgtgggaagagattgataggtggaagtttcagtggtggagtaggtgggagtgaccgatgagaaggagaaaaactgccatgagggatagaagttggaatgctagctgcttctttagctaccttatcagcataagcgttgccccgagcagtggggtctgatgccttttgatggcccttgcagtgaatgactccagcttcctttggaagtaaagcgaccttgagaagtatttttattaaagaggcattaatgatggaggacccttgtgtagtgaggaaacctctttcagcccatataacagcatggtggggcaggatatggaaggcatgtttagagtcagtataaatattgatgcgtagttcctttgcaagagtgagggcttgagttaaagcaatgagtttggcttgctgagaggtagtggagggggcagagcagtagcctcaatgatagatgtggaagatactatagcatagcctgcctttgctggtaagcggtgattaggcctggtggaactgccatggataaaccaagtgtgatcagggtgaggaacaggaaagaaggaaatatggggaaatggagtgaatgtcaggtggatcagagagatacagtcatgggggtcaggtgtggtatctggaataatgtgggaggccggattgaagtctgggccaggaacactggtaattgtgggagactcaacaaagagtgagtacagctgaaggagccagggagcagaaagtatatgcatcaggtgtgaggaagaaaatagattttggaagttatgagggctgtagagagtgagttgagcatagtttgtgattttgagggcctctaaaagtgttagggtgacggcagctgccacacagagacatgatggccagcctaaaacagtaagatcaagttgtttggacaaaaaggatacagggcacggtcccggctcttgtgtaagaatttcaactgcacagccctgcactttggctctgtgtaatgaaaaagggttgggatgagttagggagagctagtgtgggagcagcttccagggctgtttttaaggaacggaaagaggaatggggaaaggatttaggatctatgtggtcagctaggttttcttttgtgtttatgtaatggttttgttaggatggcaaaaccaggtatttaaaggtgaaagtatttaaccatgcccaggaaggaaaggagttgttttgtagaaggggttggggtttgggagattagccagacatgattagcagggagggcatgtgtgttttgatgaagaattatgccaagataggtaacagatgaggaagaaatttgggtttgactgaagtaatgggggctgtccatgaagccttgcagcagtacagcccaggtaatttgctgagcctgatgggtgtcagggtcagtccaagtgaaagcaaagagtggctgggatgaagcgtgcaaaggaatagtaaagaaagcatgtttgagacccagaacagaataatgggttgtggaggggttgtggagggaggtattgaggataggagagtatatgggtttagcactacagggtggataggcaaaacaatttggttgataagatgcagatcctgaactaacttgtaagacttgtccggtttttggacagggaaaatgggggaattgtaaggagagtttataggctttaaaaggccatgctgtaacaggtgagtgataacaggctttaatccttttaaagtgtactgtgggatgggatattggcgttgagtgggttaagggtgattaggttttaatgggatagtaaggggtgtgtgatcagttgccagggagagagtagaggtgtcccatacttgtggattaaggtggggagatacaaggggaagatgtgaaggaggctttgaactgaggaaaagggcagcaatgaggtgtggctatagtctaggaatagtcagggaagcagataatttagttaaaatgtctccacctaataagggagctgggcaggtgaggataactaaaaaggagtgcacagaagaatgttgtccaagttggcaccagagttggggagttttaaaaggtttagaagcctggccgtcaatacccacaattgtggaggcaagggaaaagaaggtaatgtggagtgggtaagctccgtattgattaagaaggggatggacttaccctccactgtaagagttacccaaagcgtctgtgatggtccaggaggcttccgaggcaatcaggtagcattagtcttcagccgctaaagccaagaagatctgggaaggagtcagtcagagagccttgggccagagttccagggactctgggagtggctgctgggcgagttggacagtccgatttccagtggggtcctgcacagatgggacatggcttaggaggaattctgggctgtgggcatttcttggcccagtggccagatttccggcgctagaagtaagatccttggggaggcagttctggaggaacgcctggccactgcggttcagacgtttggaagttcttgtgtcctggagatgtggctggggtttgtctcacagtggaggcaggaattgcaattcagaaattcattgctacttggctgcctctactctattattgtacaccttgaaggtgaggttaattaagtcctgttgtggggtttgagggccggaatctaatttttggagctttttctaatgtcaggagcagattgggtaataaaatgcctattgagaataagatggccttctggcccctctgggtctagggcggtaaagcatctaagggttgttgccaaacgggccatgaactgggttgagtttttatatttgatgaaaaagagcctaaacactgatttgggagaggtcagataaagaaaaaggagcattaaccttggctaagccttcggctccagccacctccttaagaggaaattgttgagcaggtgcgggagggctagtctccccacgtgaaactgtaagctggaccctgtgtgaggatgggaggtgattaaaggattatagggtgggggagtggaggctgaggaagaattgagacctggctcagcctggcgaggattagcctggggaggaagggaggggtcagatgggtctgtagaaaaggattcaaaggactcagagcttggagtggagactgaaggaatagacaggagagaaagaagaaagatttgggatgagttgcattgggagcagagactagggagggaccgatgtgtaaaagaatgcctggacgtcaggcacctcagaccatttgcccatttttcgacaaaaatcatccaggtcttgtaaaatggagaaatcaaaagtgccattttctggctgtttagaaccattatcgagtttgtattggggccaagtggtgttggcgaagacacttaggttttaggtcaggcaagagttgaagaggttttaagtttttgagaatacagcctaaggaagaagaagggggaatggagggtggaaggttgcccatagtgaagcaggcaagcccagagaaaagagagggtagagacacagataaggagggtggtgagcagccctgggctgcaatgtgggtgagcagccaaagcaggcatccccgcagttgacttgccaccaagggaatgtgggtgaatgaccaaggcaggcatcctcgcggtgatcagacaccaatggagtgtgggtgaataatcaggcaggcgtccccgcagtgattaaacaccaagagaagactgtattcctgagtctgtgactggtgctggagttttgagtccacggatagaatgtgtctccttcgtctctactagagaggaaaaagaactggaattggaagaacagggagactgaagggtagcaagagaggctggagaagagagtgaaaagaccgcttacctgatttgaaattggtgagatgttccttgggctggttggtctgaggacccgaggttgtaggtagatctcctcacggagtgagggcaaggacaggggactggtctcccgaaggagtcctcctgtcccgggtttcggcaccaaatgtcacgcgcgtccctgtgaagagaccaccaaacgggctttgtgtgagcaacaaggctgtttatttcacctgggtgcaggcgggctgagtccgaaaacagagtcagcaaagggagataggggtgggtcgttttataggatttgggtaggtagtggaaaattacagtcaaagggggttgttctctggcgggcaggggctaggggatcacaaggtgctcagtgtggaagcttctgagccaggagaaggaatttcacaaggtaatgtcatcagttaaggcagggctggccattttcacttcttttgtgattcttcacttgcttcgggccatctggatgtatactgcaggcttgggctcagaggcctgacagtaaggatgacctggaaagggccttcccattttggtttaaggctggttgggttaagggtttttttttgtttgatttttgttttttgttttgagacagagtcctgccctgtcgccaggctggagtgcagggcacaatctcagctcactgcaacctttgcctcccaggttcaagtgattctcctgcctcagcctcccgagtagctgggactacaggtgcctgccaccatgcccggctaatttttgtatttttagtagagaaggggtttcaccatgttggccaggatggtctcaatctcttgaccttgtgattcaccaggcttggcctcccactgtactgggattacaggcgtgagccactgtgcccagccgggttaagggtttttagaaaaacatgttctcctggtaggagggtctggtcagtgaggcctttatgtggtattgggagggcctggtgtgcctgtttgcagaggagatggcggatgagggagagtgctgggaggtactctcctaattgagaatcagaaggaggcctgttttgtaagaggaaagggtctcagaaggaggcctgttttgtaagaggaaagggcatccatacattaattcaaatgggctgaggaaggagggtgcctttgggctggctctgacgctggctagagctatgggtaggagggaagtccagggcctctggacttctagagtgagtttgatcaactgagtgttaaggtttccatttgccctttcgacttttcctgatgattggggtcgatatgggatatggaggtgccactggatgctgagggactgggagagctgttgggtgatttgggaaatgaagccagggccattgtctgattgattggagcgagggagaccaaagctagggatgatttctcttgtggggatctgggagactactgcagctttttctgaagaggtaggaaatgcctccacccacccagagaagatgtctataagagtgagaagtagtcttgtgtttttgacgggaggcatgtgggtgaagtctatttgccagtcttcccctgggagtgttcctcttagctggtgtgtaggaatagatggggaatggagggctccttgagaggaggtgacagagcatatatgacattttgaagttatactttttagtgaggtaaataggtgaggggagaagaaatatgggcggaggaggagatataggggacatgcaccaatatggaaggattggtggagagatgtcaggattttgtcggtttggccctggggaaggtctagcttctggtccttatctatccagtccccctggaggaaggctccttgttatagtaatgaggctttttcagtggggggtactgaggttggactgcaggggtaatgaggaggagggaggcaggagcggaagaaagggaggcttcttttgctgccccattggtctttctgttgcctcttgagattttatctgttcctgtgtgatgtccccaacagtgtataactcctgcctcagttgggagatgtgcggcttgaaggagttggtaaataagggggtggttagtgatagggtcactttggcagtaaggaatctcctctcttgccagatggtggcgtgggaatgaagaatgtgatatacatctttggagtctgtgtaagtgttgactcgtttgcctttggaaagggttagggctctggtgagagctatgaattctgctttttgagaggaggttcctggaggtaggggcttagcttcaattactcggtcaagggaaacaactgcatacccagcaattttgggggagccagtgggcccagaaggggggccatctataaatagctggtcatcggggttggtgagaggctcggaggaaatgttaggaaagtgtggctgcaggtgatctaggacgtcagtgcaagaatgagtaggaagggaagaagatacagggagtaaggatgctgggttgaagggagcacttttggcaagaccgaattcaggatttttgatagagggcatggagtaattgaatccggaaaggagggagcctcatgctcgggaggagaggagatcctgtagattatgaggactgtaggtggtggtattttgactcaatgttagtttcctgcttacagctaaagtggccgctgctgctagcattctaagacaggttggccatcctctgactgtgttgtctaactgtttagagaggtaggctacaggggcaaaggaaggagggtctcctttctgttgccctaagacaccgagggctattcctcatcttttggcagtatagagtgtgagaggttgggagataccaggtaaggacagagctggtgcagtgacaagagcggtttgaagtttgcagaagttggggagtatgttacgtgagggatttagaggctcactgagagggcctttggctgcttcatagagtgggtgagctaggagggcaaagttgggaatccatattctaaaaaagcctgctagttctaggaaggaaagaacttcgcttttggaggagggcgagggcagattatctattagtgctgctagggcaggggtcatagcccgggtcccaggggaaagttgaactcctaggtaagttactatggaggtggaaagttgagcttcggagggggagactctataccctttgatggagagaaagttttaagagagtaactgtgtgagtttgagagtcttctagagaggggctgcaaaggagaagattgtccacgtattgaaggagacggctagggaaaaggtttaaggaagtgagatcttgagctaaagcttgtccaaagaagtgagggttatctctgaagccttgagggaggacagtccaggttagttgttgtgactggagggtgtcaaggtcggtccaggtgaaagcaaagaggttttgggaatcagggtgcaggggaatagtaaaaaaagtcatcttttaggtcaatagcagtgtagcaggtggtgttggagggaatgagacagagaagtgtagaggggttagggactatgggatgaataggaaagacagcctgactgatggctcggaggtcttgcaggagtcggtatgagccgtctgattttttaaccaggaggatggtggtgttatatgaagaacgtgttggcctaagaagacggcgtgaacagagcttgtttgtgatgggctgtaagcctttttggtgggttagggagatagggtttttggggatgctgggaaatttagagaggtcttttaactggattttgatggggtcgtggtgagtagctagggaaggggtggtggtgtcccaccctattgggtttacaaaagaggtgggaagtgggtactggggagaggggtcaggggctggactcgcatagaggagtaggagggactccggttgagggagggagaaaaaggtgatagaagctttgaatttggccaaaatttgaatttgaatttggctttgaatttggcctaggatgggggtagggcaacgaggcatgataaggaaagagtgtgggaaaacagtatcaaacagagagcaagtaaggggtctggtggcgcgtggacgcaagatgagtccatcagcccccacaactgagacctgagagggatgagtgggtcctgaaaattcaggcaaagctgagtaggtggccccgctatcaatttaaaaagagatcggcttacctgctactcgcagagttaccctgggctccaatgcagtgatggcagatggggccgggggccctgggcccggtcagtcctcagcggctaggctgaggagctgcgggaatgcaagcggttcttcactttttgtcttgttaaaggggtggtggctctgaggagcaggcttgtctgtctgttgagaggacagtcggacttccagtggcctgtctgctggcacactggacaaggactctttggcactcaagggttaggatacacccatgcccagtggccttctttgccacacttaaaacaaggcccggagggttgctgctatcgggtcttttgtgcccttgggtgatacggctgggttgatggacagccgctgctagaagctggtatttagcacgatctctttgggctttatctaatttattttgctcatccctgttattaaagactttgaaagccaagttaaggaggtctcgttgtggggtctgaggggcatcttcagcctttttaagtttgcgccagatgtcgggggcagattgggaaataaaatggatgtaaagaacaatagttccttcccgggaggcgggatcgacacgcgtgtatttttggagagtctctgtaaggcgagaaaggaattgggcagggttttcattggccttttgggagattcctttgagtttttcgaaatttacagccttatgggcagttttgttaaggcctgcagtgaggcaagtaatcatatgattacaggaggtctggcaggggcctgtgggttgatacgcccaggtacgctcttctcagggaactgcagcggcccctactggcctagtaggatcttgccgatggaggtcatcggcatgggcctgggctgcaagccacactctttccttttcttccggaaggagggtagaagacaaaataatatagagatcatgccaagtaagttcataagactgggtgagatatttaaattatttgatgtaagtgtcgggatcggagaagaacctggacgtttctcaatttgggaaacattagagagggaaaatgggacgtggacacggaccatcccttcggcccatgccacttcccggagaagaagcaagggagcaggctgctgggcgtgttgggctcgagaacgagtaaggggtggagatggggaggactcagagtcggaggtggggtggttggagagaaggggagagagaggtagagccggagcggaggcatacggtggggggtcatgctgttccggtggaggattaggatgttgtcgaggaggggagaaatcggtgggatcaaagaaggagaagtcgtccgctggggctattgggatgaggggagcaggaggtgagtcgggtttggagcaggcgaggagaatttgaaaagtacagcaggactggcagagggagggacgactacagagagtaaagaaagcctgaacatgaggaatctcagaccacttcccactgcggtggcaaaagttgtctaagtctctgagcatgtcggaatcgaaagtgccattttcaggccattgggagccatggtctgatttgtattgaggccatgtggtgttacagtaaaagataagccttttagggcagatttctgaacggaggccaagagtatacagattgtgtaggaggcacccaaggggggtagttttaggaggaatagactgagaggctcccatagtgaatggaagggaggggggtagaggaagaagagactgccggtgacgtcccctttcccgcggaacttgtcaggaatagaggaggtaaccaccgtgtcaggcgtccctgaaacggaggaaccagaggcctggaggctggaggaagcccttggcccagcgctgggtctttcggaaatgggagatggacggtcaagagttcagggaatggcaacagtctctttttactcaccctggcggaggctttgatggtggatgaagtcaccagcaatgggagagtctaggagattgtctgggtctttggcaggttcggggaaggggagattggccaggagaggggtgataggggagggagggagagagagagaaaaagagagagagagagagattgatagtgagcgagtcctggccagagtctatcccccttcccgggtttcggcaccagaatgttaggtcatccgagagaaaggaaaaattgacctaaagtcaggcaagcaagtttttattaacctgccaccggccgcttaacagtcagaggaagcagccccaagcttacagattgaggggtttatattggggaagggagtttgagggagttcttcggtatggtcacatcccggggttgtttgctggttaattttgccacatatcaccttgtgatgtttacggtagcagctagatgaacagcaggaacttacagaagggtgtaggtaaagtttgtttatgcttcccacgatctccccttgtgcggtccagatggtttgtaattggtgaggtctgttggctctgccctaacactgaccacagtgccccttctgcccttccagtctgcagcccctctttcctggagtaaatgaactggaccaaatctcaaaaatccacgatgtcatcggcacacccgctcagaagatcctcaccaagttcaaacagtaagtattgtgttctgagagtggatgtggacccactcccctgctaggacctgcagcagggcaagcccctccctgtgcctccctcaaacccctctcaggagctcctttggctgactacaggggttcaagttcacttgagggccagtgagtggctgctcagacagagcccatcactttaagtggtctcaaaggtgagctcttccttgagcatcacagaaagatttgtcacaggctttctgagggctggggagtcaggctgtgttccctgagtaatttaaacaggacttagaagcctttgggtggaaacgttccccaagcacagagcataggtggtgagggctttctgcagccctccacagccctgctggcgggaccgacgcctggaagaggtgttcccggactcttagggtcattctggtgaagctgaggctgggagttgggacttcccagggagggcctgtgggctgaggggcaagtagcacccagcggcccccacatcccagggagggagaaggtggcaaccattttggactcttctttttttgttaaattttatttcattcttctcatgtgggaaggtgatattaatcttttataggaaaggtagttttcttacatttttagcataacagatccccccctttataatagactatttttaaatagatttttttaagagcagttttaggtttccatagagccctgtccccatgtgcacacagcctcccctgtcgtcagcacctgcctcgagtggtgtgtttattatggtcgatgaaccgtggatatctcattactacacagagcccatcatttacatcaggggtccctcttggtggtgcacgttctgtgggctgggacaggtgtagactctgcagtcataaaccattccccaccacacagggcccttagttgtgacagtggaccaccggtgcgctcagtgacagcatgaccatttattatcattgggtttttaatacaggtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggtaggcactctcgtgggttcggtggggcagatgcaggacctggcaaatgagacccatgggcacatggtggggcaaggtactgccccctggagggtccctggttcttgggaatcgcgctctctatcctgaagagtggtcagggcctcttggggcccacaccgtgctgccttctggtgtatcctccccaaaatgaggatgttagcagctccacggcaggagaaagaggggctggctgtccactttgcggttgatgccaaggctacaggtagtaatccttctagaagagcctggtgtgcggcccttgtaaatggtgtgaacaggatgcattctgagatggtagagcactgtggatgtcacctggcgctggaagtacctgctgaatgtgaatctaagacctgtctgccctgaggtcacctaattccggacctctggacactcctgtttgcctaactgtggaggtgacagtttgatctgaaactgcgagtccctgggtaggcagcgcttctgattcatggagccagctctgttcctggcccagagactgtcaggctgagacagaaaagaaaaaaaaaggctcctgattacagctcaggcagaaaagaagagctagtgacaactcacacagtagacaaattggagacaaagaagccagtaggccgtgtgctctgcgggctctcagtggagctgctccattctcttctccttccccgtaggaaaacagagaagcgggctctgggcagccacagaaaagctggctttccggagcaccctgtggcaccggaaccactcagtaacagctgccagatttccaaggagggcagaaagcaggtactaagcgaaatcggagccggagactgcctagctcagccgggactggatgccctcgggtggcctgtgtctctctcaggaggacgccacctgtggaggctgtggcagaccacattgtcagtcgaggcctgaacagcatgcgagttgatggctccatgtgttgggacatcagggaccccagttctatttgctcaagccctttctgccccagtagctaagaattgatgacgaatatcccatgtgagcaggcccagagaggggatgtttgcatgaacttttgtgtctgtcctgatgaccatatgcaggtgccaggttctatgccaaagcaccgtgcagacatcgcccctcagaacggccctggagggaggcgccaagaagatgcaatgctggcccaagtcacccacccagccagtgacaggtctcaagtcactgtctctgcctggctccagatgagcacttcgtcccatcagcagaggttgtgcacattttcggttgagaaatgccagctttgcccctcagtgccttcaccttcccacctaccgtgtggcatcctagcctggtgcagccctgtgtcacctgctggcagggtcacaccagtctcccagttctgggctggcaccccaacagtgtgacagtgtgcccttccatcattcgtctgttcggtcgtccgtacgtcactcgctcctcccagcctttaccgagtgctccctgaccgcttgggagctgggaacccagagctgcagtcaggctgctctccagaaagccaggctcctgtgtcccattggtccctgatttgacagctccacttgaatgtccgaaagacagacttgctgaaaccccttctcctgatctttccccaaacgtgctttttccctgtggcttcccatggccttccctccgagggaggcaactccgtcaactgcccaggccccccgtggacccttccttcatcccacaggggcttcgccttcttgcctcctacatcctcctcaccttgcctaagtcaccacagatggcctcctcactactgtccctgctctgcctccgctccctcctggacagagggtctgcttcaaacccttgatgtcactcctggccggcattcacccaagtccccaccctcagtcacatccgaggtcggcatatttttctctaagggtctgataggaaatattttaggccccgtggccgtggggtgttcgttacactccctgctttgctgcagtgtgaaaggagctggaggcaacacatgaaccacataggggctgcgttccagtagaactggggacactaaaatttgaatttcacataattttcacatgccatgaaacatttttttttcagtcattaaaaataaaaaccaggtgggtgcggtggctcacacctgtaaacccagtgcttagggaggccagggtaggatcacttgaggccaggagtttgagaccagcctgggcaacgtaggcaagaccactgccccaccaccccatctgttttaaaaattagctgggtgtggtgcgtgcctttggtcccagctacttgggaggctgaggcaggaggatcgcctgagcctaggaagctgaggctacagtgagccaagattgcaccactgcactccagtctgtgctacagagcaacaaacaccgtgtctcaaaacaaacaaacaaacaaaaaaccccaaatgtaaaaccatccttagctcacaagccacccaaaaccaggcgacaggcagatcagggtgtgagaccttggagctagagcaggaggcaggaggcgtgggcaccacagcccgcgagccctttgccgcccgcactgctcagcttgcagtcggcattcttcaggttccccctgaaggtttggcctcccccgtgggactctagtgggcagccactcccttggggtgtctgggacctggtggatgtgtcccagtcacatcttatggtcaagaaattgtattaggcaaaagcagtacaaaagagcctctttcgtttttcctaatttccataaagcagaaagcgttttatgtccaactggcctctgttctgtttcaagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttacagtattgcattttaatgttttccgagtccaacatgtgtccttaccagccattcctttattttagcttttgtgggcacacgaggggaattgattttgttgggaagactttggtgtggcttaatttttttttttttttttttttgagacggagtttcgttcattgcccaggttggagtgcaatggcgcaatcttggctcactgcaacctccacctcccgggttcaagggattctcccgcctcagcctctaagtagctgggattacgtgcatgcaccaccacgcccggctgatttttttgtatttttagtagagacggggtttctccatgttggtcaggctggtctcaaaactcccgacttcaggtgatcctcccgcctcggcctcccaaagtgctgggattacaggcatgagccaccgcgcctggcctggtgtggcttaattttcatttgaagaaccattcagaaaggaacacacacaggcgtgtcctcggagccctgtgtgctcctcagtgaccagcctggcgaggtggtgcggggcacagggcaggcctgaagggtctcttctgagcataggcttcaaggtgaccacgttgtcattttagctcctggtgctcagctgtctctggggagtatggagccctgcccctggcctgtcagtgggtgctttgagctgtttgctgagtgccaacaataagttgggcaccttgtgtcctagaaagagaaacctgtttccccatggggatgggaatgggaacattgcaaagaaaccgtggcactggccgggctgctgggcacaagaaaagtcctagtaagtcctcttgtttatctgggaaagtaacttagtaattgggtcttctttcttttttgtcatcttcccaaacttaaagagatatttttgaaaaaggctaaatttcccaggctagtagtgtttaagcctccttgctcccctgttgagacaaatctgtgacacccttccttcacgtgctctccagtggtcctggccccagccccaggccacctgacacgacagcggggccgcaggagatggaccgcgggccacgcggagggagggcaggctggaggaggaggcaagggcggggagcgtggggcagcgagtccgtgggcacaggtgcccactctgcaccacatgggggcaaaggaacccaagaagaagggcagattccagtccggaagtgaggcttgccgtaatgttcagaccggaagtgaggcttgccgtaattttcagaccggaagggaggcttgccataatgttccagagcagggtgcagtgcaggcctttccccgggctccttttaaacccatttgagaccctggtgcagccttgagggctgcccttgctgtaggggaggtgtctgagcaggggggtggtgccgttctgcctctacagagggcctgggagtcccaggggagtcggacgtcaaggccgtgggcagagcccagcagcagggagggctgggggacagaaggctggggagatggctgtagggggggcggcgcgcaggtcacaagagagggacctgtgggtaggggagtggtggctaggagggccatgccctgtcccccggcctggcttcagggtcaggcatgttaacggattgagtgtgtacttgggaaacgtgttactctctttatgtctataaaatatgaagggaaagtctttacagttcttctgcaggcttttttgagaaagcaaatgtggtctgcagatgccggtgcccaggacaccagctgccctgtcctgactgtcacactcctcgtggtgggggcagcggggctgggggccctctggaggcaagaaacagtccctaaagcaagaggaggaccatcccaaggtccaccacttgaggccctcctggtttagttagactcgggcgtaaacgctctgaagcagtgtcgagcccggcacgccagggcccagggcagctgggcctccaggctggaggtgagcaggggaccagagcccagctccacaggccccc

SEQ ID NO: 12736 - DNA, 26852 bp, Human
gcacagctggttctgcgtgaattaaactgtttctctattgcaattcccccatcttgataaattggctcagttgaggcagcgggcgagaagaacccattgggcagttacatcactgtgttgcccaggttcaactcgaactcctgggctcaagcaatcctcctgcctcagcctcccaacatgttgggattacaggcatgagccaccacacccagccaagtctgtccttaatcagggttcctttgggtctcattttcttaagctgcaaaagctattggaccaggtgacattgccaacccctttaagctgctgtaactgtagtttcagctgctggatctgctttcagttagttatgttccccatcactttggacaagtcatcccaactccctggcttgtttttgtaactcgattacagtccagaagcccaagttctaaagtgctgattctgatgagtgtccatgtaccaggcactctgatcccatcatagcatctactacagcctgggaggtctactcaagtgtgcattcatgttaagcactaacaccaattaaatcacttaaataacgtaggtaattatccaatagcacatccagacgtggtggctcacacgtgtaatcccagcactttgagaggccgaggcaggcagatcacctgaggtcaggagttcgagaccagcccggccaaggtggtgaaaccctgtctctactaaaaaatacaaaattagctgggtgtggtggcgcatgcctgtaatcccagctacttgggaagctaaggcaggagaatcgcttgaacccaggagggggaggttgcagtgagctgagattgcaccattgcactccagctcgggtgacagagtgagactctgtctcaaaaaaaaaaaagaaaaaaaaagaaaaaaataataatccaacagcacatctaaacaaggcttaaagttgtaaaataaaattacactgtgtggagggtgtgtgtgtgtgtgtgtgtgtgtgtgtgtgggtgagagagagagagagagagagatgaggtctctgtcatccaggctggagtgcaacagtgccatcatagctcactgcggcctccaattcctggcctcaagcgatcctcccgccttggcctcccaaatagctaagaatagaggcatgtgtcaccacacctttttttttttgtcgttgtttgtttgtttttatgaaacggagtctcgctgtgtagcccaggctggagtgtagtgatgcaatcttggctcactgcaaccttcacctcccagattcaagcgattctcctgcctcagcctccctagtagctggggttacagacacgcaccaccacgctggataaatttttgtaattttagtacacggggtttcaccatgttggccaggctggtcttggactcctgacctcaggtgatccgcctacctcggcctcccacagtgctgggattacaggcgtgagccaccatgcccggctaattcctgtattttcatacttagttgtatttcctattagggccttggatcccgagtataattttgtactcaaatataatttataaataaggccttagcctcccaacaaggtcaaagtagctaaaaagtaagtcctcccaaccactgacattaccagcccccagcccccagtcccagcccagcgggctaacaagggtccggcctcagagagggtctcggggatcccagaggtgggaaagtctccggaggcgcaggccccgctctccaccttcaccagggtcggcggcagcaccacgccgggtcgcgggctggctgtgcgcgccgcggccccacgcccacttccgcttcccgtgctgggggcggtggcagggccggtgggcggtggcggctcccggtctcggctcgggcacggccctgggcaggccgcccgccagccgcaggggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcggtgagcgcagcccggtctggcgcctgcagctgcggggagcgcgccaggcagagggagcggggagcggggcgcggggcgggcctcggtgtgcgggcggcgtgaccttcccgagcggcgggggaagcggccagcgtcgcagcgcacgtgccgcgggactcggagaatctcggggttgtcggcctccttcctgcagtgcccacctggtgggaacttttgtccttgtttgcccccaagtcctgtcatttggctgcggggctccgcgcctcaggggcgccagtgctgggcagcatggagccgcttgtgaatggagacttgctggctgcccaggagtgggcggctgggcaggggcggtgaacgtttagggtccggccaagaaagttggaagtcgtctccctgacctgttccttgcgaggcccgggaggagacgcgcctggccggtccttggcggcgaaactgatttgcatctccacgctttacctaaagcccgggctctggggactggatggcgagctggcctgcggctcctttagccagaagctgggatcttcccgcagcagttcgtgttccctggtggaaaatgcagcctcatctactgactctcccttccaaaaaaaagttattttccccaagggtcgagaaaagtgggtggtcggcactgttgttcctcagttgcaccctggtgtaatttgagagaggggtcaaaggcgctgaaaagattcttttttctattccaagtgctacagcaagctcataaatcaattttaattcatgctgaacagtcttgcctcctccaagccctgtgtcttctccaagccagagctacacataatgtgaattagctgcccactccttctgagtgaatctgttagtacccatcatcgttttctatcctaataattctaatggctatttgtagaatttatttgtttgtttatttttttgagacggagtttcgctcttgttgcccaggctggagtgcaatggggcgatctcggctcaccgcaacctccgcctcctgggttcaagctattctcctccctcagcctcccgagtagctgggattacaagcatggcccaccacgccaggctaattttgtatttttaatagagacaggggtttctcatgttggtcaggctggtctcgaactcccgacctcaggtgatccgcccgccttggcctcccaaagtgctgggattacaggcgtgagccactgtgcctggcctatttgtagaatttaatgtgtttaagtttggctcacctaacagggtttaattcttagggacagatagaatgtaatgtgatgtgactttccttcaaaattaagaaggaagtgtctgtgccaaaagaaataagcgcattgaggtttatctaggaggccacattgtacttgcctctgtctgtctgctcagttgcccccgtttttttctttcccaaaaatatagggttgggtgttttgtgttgcctttggccaggttgaaatactcagattaacggttggtttgtaggcacaggcctgaaaagacaggactttgaactgaatcctctgtcactgacagttgtgtggccttggagaagaccttgtcttgctccaggctttagtttgccttctgggaaaggattaggaccctgataaactttttatttatttatttatttatttatttatttattttattttttattttctattattattattatttttttttttgagacagagtctcactttgttgcccaggctggagtccagtggcacaatctcggctcactgcaacctccacctcccgggttcaagtgaatcttctgcctcagcctcctgagtagctgggactacaggtgtgcatcaccacgctggggtcatttttgtattttaagtagagacagggttacaccatattcgtcaagctggtctcaaactcctgacctcgtgatcctcccacctcagccggcccaaagtgctgggattacaggcgtgagccaccgcgcctggccaggaccctgataaacttttttaggaagataccagatggccaccaccttttcagcctagtgaatggtcctgtctctccagacctatcaacagcatataaatcagtgtcttgcacttctaacttagttgctttattaagtaatgtgccgttgttgccactggttttaaattttttgtgaataaaggaggattattgaagtctcgtcgttggcaagatgcttcaagaggtttaaacaacttctccacggccaatgtttcctgttgacgttcagggtgacattggtgttaggagcgtgcttggtgttcatctctgatccagcacgatgggtcacacggctcctcagtgtgatgaggaataagttgttccttattatttgcaaataagttactaacaccgtttgaaaactgtacaggattggtcgttgagttggatattttagtcaacatttattaagcccatgcctcaacagtagttgacttttgtctaaagagagagaaagaaattctagttttcccaaatgcccaaggctccaaccaaaacatactgaatccagatttccagaggaaagtcctggcaatttggatatttaataagtgctccaggttatcaagtggatttggacacaacggcccaggtgttgtatctcaaagtgtgagtctgtggactggcactgtccgcctcacttgggaactcatcagaacaggcagaacctctggtcctgtccaaggctactgaatcagaggccgcattttatttagcaaggcccccaggctactcctgcacacgtttacatttgaagggctggtggtctgtggtgacgggaagatgtgtgtgacaggaagatgcttgcgcagggccttgttctaagaacacatgatgcttgtgcacggtgtggcgtcccatcagtctgatgtggctatttgtgactgtgtttgttttataatatttttattattcaccttgtacagatgaggactcccagctgtagaggctgaaggagccacactgcaggtagagcaggcattcaccaaggcgtgtgtgatcccagggtgcagctcccacccttggctgcctgggtgctcttttccagacctactgtcttgtgagatccccttaggcacccagcacaggctgctgtctgaatttagaactgagcctgttcaattgatggctcaacataggcctctaaaaaaacaagtctgatgcggtttggtacacctgtggttggcttacttatttggtgttcgttttttcagttttcagaaaggtcagttgaagtgctgctggtggctgtagcattgatacacaggggaggtttttgatctgtgagctttctaggaggcagttgctaagctgcactgataccttgagcccctttcctttggaacagtgtggaccccaggtcatggctcccagaagtttaggttctgtaatttggctgcaggcctagagaacaggatgctgcagacttggactaatggtgaactcttgcctccccccagggatatgtggtgcctgtcataagctccagagagctgccttccacaagaccagcagaagagtgggcaaacatgaaatccaatcctgctatccaggctgccattgacctcacagcgggggctgcaggtacagtcatgtgcctcatcaccatgtttctgtcgttgatggatggtgtatctgatggtggtcccatgagattatactaccatatttttactgtaccttttctgtgtttagatacatttagatacataaataccactgtgttatagttgcctgcaacatccagtacagtaacatcctgtacaggtgtatagcctaggagcaataggccataccgaatagcctaggtgtggagtaggctacgccatctagggtcaggtgtgtatgctctatgatagcacaatgacgaaattgtgtaatgacatgtatttcagaacatgtcccagtcattaagcaatgcctaactataatcccagagaaaacccagttctctctattcctcaactactctctaaatgagatcaaatgaaagtggtatgaaaatactacctttctccctccagtactttacctttgggattaatccatttgatggaagtttagtattgttcagagagtagcagaagctagaggagtgtccgttattgttaacaccttgtcagtcagggtgatgggtggaaggtgcccagtacagctggaaaacagctcagaggtgaagccacgtgtccattgtcacctggctgggatatgcaggtgatgtggttcttcacttcaagcctggcagtcttcagagcccttgttgtgcaaaaataacaccatagcatctcctgggaaacaccacttactgtccctgctagtgttgggaaagaaaggaggacactcttagaaatgtctttaaaaggctgggtgcagtggctcacgcctgtaatcccagcactttaggaggccaaggcgggcagatcacctgaggtgaggagttcaagaccagcttgaccaacatggagaaaccccgtctcttctaaaaatacaaaattatccaggcgtggtggtgcatgcctgtaatcttagctacttgggaggctgaggcaggagaatcgcttgaaccccggaggcggaggttgtggtgagccaagatcgcgccattgcactccagcctgggcaacaacagtgaaactctgtctcaaaaaaaaaaaaaaaagacatgtctctgaaaatgagactgataatggactgtgtcttagagccgtgaaagttgtaggatttgctgggaatgtcagctaacctgagcctaggggcctgagcccaatagcctgaggctcccccagcacagggaggtgctacctgtgataaggggtagtgctggcaccatgcaggctactccttagaaagatcagcttgaacatgcaggaagagcaggaccctcaggctgggaaacagggcggaatgggaagtgcatggtggtaatttggttctccagagtccagaagtaggaggagtggctggaatactgattgcccaaaggaaaaccctggactaccctgggctcccgcaggattctcatagtagttgcagctccctggagtggggaggccagcgggggtgttgcccagtgctgtccttatccagcacaccccccacccccaccaccagcagatgagtatggtcatgaatatggtcacctcatcagtcatttgctcaattgtgaaaaagaaattgttcagagaagagcaaagtgtttttccatgagccaaaggtcagccagggtatgctaatgaggaagactggagagagcgcgtcaccgtcaccgagcctaatgaggagcactgggcaagggcacttctcccagggcagaacccacaaggagcgtcccagccccagatgcccagggaacggaaggccagtgggggtctgcccagtagtctcttgcccactgcgtgcctttaggctacagcctcccaagcccctttccccctcccctcccccatgccacactggggaggacgctgaccctgagaatggtgcaaacatctgcctgccccaggccgtctctcaccagcgagtgaatgctcttgggctcagttctgtttctgcagaaggagggtgtttagccacatatagtctcagcttttgacattttatgtctttcagtcaatctgtcaaagatctagaacctatggtgatagaatttaaaagtttaccttttcctatttatgtgcatacaggtatttgggtaccacatttataatttacaagttagtttgaaagatagaaattgcaacagtatggttgggagcctggtatgtaaggcatttgctggtgggcatgttttgaacatgtattgatcccttatgtatactgacacattgtccccatcactgttggacaggtatttccccctgtgctggcgacacagggacgcccctcaccgaggtagagatgctgtgggtagtcttaacttctgaggacaacgaagcccattcctggggggacaggatagggagggggagcgagacatggtctataggttgggggctgggcagaggaggtgcctagcagtgacacagaaacctctgttctgctgtgaggcctatggaatgcaaatggaacccacttttgaggatcttggagtcttggagtgctggagctagagagacctttagacattgttggctccaatgctcgttggatatgtagaaaaaggcccacagaggagcagtagatttgttcaaggttacacagcaagatggtgtgaagacagggcaggactgtgatccctgggtcccttgtctggtgtcgttgctgtctctgctttagtactccgtaatgcatctgcagcacactggaggggagggttagtttggagcctttgggccctgcctttctggatgtggaacttgctgggctttgggaattttctgccagccattgataggagcagaggacctgttgtgttttgtggcagaggtcacccacggaagcgatccatctgtaagcacagagccagctgcagcccgaggtgatgtggatggagcttaaatgtggtgttgtgtgtgtctcttcttttcctttaaacaacgttttccccaccacacaggtttttagccagcttatctactctaaagtgctgggaagttcccatttccctatctgcaatggctgtaagacatctagatccctaaacagctaggataaaggaggatttcaagaacttaggtgattaggtaattattgaaatgggggtgcgtggatcccaaaagttaaatagccttaaagagaaacttggtaccactttaatagtcattcagcaactctaaaacaatgcagtcactactttgactactgttgcagtttaccttgtttagcatagttggagaatgtggcatttcagatcattgaagtttatcttctcaaatgccaaaattaaaaacaaccccaaaccttttttgattggagtttcttgaaaatgatattcttccctgccctgttaaacctttacgatggcctccagaggggtttgagggtctcacctctgcttggtgggcctggtcctgtggtgtgagtctgcttctctctcctcacctctctgccttcttcagagctgtcccttccctgagacactgtccctgccctgatagatttcctctgtatctcgtgatttactgactctatgtcaaggactgaaaatccaaaccaccacccttagtaaagtgttaggtatgacataatctgagtgcctttcctgcggaataagatgcttggctggccaccatatcgccgaaagaatgttgttatttgtcttttaaggagaataagatcagaagtctgatttctaggcaagtggagaaatataatatttattcatggctttatggacttgatcgatctttgagaacctactaggtgtcagtctctgtggttggtactggtgttcagaacagtcttctctcacttgagggcacagtgagcgccgtgaccatatcatttgtggtaaattacacgggaagttagcttacccttgcagaggacgggagacagttgttgctagcatttgtacattcattagcctcccccttctccctgttggaaatgtaactgtcccagctacacagcaaatgtgtattctagtaacctgtgatgcctgaactgttcaagatgatcaagttaaaatatgaatgtgctgaattaaatgctttattcagcttatctgcatctaggctctctgaattacgcacccacttaaaacattctgtcaccttttctcttggaataattaaattattttaatgtaattcagatttctttttatcctagcccagcattacctgggagagaatgactcaggattaatcataataaaatcatattaaattatattccactaattcagaattggggataatttggcaattaaaggcggaagtgtgtcattcctctcctgtaagaaatgaacagtaatgatgggctcacagagatcatattgcttgttgcttaaaaaagagatcaagcagttttcagactctggaattgttggcttatttgccaataaataattgagaattattcttaatgtcccttcccccaactccactttccagagtttagatggaataactgtgtataacatcaaattcaggaagttgcatttcttaaatattttctgtaagccttcttttgcattttgatgaagctttaagagctcctctcaggtccagaaggagacggtaaacactaaccactggcagttcccacgacgccaaccctactacagggtgtggggatgttgtagggtggttacagttcattcttctcttctgtttagaatttttactaaaatgatttcacgtggctgggcatggtggcttatgcctcccagcattttgggaggccaaggcaggaggatcatttgaggccaggagttagagaccaccctggccaacatggtgaaaccccatctctatgaaaagtacaaaaattagccaggcgtggtggtgggtgcctgtaatcccagctacttgggaagctgaggcacaggaattccttgaacctgggaggtggagtttgcagtgagctgagattgcaccactgcactccagcctgggtgacagagcaagacaccatctcaaaaaaaaaaaaaaaattattttgtgcaatgtagactctgctgtatttaatcttatagaagtatataaataaaggatttaagcataaataaatttcagttcattctctatttacatacacgttattaatcggtagagctcaaattaaagaggtttttctatagaatgaaatatttagctctttggggattaattagccagactccttgtttcctttccgtggtgccgggtctgatcagtcccactgggcattaggcaaagtgagcgatgaagtcttcccaggtctcccctccctttctgtggtttccgtttcttgtgcacacagtagctgctgtttactgattacgtagccggtgctgtgccaagcctgtctcctccatttttatttaatcctcacgctaaccctgtgaggtggcatggatgaggagctgaggctcagaagttacatggcttgtccaggatctcacagcaaagccatagtccctctgaccctattgcccaggctcctacatattcactgcactgtttgtcgctgttgaacacatgtctgtctctctcccctgcctggcatgagctccttcagggtgggacttagatgccaggcacatcaaggacctgctctaaattgtttactggacatggctggaaggttttggaggaaaagaggttgaaatgaaccgaagcaggggtaagttctggggtaggctgcctgtgccttccttccatggataatggaactgtagcctcgtactagagcagtcatctgtcctgattgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgaggtgagtcaaggacacacactttttttatttgtttaaaaaaaccccacaaaactggcaagacatggtggctcatgcctgtaatcccagcactttgggaggcaaaggcaggaaaatggcttgaggctgagagttcaaaaccagcctgggcaacacagcaagatcctcatctctacaaaaaaataaaaattaaaaaaaatctactgttgtatggtcacaattttactggtgccttatgtggaagaacatttccttttttaaaaataactgctttccttttatttatgaagttatacattgtcatcatataaaacttagaaaccacatatgcacaccacagaggagacctgctcatcatccaccactgagaatgaaccgcccttctgtttcagttttctccaggagaatgctgttcagatgcagctggcagtgctacctctcgtcagcagacatgctgcactgaaactgtagatgctgcttatgatccaagatttagcttttctttcattagcaaaaagcagagtattggaagaggttgtctgagccagatgaacttgaggagttttaggaagggtcggaaatgtctgcgaagatgcaagggaacccacctttctctgtccaaatcttcccaaaacatcagactttgcctctttgttggtcttgccttgggtatttattatatagagactaaacagaatttggaaaccactgggatgtttagctatccctgctttgaatgttgatttattttataccacttaaaattattatataagcttcaagattgcaaagggcagtcttagttatttcagtaggagtttgaaacctgattgcagctgcaggtcccacacaactgaattcggtttcttgtgcacagcactgttctctggaggtgcctggaggtctgaaggtgtgcccttttatagacaggaattccaccatgatgggtagagcttgttttttaaaaaggcttgggactagatacgattgcccaagaagacagtgtagacagcgaggagggctgagcatgaatgggatgagcctccagcacagaaagggcaggcaggaaggcagtaaagaaacaagcagggcacaaaccaggagagtatggcatgccatgatggagactgaacagaagcaaaaactacaggcaactgtagttttgttccctgttgaaggagagacactctattagagaagacctggaattcagttcagtttccttagcaaaggacaaaatggggagagaagacagggaaacagtaagcagccacgtgagattctggggaagacctgtgtcttctgagcaaagtagcccctccagccacaggatagacagtgacttctgtcttgcatgagtgaaaccactggatctggctctgcccgcccctccactttcttgcttccttagcctgtgaacaaagtgaaggacaggtaagagcatattgcttttctgctgagaacaatctaataccttacagctgcattttcccacactgctttcagaacattgaattgctgggtgtccttaagaaagggttgggaaattacgtcacagtgtctctctcgtgaagaatcactctgggtacatttatttcatatagtgtatgtgttatttagttcattaaagatgcgtaaggctgggcacagtggctcacgcctgtagtcccagcactttgagaggctgaggtgggcagattacttgagcccaggagtttgagaccaacctgagcaacatggcaaaaccccgtcactacaaaaaatacaaaacttagctgagtgtggtagcacatgtctgtggtcccagctaccagggaggctgaggtgggaggattgcttgagctcaggaggcagaggttgcagtgagatgatgccactgcactccagcctgggcaacagagcgagactgtgtctctcaaaaaaaaaaaaaaaagaaaagaaaagaaaccatcctgattaaccttgtctaatccagcactcatcttttttgagcttgggcccgttttttttttccatcctgaggaacagtgtttgcctcttacctgttggggaaatgctctcttagagtctacaaagctctgacatgtatatcatgtctctatagccctcaccgtgatcctgtgagaagagcaaggcagatgttacctctcttagggatggaaaactgaggtgccgatgttgacctgctcaaggtcaccccgctaaggacttgaaattgtgtcctctgagctcctgcccagtctcctttccatcagaccacagttgggggtctggaatattttataagggtcagttctagagagaagattaatcaggagcagtgaaaggaaagaactgcttgtgagagcctgtggtgaatttctgcaatcacattgtaaatatttgtctgttcccggtttcaacatgacccagaatgttctagtttgacgtttggctggacagggtcttacatagcaggagtgctcaggtacatgtttgttgaacatatgacaaatggatgattcttacaaaatcccatcctatacctattactgtttcaattccagttctacacattcatactacatgcagaaccaggggcccatgcacctccttctgtgcactggtcaatgaaagtatttattggaaagccaaagtccactgcatatctgatttgactgtgtccttgcactataataatgtgcttggtgttcgttcagatgtctgagccattattatatcttaaactcaatagacttctacatttattgactgccacctttgtcctggcaaacttggcagatcctggttaatgctcctaattgactattgcctgtcaacaggttaacagagagtccctgagggaggccaactgtggatctgcaggctggctgcaagacaacagaaaccattttaagcttcagttctaacaagctgctaaggagtgaagtgggggaaaggagtggactgaacagcattggatggtttccacaccccataaaagcgtgtgcaagtacatttgtgtacctggttctcctttgctaatggttttaggcttaattctctaacatcaaaaggaagtccttactgcaaacagtgtcttcctactgaaagaaagctccactctaagccaagtcttctgaaagagttgcctctggccatggtacagaagctagaccaccagggactagcaaaccagggccaagactggtgccaccttgattttatactaatctttaacactggaaaaacttgagtacccctgaatatggtaagtccatctgtgctttttttttttttttgagacggagtctcactctgtcgcccaggctggagtgcagtggcgcaatcttaactcattgcaacctcgcctccccagttcaagcaattctcctgcctcagcctcccgagtagctgggactacaggcgcccaccaccatgcccagctaatttttgtattttagtagagatggggtttcaccatgttggccaggatggtcttgatctcttgacctcgtgatctgcccacctcggcctcccaaagtgctgggattacaggtgtgagccaccgtgccctgccccatctgtgcttttgctcacagtttggagaaaaattgttaggggattatatctctacctgagtagttagctgaggagattcccacccacccttaggggtttttggaaatctctgagggtgatcttggctgtccagtgagagcatgatgctggcattgaatgggtgtcagggaaccagttcagtccttcctgcccaatgaaggattgtcctacccccaaatgccagtcatgatcccatgacacaacactcttctagggctggaagggatcttctatcccaactcccatgaaccaggaactcgcagagaagcctttcttctgaaacacttctcagacttttccccgtattcgttttttttttttttgaaagagtctcactgtgtcacccaggctggagtgcagtggcatgatcttggctcactgcaacctctgcctccctggttcaagcgcttcttgtgcctcagccaccagagtagctgggattacaggcgtgcaccaccaggcatggctaatttttagtagagacggggttttgccatgttggccaggcctcaactgatctgcctgccttggcctcccaaagtgctggaattacaggtatgagccaccacgcctggcctccccatattcttgaactcttactggattccagtttcacaaccctgctggtgacatttggctgctggtactaaatccatacatgaggtgaatgcttctgttttgtatttgtgcattcatccctctgcctagtttagatttccagtttagcaatttcacctaataccattgagcttgcagacttgtactggcttcacccactcctgtggcaccattttaccctcgtctgtgttgctgaggtggtaggtcaccagttgaactggaaaatctttttgtgatgcagcaacttttggttaaacgttttttctgggttttcatctgtggcagttacattgcacatctggttgctccaggttggattgtgggcatgtggggataggcttagaacctagatttatttaaaacttagggcagacacactgaagtattaatagtgcatgtttttcagtgggggactatgggcaatattttcctcctttcctttaggtttttttgtggcgttttattttgtcatgtcacgatgtatcttggctttggctgttgtaacagaatactacagattgagtggcttaaacaaacatttctcacagttctatggtctgaaaagtctaatatcaaggttccagcagatctggtgtctgatgagggcttgttcttaatttgaacatagccgtcttctcactgtgtcctcatatggcagagagtgagcgagctctctggcctcttcttctaagggactaatcccatcacaatggccctatcctcatgacctcatctacacctgattactcccaaaggccccatctcctaacaccatcaccttggggggataaaattcagtccatagcgctgtgtgtaatcaaaagaatatggttgttgcagtcaggaagacctgggttcacatcctagcactgccacttagtagctgtgtgactggccacattatgtcatctctaagtgtcacttcccatagggaactggggtgctgctgtctgcttcatagggttgtgggatccttagatgaaacagcacatgcaagtttccttcctttcatcatttttttttttttttgagacggagtctcactctgttgcccaggctagagtacagtggcacaatctcaggtcactgcaagctctgcctcctgggttcacgccattctcctgcctcagcctcctgagtagctgggactacaggcacccaccactacgcccggctaatttttttttttttttgtatttttagtagagacagggtttcaccatgttagccaggatggtctcgatctcctgacttcgtgatccgcccgcctcggcctcccagagtgctgggattacagttgtgagccacggcgcccggccctttcatcatttttttagacatggaggtctctctttgtttcccaagctggaatgcagtggctgttcacagatgcagtcatagcactgtagcctagaacacatgggctcaagtgatcctcccacctcagtctcctaagtagctgtaatcacaggttcatgccctcacgcccggctccttaccctgctttatcaccaaagtgctgtctgtgtggtgagtgccaaaggaatgaagaaactgaggggtaactgtctgcttgtgtgctttcagtgatctgcagaatgcagccgccggttccttcgcctctgcctttgctgcactggtgctctgccccacggagctcgtgaagtgccggctgcagaccatgtatgagatggagacatcagggaagatagccaagagccagaagtaagcaccacttgggcacaaacgtcaggtctctattgccctagtgtattggatgatttttcattttacattgtactaaagtggcagatgtggaagccaatttatctactccaaaatattgtttctagaatgctttcccctatcagagattttctgaaaggattggctgtgatgggacccaccacccactgcataaaaagtcttagacagatatttaataccccagaactggagaagccaggagcttaacaccctttttggcctcttggaaacataaggcatgatcttcagccatttttggaggtacataatgggtggcttttgaactttgccttagacctgagccttcataagtgccaatttggattctgagatgaatatttgatccccacttcaggtttcgtatgggtattcaggctgattgacccagatcctagaggtaactattcttaccccacttatccccagtccttcaagtgtacctgcagatggcccaagttctgagaacattaatcaatacttttataagcatagctactcttcagtgattaaatcactctctagctcactcttgaaaacacattctcattatcctttgagagtactgtttcatacacaatttgatttacttgaattggaaagcaatttattatccttattaattgcaaaacttgcttacttatcttgacatctggctgagttctgaccaaggatattgctgtggttaactcaaagcctataaatctgctgggaaaaagcagtagataaattgaccattttcaaggatcagtccccactcagtgagaatggggtttggaaaagtgccctattttctgcacccttgagattcattacagccaacttgaatctaatattcattgcctagaagtccaagagtgtaagtctttaaaactttttattgaaataatacacatagtatcatgaatgcacattgaagtcacagtatgcagctctataaatagtgacacaatttatgtgcctttgtaacctgtgtccagattaacaaatagaacattaacaacacccagaaagctgccctcatgttccttggaagtaattcaaggtaattaaaagatagtaatagttatatccaaaggacttaggcagatcaacaccttgaattatcagttgactttgtatttgaggtctagcagtgttcacacaaggcatggtatggtagcttggggctaagactcggattggaagggaggttaattgtgttgagctggattactttgttacattccatgtagcagtgctgcaggaagggctggctgatggggaatacctgacagtgtcttctgaagctctcagaaggaaaatagtttttaaatgtctgtggcctttattaccttgggacttgatccttcatctgtccaagccaagtctccttcttgctgagaacaaagtgaggagagagggattcactaagttgcactgagtatgtgatttcttggcctgttcttagcagggataaacctgccctggttgccctcaatcatgaaggggagtcagacaaagagtgtcctgtgttctggctgctacaggagcagggctgcttagaagaaattctcccgcatccctggtgctctgagaaataaattcttggtgcttctgcataacaggagctatataacttgttctcagaatttgtcttgtcttcagacaacatttactccttcactcatttctctgcactaaaaacagatcctgtaaacacctgaacaaatttcccaaaaacacaccagaaagattgaggaaataggaatcacagcgataagggactgggcaatacaatgccattttatgtttgctgagtttagataattccttactgtaaataaatttccttcccacagaaggatgccgttgagtcttaattcctggctcttcatttacaaaatcagcttcttccttactagtgcttgatcagatctgttaattggttgcaaatgcccttgtcttttcttccttcccacctgctgtaaccgtgctatctctctgtgtctcctcccagtacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggtaaatgtgtttgcattgacagcagtggggtgtgatggtgtttgctccctgcaggtatggtttctgtggattctctgccctttgtgctctcctccccacattggtggctccatctggcacagggaagcttctggatgcctgaaggtaacatggtggcaggcagttgatagcacccaccctccaggcctgataatttccttaggacagggcctgaagcagtacatcccaaactttcttactggaataaagttttttaatttttctggatctattttaggggagaagaaatccagaaattactttcccaattggggaatcacctataaataatcttgaaataaggttaaaacttggaaatcttaatagtgttttgagagcagtgaaaaccatagttctttgtagcttatcgtgtttagctggttggtacaactacatgcaatgtttggctcacataagtgagtttttcttaccatctccctcagtgtgtgttgaatctattctgtggttagtcaagctcccagacttaattgctatgtttaataaaaacaattttggcttttaatgataaatgaagaatcagggctattaaaatacttaagagtgagaaagttgaaaaaagacatagattgtgtttggcctgtcttctccccactgtagggggttgccactcagctggaggcctgctggttcgtgtgggccagcccttgacacctcagtgaccaagcgaaatataaccctcactaaggcttcttgtacttggcaagacccaggagtagacctgggctaccaaacaaaaccctgtgttcttagagcttgggaacaagagctttgacagttttcctcaaagaattgtattctgtagcattagcatttttattttcatctacctgcagccattactacattgacctctggaaatgtcacatcagctgttcttgagacaaaataccatttgctattttttttttctctaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggtgagtaaatacctgtttttcaagcatctatatacatcttaaaatctgagatacgggccgggcgtggtggctcatgcctgtgatcccagcactttgggaggctgaggcaggtggatcatgaggtcaggagatcgagaccatcctggctaacacggtgaaaccccgtctctactaaaaataccaaaaaaatcagccaggcgtggtggcaggcacctgtagtcccagctactcgggaggctgagacaggagaatggcgtcaacctgggaggcggagcttgcagtgagctgagattgcaccactgcactccagcctgggcaacagcgagactctgtctcaaaaaaaaaaaaaaaaaaaaaatctgagatatgaactctgttttgattgtaaaaagaaagaggacagtaacacagaaactttgtgtcccaaatagaggacagataccttgtctgttactcatagtaatcctcccttacatttgtataacatgtaaagttttacaaagtacttacacctcccttatctaattcaatcttcataaccaccctgggcagtactaatactatacacaggtctccaacttcaaggttggtgttcctgccactgcccaggtgaagctgcaaagctgctgccacctctatctccatggttgcctctgtctggccatctcaggcctcagctctgccccatccatatactaagagttaaccaagcgtggaattggggtatgttacctgagcatcagtcagttttgccaggagacctgatacttgtccttgtttccgttagtctatttaggaaaagctgggaatgcatccttctatgacttgttggtttttagcactgttgtctgggtttgcatgtgtaaatatacctatgctatgcagctgcgtgggtatccccaaaggagggattgttgcagtctttgaccgcccttttatttgctaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaagtacagtttggtaccttgtttatttcaaatatcagaaaaacccagaggtgatcatttctcatgaagatgcttataaatggttgcttaacccattctagatgtagggtctgcttaatgtgtgtacttttctaagtggttgattattttttatttttttgatacggagtctcactctgtcacccagactggagtgcagtggcacgatctcggctcactgcaacctccgtctcctgggttcaagcgattctctcacctcagcctcctgagtagctgggattacaggtacgcgccaccatgtccagctaattttttttggtattttttgtagagacgaggtttcaccatgttgtccaggttggtctcgaactcctgacctcaagtgatccgcccacctcggcctcccaaagtgctgggattactggtgtgagccaccatgcccagccagtggttgaattttttaaaaagtgttcatggggtgcttgaaaactaaaatatccttctagatttgtaagacagtatacctgcatactggtgtggcttccacacttgagtaaaagcttcagagtaggtatcctagatttccccaagatgctctactcttaaaatagtgccattcattttctaggtgggatcatattccacgctgactatattgctaggggtggcccagagggtcaggcctttgggaaatagcatggcctttaccagcttcccttctctcccaaagaacttcccttcttgggctttagattgaggaaggggctgagtggtaggcggtgctgctgtgctctgatgaagacccatgtggctagcaacagcgcttaccttttgtctctgggtcctggcctggggccatcaatccactttgggccactcactgtctgctctgcctccaccaatcagaaacccttccaaggaacagtgagagccaaagccaagagaagccttcttccctgtttggtgattgtgtgacagtgggtgaacctctctcagagagaactagaaagaactcagtgcttgtactccacagtgagtaatgtcaggtctgacccatcctgaagcctgtcttgccatgcttttacagtgttggaggcttctacatttggtacttgcagtcagtaagtcttaatgatgactgtatatgtgatatgagtttataaagcaatggaacataagaaaagcaattgtaggccaggcgcagtggctcacgcctataatcccagcactttgggaggctgaggcgggcgggtcacaaggtcaggagttcgagaacagcctgaccaacatggtgaaaccccatctctactaaaaatacaaaaattagctgggcgtggtggcacgtgcctgtaatcccagctactcaggaggctgaggcaggagaatcgcttgaacccgggaggcagaggttgcagtgaactgagattgtgccactgcactccagactgggtgacacagcgagacttcatctcaaaaaaaaaaagaaaagaaaagcaattgtacttcactatgccatatgtatgtattcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcattaaattatttacttaatatttgagtctgatgaatttcattgaagttctttacatccatgttgggaaacaactgtcaggaatgttaaagagttatgtatagtagtgtttcaaggcagtggttttattgcaacaagcattgttttctgtcagcaagacacctcatgtaaaataatttcaccataggtaaggtgacaaaaatatttctatgctctgaagttatggaacttggctcactagaattactttctccctccacctctttccctctattttaaaaaatagttaaactgtctgcttttaagttttggatgattccattccaagttactaaattctacttaagaaaacaagtatctgaagtgccaagatggctgactagaagcagctagtgtgcgcagccttcacaagaggagacagagtggtgagtgaacacaagctcttcaggttgatcatccagcaggctgtgttgggattcatcagggaagcagtggtgagtcatggagagcataggggagtaaggaaggacagccgtccacctgggattggtgcagagcaaggggaggctccctacagcagggaaagtgtgagtgagtgaaggctcctggggactcacacttctgccatggaccttggcaatccccaggcacaggagatcctccatgactccacctgccctcccccccccccccccacccacacacacacacaccctggggttctagactgacacagagagctgcttggagtctgggcagagccactgctcaagccaatgtggatccctgagctgctatggccccggctgccatagtccggccaacaaggtaggccaggctctctcgtgtgcccctaggataggggccatatccatggtgctgaggagcggacagattgcaggcctcacttccactgcaccttgccaggcaaggcccactggcctgggcctccatcgcagccatgctacccactacctgagcactccagctagtcacagccctcatttctctgggatggagctcccagaagtaaccaacaggccctctgccctgccgtagcctgtgcccctgctgccctcaggctggagagggagcaaaaagcccaatagcggtcatgggcctccagcctgctatagctgacatatggaaaggcagcccagactgttttccacgagtccctggccctgctgctcactgggcagggtgcctcctggcttgggcccccagcacagctcctgcctgatcagttggtggtggctctgtgtttctctgggatggaggtcccagaaacaactgacaggcctctgccattgctgccaccacagtacctgcccttgcttcccccaggctagggagggaacaaagggcctgattactttgtcagcattctacagagaggaggccagactgtcttccgggctgagttgcctgacctccctgctcttcaggcagggcccccagcttgggcccagcagcacagctgccccaaccctaagctgaggagggaacaaaaagcctgagcttgcactggggctgcagtgtggcagcttggaagtgccaaggcgagatctgtagcaggcactagagcaggagaggagcccacactctcagagtactgagagtgctgagttacatgaacctgtgggctaccacagcagtgggcatgcctccctatgcagggccagctgtctggaaaagggatggcctatctccctacctcagcctctgcctgagggagtgcacctgacaaaagaaacacgggcacagtgccattggttggaaggggctcccccagggcccaggagcggacctgatgaggtggtcacctctcttcccaccgcaccacagagcacagccagaaacaccaggaaatccaaaggagcaaagtggctaagatctgtctaccgaccattactcctaagcgccatctactggaattcagtagatgtagcaaactacaaaaatagtttgctaatataccttcctgtaaaaccaagctaagaat

SEQ ID NO: 12737 - DNA, 104428 bp, Human
tgtaagtcttaggtcagaattggatctgattgtataagaaaaaaaatcttatgtaaagtgagatgtggacgaaggaatcaacttgtgcactgtggactaactggagaagcaaaagataaaattattaaaataatagcccaagaggaaagtataaaataggaaggaaaataagtagggccccttgtttgagattatccttaccatctgggttgtaaaacatttgattctaattccagaaacttgataccagaaataacttattaccagggacatatgctgaagaattgtcaggaatgacaaagtgtttacttgtttttaatatctgtatcacaaaatgataaagctgataaaccatacagtgatgtgaaggagtgagtcatagcttaatactttatgacacatatatttatgctgtatcttttacaccccaattcttcccttttcaccctataaaaggtcagagaccactgctgataagcaaagaatccttcaaaatctctcctggctgggcgtggtggctcatgcctgtaatcctagcactttggggcgggtggactgcctgagctcaggagttcaagaccagcctgagcaactcggtgaaaccctgtctctactaaaatacaaaaattagctgggtgtggcggcgtgcgcctgttatcccacctactcaggaggctgaggcaggagaattactagaacccaggaggcggaggttgcagtgagctgagattgcgccactgcactccagcctgggtgacagagcgagactctgcctctaaaaaataataataaaaaaaaaatctctcctctctggaggacagtactgaacatatgcagggtcttttcagtttataatctaatccgtagactgcacagtgctagcaattctgttcacagttatcttttcacaacagtcatcttggaagtacttgattcttaccttgatttataatatttattgagctcacattacagatcattactgtccagtcacattgataaaaccatgtcacttggaagctccagttcaccactcctagctgtgtgaccttaagcagtttacttaatcttactagtttactcatctttaaaatgggaataataatagtgtctgtcacatagccaatatatttgaaagcggtattgcaaggatatagaacagcttgaatgttaagcactttcaaatactaagtgaggtgatcacttttgtaattcaaatggaaatagaataaatgtcaatgaattaatgatctgtatcaggaggcagcataaagaatttgaattggagggttttgggtaactggtaaaatggtggttatctttttttaaaagaaaaaccctctttggggattcctttgtacagatgatctcttaatttgccatctttaatcctcacattattaaaggctacattgattagaaggaaatacagcttccttgtaggtttttagctttttggcttgtttttggggagatggttgctgctatttggagaaagggagaaaggcagaaattttaaccttagtctgataccttttctacaagctggccaccaggtcctttttaggtttttctgaaacctgaccaagtttaattgtcatggcataaaaacttggtattgaaggagttaaagggtctcccacacccctttgcatgaatcgttcttttgtgtacacagctgcagtggcagcacgggtcggaaaggaaatggttagaggaagagctggttttcagacaaggcgagtctgcgaggggggctgcagggtggcctggggttttacatgccagatgtaggcctgccccggtgcctgcctggagctgctggcgtggtcacgccgcggccctgtgcgaattgaggcgaggtgatgagttagcgggttgccatggcaacaggctggccacgtgaccagggtgctgctgccggcgctctgacgtcagctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacaggtaatggggctggcacgagagcagcgccggggaccgccgtgagggcgcgcggaaatccagcccgttatataatggagcagacactgcctgcgacccctgctgcaggcatgcatttgtgaaggcggttgtgattatttggtatctgtttccatgtgtcatgttgggtttgcattgaggctccgcgactgcagatggaaagcattttgtgaataggtttgctgccttcgaggggtctccctccatctctttccttccacactgataaaaatgcatgctgttttcccccgctgtccaaagggagacaggcagtagcacttcctttcctccttcccttttagattttaaaggagccattaggtagcagtgccaaaaggcagaaaacgggagggtggggagaaaaacgtttgcgcttaacctggagagtgtgcaggaaagatggaatcctctagattaagctgcagtctgtgatgttaaaccgccagattgatggagctttgtaagaattctgctcgctgattggtgcagggattgacagcagaggtgatagtgtcagacattcaccaaaattttctccatagaaccctaggtttattagaaagagactggactgcaaaggacttgaaaaaaactgggcgctgttatgcattttctaaggagtttatggccaccgcttgggtgggggagcctttccttcttatttacagtaggaaggtgattcctggtcttttgctgaggtctgttttgaggatgggactgatcttggtcattgtattgtgagccttttgattaatgagttggcctgtacggttggcatcatttttacattaacatatctggcaatatgttccagtagataagctcattaaaattgtttgcattgtttgataaggataacaatgtaatggagaatgcagctagagtcttatgcagctcaaggccagacttgaagggagactgatagcttcggtcatatttcctctgaagttcttttgtactggggtagttatttttaaatgttaccttgataaacgctaacaatgcttttgctttgaggcagagcacacatacctctaaagcgcatcctctcagctgatgagcaacaggaaataactctttttttcctttttagagccgtcatctaaacattcagatggtattatgggtagaatattgtgtgtgtaaatgttgcatatcacaaaatagaaccagaaagtaccctacttcctttctctttggccaaagaaatgcagtatttgttgactcaaaaaaaaaaaaattataagcaacctttgccctgtcatctctggcagttacataaatacttggagttaattttggctgtgcccatgaggtcaccaaaatctcatgccttatggttccaactaatgtgttgatatggcattcttacagatttcaagtgcttgttattcacttaatgtaaatcaaaattcctccacaacttctggagatatcctttcagagaccctgtgattggaaatttgggcctcttctcctcttactcctccacctttttcctctgtgaccatcccaaagcctaaaaatagaatttaaaaacaaaaaacttgaagtgattttaaatctcactagtttgaactttttttgtagaaaataaatttgaagccttcattttctaaatgatttaatccctgctgtgtaggtagcagttgcttttaagacagaattcgaattttaccccatgggccaaaggaagttgcctggttgggttttattactcatgtaaactaacttgaaacggcagtggaaaatcatttgacagaaaggttaaatgttacgttttggtgacagattattgctttaaaatgaaattttatttacctctttaattcaacccaggctattatttgcgtttcctaaattatttgcagtttgctttctgagtccctataatggcattcaaaattatgtaaaaaacaaaactgaattttaataaagatcttactgaacaaattcttaagtccctaagagcatcactgcatttgtatttgatataataggattactggatgatatagcgagaggtgtcataggctaaatgaagaaggaagcctctcaaattgcatttgtcttgtgttatacaaagggtgcacatggagacagacacattcgatgtttttcttcttctgtttttctttcaaagtggatgtccagtgtaataattaccacttatttttttggaggggcataggaaaaggaaaaatgtgacacatttttctatccaggaagcattccatcattattttggcatcccaagactggaatattatagccatttaattgctgaggaaacttggaaggcaatttgaaagcgaagagtagagatttaaccaaataaaagttttgccttggctataggtttggtatggccctcaacaatgaagatgtgcctggaagttctgggtggagtcccttatggtggggttggggttgagtgagcccagttccctggcaagatcagagggaattctttccctggatcctttattgacttctaggtaggcccccgaacaggtctttatcttaggctttcttttcttttctttttttgcgacagaattttgctcttgttgcccaggctggcatgtaatggcgcaatctctgctcactgcaacctccgcctcccgggttcaagagattctcctgcctcagcctcacgagtagctgggattacaggcatgcgccaccacgcccagctaattttgtatttttagtagagatggggtttcaccatgttggtcaggctggtctgtaactcctggcctcaagtgatccacctgccttggcctcccaaagtgctgggattacaggcgtgccccactgcacccagccttaggctttattttctacctttgcctgttgtatataaaaatatctagcccccgttgttagagagatattgtgaggctaaactccatatttaaaccaagtaatttcctaaaagagctatgtaacataagaatactgttgttactgaaaaagggctcttgcaggggctcttggacgagaacatgtctcaccttgctggcagcacaggtgagaagaggagggaacacctagaggatagggtggctctcctgagcattgttaatgggcaagcagtcactctttggagaaggagacattactgttatagcatttgcaccatattgttcataagtatgtcaaatttggttcctgacccacatctcttaacccaggtatctgatagtgtaaacaaagcccattttcacagcatggaacagagtgggtggcagctcattattgaaactagcttgcaccttgattagaaaagcaagcttcctttagaaaattacccctggattagtaattccaattgaaaagagtaagtacaaaaatggcttagcagactcatagagacatgttttcactcctgtgtgatttccttctcagcctcagcttcctcactgtgtttatgaatgctagaaatctatgtattttaagacctgcttaaaaaataaatgtggtgtgggccatccgaggtgacactgtttaattcacagagcgaatgagtcgtgctctggatctccctggagaggatgctccccatagctctgtttcatgcagatgctagttggaaatgagatttattaactggctctctgcccactgcatctttgtttgtatactccaggcttttaagaatgaatgtataagtctagaggactatttccacatgggtgttttgagcatgcgactacagtagcacatgtttctgaatactttaaaaaaaaaaattacttggccccaggaaatggattgcagagaaaagcaaaactaaaatttaagcctaaagcattggccataacatccagctttgccagttttaaaaaacatgctgttgttaaggaaaacaaagagaaatatcgtaatattgtgcatgtgtgtgtgtttttttgtgcacgtgtgtgtataaaagagttgtgaaagtgtgttccattcaatagaggctattgtaacatggctcacttttatcagaacataggcttcacatcacattccccaaaacagcagttatagattgcaaaagtctacgttcatgtctttattatgtatttgttagtatcatctaggtttaatactgtcaaaggaggttttccaaaaataaagatttttgtccttactatttttcttagtgtttgtaaaaatcagaagattacttgatgctttagtacatgcccaactctggaacttcttttacggattttcagagcttctgttaatggaatggtcttccgggtgctcttgctttggggagaggctcactcctgctctgtagctggtatctgttgacagtgcattatcttagagcagtgctgtgagattgtcctctggaattcagaaggttgatttccttatgcagcatcttttctttatttacagggacctcttgaagctgcagtgaataattctagattaattggaaggggaaatttgggactaatttaaatattctgtttggtttagagaattaattaattttacaaatatttgaaagtctgctctggccaaggtctgtgctagatgccccttgaaggatcttgagtcctagtaaagtccgatggaaaaccgctcattttgtaaaagacttacagtgttggtattttgcttagtctgatagcgaaagtggtttgcatttcctgaacccccagtgacccaaagggggaaaaaaagtttctctgaagtccagtgtgctgtaggaagctaaaagacactgagagaaaccagaaattttgctgaaaagaatgtaggctttaggatcaggcagaattttcactggcctggccaggtgtgttgggcagtggtagaaaataaaagcattgaaaagcaggcggggtagttggaacttggaaataagaagctactgaaagtttattgactgaagatagtgtaatgaaaacagatgcctactgcagtggatcttcagttttgaaatgagagctaaaaggaaaacgggatcccaatgcaccactgtgtgggtctagaatcactagaaaatacttaatgccatgcgagagcttgagccctctaatgtgcagagatcaggactaggtagatgttctctggctcaggatgtctttccttgagtagaagcaatgaatgcagctttgttccataatgagactggtacttagcccagacagtggcttttatatttgcagatgcccacttcatagctatcagtctaacttttaggagtggcaagtgtggagagctgccactattctgatcttcccaaacaatgaaccaggtttctggttcattatgaagcatcttcccttggcatttaatgatgtaaaaagttccgatgtggctgatgaaactgctcagaacactccctgtgactttggggccaattcctctgacagttagaaggttatcaccttggtggcagactccagagtggatggagtttaccctaaatagtgtgtgtgtgtttacttcttattttagtcaatttcactttaaaggacaaattgattttcttctctcctgtgagaagtatcttttttctacagtgaattaagttagaatatatatctaagaacagttttattcttcctgacttcaggccatctttcagctagctgcctctgtaatactacattgagtatgtcaaacttagccaatatctgaagcactattccaacagccctttttctttctaacactccacacacatcccattggtatcatacaaaccttgtttcttagctcattttaaaattccgattgtttatcttagtgtttctggcccttggtctttattattagattgagagaattctctcaaagtggaaacctacaattcacataggcaagaaattatgcaacatttaccttatagcataaatcaaagaaatttctcctaaatatgtttttataaaatgcctccccaaagatgatcatttactttaatgaaaataaatcattagcaaggtaaagactgaacagagttttataggccaccaataaataatttcttagtaggttacttaaaaaaaaaaaaaaaaacactgtgttttcagtgtcaaatctccccaagtgaattaagattttactcacttgaaccaggacagagtttcttaaagaattactgtcttttctaagggagcagaagtttgtgataaatacatgaaatgatcaagttgacagctttgagtgatggtgtcctctaatgcttatctagttaagaaaatatggcaaaaactcaaactttctgtgatttctaggcctctctttgttccagcaggtaaaatgaccatgctggaagaatctgattttagcaatgactttggaacagaaagacaacatggcaagaggtttaattggcttacagttctgcaggctgtataggaagctggcaccagcatctgctcagcttctggggaggcctcagggagctttcactcatggtggaaggcgaagcgggagcaggcatgtctcatggccagagcagaagcaagagagagggagtggagggggaggtgccacacacttttaggcaaccagctcatgtgagaagtcactcagtgtcatgaggacagcatcgagctatgagggacccgaccccatgacccaaacacctcctaccaggccccacctccaacactggggattttaattcaacacaagatttagaggggacaacatccaaactatatcatatatttatatagtattaacacatatactatatatgtgtgtgtgtgtgtatttatacatatgtacactatagaaagtatatatacacatacatatatacttttagaaagtataattatatatgtgttacatatagtattaacacatatactacatatactatattcacacatatatagtagtaacatatatgtattatatatgtgtgtatgtatactacatacacatagtatttatagtattaacacatatactatatgtgtatatgtgtttatagtatatgtattaatactatacgtacactatactatatatactattatatatagtgtatatatagtatatgtgttaatactataacacaatggtgagaactgggcatatatagtatgtgttaatactatatataacacatatatatgtatatataattatactttctaagattatacttcctaaaggcattttggctatccataaaaatttatacagaagaaaatacaaatttttatagaaattcacattttaattgtgtgcaaaatcgatcctgaagtttatggccaatgtttgttgttgcgtatgactaaaaagatggtgctgttgatgtgagacacactttagatttctgtgatcctatttcatttttcatagaagtaatacttgtttttgttttgttttgctttaaagacattaattttttgttctttatttagtgtcagcctaccctggcaaagccctgggaggtaatttgtcaaaaacgccaggtaatttgtcaaaaaacatctctgggaggctttcttatgttcacagctatactttgattataaacagtggtatccctgattgaagggccctctgtgattccctgagaggtcttcatttggtgctgtgcaagtcaggagaaagtgaagctaagtgagctccttcccccactccctcacgccatctacttcctttttatcattttggagtgccagaaagtgttttcaggttctaataatgtcatttttaaaatccccactcttgggttttacacaattattgttacattaaagtttaagccaaaaatccttctttcagcagacttaccgagttcctttaatgtgccaaccttcctccatgctgggcccttggaatacaaagataaatattgcacagccctcccttgataagaacctccaggggcctggacagtgggcgagagtacgtggtgggagggatgtgagatggagaggttcccacacctgaccccagagtatacacagggtgtgtgttttgttttttgctgaggtgtggctgtcattggttcagaagtcttcctgatacttgtctgaataaaagtaattttgtgattattgtgttgatacttgggaagggcaaaattatcactcctataattttcaaaagctttcagaaatgtagcgtgtaagtaaaaatgtgtgtgtaccctactatgacctctatatttgtcttacgaacatagccttgaggcacaagcttgggcattgttgagtgatttttgtggcaggaagttcatttctgcttttcaaaaagtcgaggaaaagtaaaaggcttatttatctgttttgctcttccaatttttatatttgtattggtcatcactaggttaaaaatatttcagtatgctattacataaaaagtgaaaatgagatcatatattcatactttattcatagagaaactgaaaggatataaactaataatggtaagaactgggaagattaatcactgtgtacctttttatgttttttttttctaaactgaaactaaatgcattacctcatcaatcagtgatgtttcaattagccctttaatagcataggtttttaaaattaaataagtttcagtttgaacttaatgaggtttacatgttgaaatatgttaggaaacatctgatagatactcatgaacttaccaaagtcacatggatgacagtaaagatttgcctaatgcaagtaccattcttacattaaacatcagtagtcacaaatgaaatgtgctcctatagcatctgcctcatttagccctttgaggtttcacacatagcaatccatagtggagattttgtttcattttctccagagtacattgaagctgcctgtgtgttttgtgatgcgtccagcctgtttagtatgctctgtgaatcttacactaactgcaaaataatactctgtgaggattattttaaaatatcctctttgcatttttgttttcttctcatttatcaagctcctgccatttatcaagtacagcaaagggccctaaaactgagattgcaggtaattgccaattttttggccactctgagtgcagtcctctgtcctcctccaactcagcctaacctcccaccttagggaacttaattgggcaatatctggccttcatgtgacccctgtgtgtgatgacggccaggaaacaagccatctgcattcaccatgcatttctgtttcagccctctcacccaggagtctgggtgaaaactgagagaacccccagggagactgaccaattaagaaaaaaacaagaacaaagctttgaatatattatcctcagtatagggacctgctcactgtcagcaactctgaaataaaaaagcttgtggaacttacgagctgaatgtctgctagaaaaggaggaagcagaagacaggatcattgggagatggagtgtaatgggaagtgagtgcagcatggaggacagtgagggtttcttggggtgaacatgccagcctctagagagagtttagttctctgcctccctacccccaccccatctctctccctgtcttttcaagggcagagtaaaccttcccttcgacacttgttctccaaggacagaagaaaatgaagagctctgtgttagcctaggcaggggtctggcaggagaagggaaacaggaccaacaagtctctcccaagtcccttaatggggcctggaatacacagtaaattgttaagtttgagtttgggaagccaatttgggaagccaaattgataagtttgggtttgggaagccaatttctttccccctgaaatttttgacaggcagatagcattgtcataacaatgactttaagatgtcagcatgtacctatttccagcctgtatgataagtgtgtcactgctacctctactccagttcaaaatttggtctgtaccgaaaagggaacctggattgtcccctacctcctttcctaacctccaggaggaccagttggggtcctcaaagtgcacagccaggaagttgcttgaagaggcagtgaggtatagtgggcaaagcttggctctggtgtgagacttttactttctgtcccagctccatccctttctagggcaacatttttttagcttctctaagcctcattttcttaccgtgcatatggaaataatagtagcatcaacttcccagggttcttatgcagattaaatgtgttacagaacataaggtgtgccaaacggtgcctggtgcaaagtaaatgcctcaaagaatgttagctagtattatttcttgcagcttaaatctactcttttaccctgtattgataaaaatctataatctttttgttctaagtaccctgtacaatactttgcacatagcagatgttcattaaaagttcaaattgaacctggaaaaaagtcaaacaaattatactatagtcttttttccccctcatcaactttattaagaatttatgtacagtaaactgcagccatttaaagtgtctgagtcagagttttggcagtgtgtccaccctgaagccatcaccacagtcaagatgcagaacatttccatcacccccaaaagactccttgtaccctttgcagtccaaatcttctctgcccaaagccccaggagccagtgatctgctttctgtcaccacagattagattacattttatataaatgggatcacagagaatgcactcattagtgtctgactactttgactcagcacaatgattttaagattcatccatatgggatgtctcagtagttcatcactctttattgctgagtagtatttcattgtatggctataccatattttgtttatctgctcaccagttgatgaacatttatgtttccagtttttaggaattatgaagcaagtttctatgaatattgttatacaagtctttgtggaggtgttttcatttctctggggaaaatacttaggagtggagtgattgggtcatatggctggtgtttaactttttgagaaactgtttggcaaacagttgtccaaaatggttgtaccattttacattcctagcagcacagtatgagagttctgattgtttcacatccttggcaacacttactatcagtctcttaaatgttggccatccttatggatgtagaatggtatctcattgagattttaatttctattttcatgatgactaatgatgggtatgttttaatgtgcatattggccatttgtgtgtcttctgtagtaaagtgttcaaatctttttccatttaaaaaaataggttatctttttaaatagaattatacacatatgttttgcataataatatagtcttgaattgtattttaatatgtacaggtcttatattcttaacttgaatataaagtcccccccccacacacacaaaaagacctagtctttgttcacaatgacttttacagcaattagttacatggtccatcctcagtaagtacatattaaatgagtctatttagcccgggcactgtggctcatgcctgtaatcccagcactttgggaggctgaggtgggtggatcacttgaggtcaggagtttgagatcagcctggccaacatggtgaaaccccatctctactaaaaatacaaaaaatagctgggagtggtggcacttgcctgtaatcccagctacctgtgaggctgaggcaggagaatcacttgaacccaggaggtgaaggttgcagtgagccaagatcacgccactgcactccaggctaggcaacagagcgagactccatctcataaaaaataaaataaaaataaaaaaacagtatttaatatgtaaatagagggtaaaatagtaacagaataattattttagctgagaaaaaaaaaacactgaatctaccttagaagttttatatgaacatgttacatttgggaggtagtcttggtagataggagatgctcttctagttctgtggagaagaaccctataattaagacattcttttctttgtattgtgtgtccccttcttgctagattccactattaaatttaagaggaaagtgtgcatagaaaattttttttctttaattgtaacaaggataccatatgttctcacaagtggcagctaaatgatgagaactaatgaacacaaagaagagaacaacaggcattggggtctacttgagaggggaaggtagaaggagagagaggagcagaaaaaataactaatggttactgggcttaatacctgggtgatgaaataatctgtacagcaaacccccatgacatgagtttacctatataacaaaccttcacatgtacccccaaacctaaagtaaacattttaaaaactaagtaaatgaaaagagggaggaaaaataaatgtaacaaggagccatttgcatgcttccaaaattttgccaagaatagccaaagcgttggatgccccccttttaaaaatttttgtggtgaagatccctaaacttgatctctttccattcccattccatctaatttggcagttttgttgttgttttgctcctgacttctctaactccctaagaagaaattgtctcaagtaaaatttagagactgggaaacaaaagcttagtaaggtcataggtttgcctaaaaggatcgactgagggacctcgttttggagaagatgaggatccttggctcccagaatctgttcagaaatctttccagctaaaagccagtttcttaactacatatgtttcaaaatccaaaaatgcaaagtttaagttcactaatgatttcacaaatgtcctaggcctactactagatttcgtgggtgccacttatttcgtttaacatttattcattttattgccaaaaggttcaggccgaatttcaggtgagtcgctgcctccatggtggcggcagtcagatgattctctctgttctggttgggactgagtggaccacagccactcaaggatcccttgagagttgcgagtgttctttttgatttgaggatgtgccgtgaacggaagccaaatactaatagacaggacatcctgtgattcccttagtttacgatggccaaggatgtgtgggtttttttgtttgtttgtttcttttttttgataagatgattacttggtttttttcctgttaacaagggagcctagatgatgatgtccatttggcttttaggactcttaactagcaaacaactaagcccctgcaaaatcacatgaagacattggaaaatctttttatgtaaggcagagatgatttggtcatagttcgcaatgaagtgaccgtcagttctattggcttgaaataataatgaaccaaagaggggaaatgaccgaagtcgaagttcttgaaattaaggatgttaaaataaaattctgaaatctagtatactgtggtatacctatacggttaagtattatacaaatattacatgtgaagaaaatatgaaaaaagttcacaaatgtaccaatgttaacagaagcaagatgattattacaaacgtttatatggattatattagttttccagggctcccataacaaattaccacaaaccgggcggcttcaaattgatcctctcacagttgtgatgccggaggctagaagtctaaaaccaaggtgttagtaaggccatgctccctccaacagctctgggagacccttccttgtctcttcccgcttcttttggcccccatgtgctccttggcttgcagcttcatcacgcccatctctgcctttcattatcacctggccttcttcatctgtgttttttacatggtcgtcttttaaggaaccagtcattggagggcccaccttaatccagtatatcctcaccttaactaatcatatctgcaaagacctttttccaaataaagtcataatctgaggttccaggtggatatgaatcttgcagggacactattcagttctctgtgtgtgtgtgtgtgtgtgtgtgtgtatgtgtgtgtgtgtgtatacatatgaacccatttttataaataactgtatgtgtgaaacacatacacacaggtacccctcaccagacacacataaaagatgtttagggccagatgtggtggctcacgcctgtaatcctagccctttgggaggccgaggtgggcggatcatgaggttagcagttcaagaccagccagcctggccaacatggtgaaaccttgtctctactaagaatacaaaaattagccaggtgtggtggtgccagcctgtaatcctacctactggggaggctggggcaggagaatcacttaaatccaggaggcagaagttgcagtgagccgagatcatgcaactgcactgcagcctgggtgacacagcaagactcttgtctcaaaaaaaaaaaaaaaagatgtttaggaagatatgaatatgagtgttataactgggtgatggaacagtggaaattttaattttattttttatctgtattttctgcattagtgaaaatggacagatttttttaatagaaaaatctggctttttgaataaacagtagcactttgacatcttaaaaaaattgtagatttttatttttactagcatcctactttaagtttgttgttactttgcctcatccaactttaatgaaatattttaactttaaataattaatcctttgtagcattatacatatataaatatacataatgaacccattaatatatttgtgatattaaatgtttattatgcttattattataacaatagctaaagctgaaataatataaagtaaaataggtttttgagacattgaatcaaccagtgtgattgtcaggtttttggtttaggtttggaaagccaaaaaaagaaaagaaaacttataattcttactcaattgctgaactcaaacctttttttccttaaaaatgtttttaaagtctctaaccctaggaacctagaaactcggtatggaggcaggatggggagggactttaccaaatttttaaatttcatctgttcaaattggctcaaatactgggtaacttttaacacatgtatctactctagaactacttcatccactgacccttcttatttagacatttgtgcctatagtaacatctctagttatttagtcaaaaagtttactaggtcttgtggtaatttcctttttcttaattatctttgaatgcttattaactaattgttactgttctgtctttatcccaagtttaacaaaacattctcaattcagtaatgacccctatccctaacatttgttaaactactgcagtatactgtattaaaaattttgtcctttgctcctgtaagtcctcatagcatagcgctgcagaatctaaagaggagactgcagttcaaaaagcttccctgcttccactgtccttcccaaacccatggtcttaccatgtatctgcccctctgtttttttgtttgtttgttttgttttgaaacagagtttcactcttgttgcccaggctggtgtgcaatagcgcaatctcagctcactgcatcctccgcccccctggttcaaggtattctcctgcctcagcctcccaagtaactgggattacagacacatgccaacacgtctggctcatttttgtatttttagtagagatggggtttctccacgttggccaggctggtctcgaactcctgacctcaggtgatcaacccgcctcagcctcccaaagcgctagtattacaggcatgagccaccatgccctctgttatttctatacctgatttggttcaaacatggcacaatttttatctgctttttactggaatgctcagtttctgtacttccctttgaaaattgtagtgatattacactgatgctagaaatgttgtaactttacgtttgacctgtgacaaggtagtagagaaggagagcagagagatactgcaaggagtgtgtgcgtgtgtgtgtgtgtgtgtgtgtgtgtgtgtaaactgatatttgtcaggggctgctaggtacttctaatgcaaaagtctgtcagttcattcttcattccagtaaataaataaagatgtttattgatttaaaaaattcttcttctgttccatatacaatatatacaatgatggtatctggttgcccaaacaagagtaccagaagaatagggaagggaaaagaaggatgaactctgatcctgggatggaattttaagaagatacagggaaatccattctctggctgaaatgagagaatcatttcacatgggaaaagaagttttggggacgatgccctacgaagctggtagtgaaataatgctcctagttttgatagtatttccccactgctccaccaacttagctgaacatcgtttatcttagctcagctgtagcaatgaccaaaatttccatttgctactcatcataaagtgcagaagagaacctgtcttgtatataatttgcagtttcttctttggggctggagcatgggtttgatgtagaggcagatcagtaccttgccaactgaacccaaggagttaagtttaatgttgtgctatttcccagtttgaagttttcaattttgattctgtgtcagagtctactatggaaataattaagaagagtagataagcacaaatatggctgggggcataaggatgtcttttggagtcagattcactggaatattttttgccactggcctgtacttcccttgtcctgttaataagcttaattttattggtacttcattttccattttcatttcaaaatgttctcatgagtttaaaaatcaattttaccataatgtaaatacagacctttggataggcaccaatctctaagagtagaatactgagaggcttgtctatttttttttaaggaatagctttttctaaacacatagtcaagataccaatctgaagtctttcattagctttgaaaaaattataagcagtataatgtacatggtctctgtccattttgactaatttaccacaaaaagcaaattgagaggcttgaaccccaaatctgtagtaactagaaatgcacgatgtgatgactcctacgatattaacataccttatatgttacagctggcagatttgccagccaaaaattcattcccagcgataaactgagtaactagccacccaaatctctacattttgagcttttcttcacagaaacttaaaatcatcttggttaaagtgaaaatgtaaaatgagatcttggtagaatttaaaaagacaaaatggcttattaaagaccacaattgtgtcctcacttggaattattttttcttcctgcttaatctcatgacataaacacaagagcagggagagtcttaattaaaagcaagaatcctggaattcatcctaggtccaaatccctgctttgccacttaataatggtgactagacaagtcactaaacctctccgagtctgtatcttttcctacataacataaaagcagcagtgatcacatggcattgttgcaaagattaaattaaaaaattcctgttttactctttcattaggcatgtggaaagttttcaataaatattagttattgtaacttctaatctagttccccttgtttactagtgaagaaaaggagatcccaaagagttgagacacatgtgcccacatttatccaactggttgatagttctggaactagaagctgctgcccctgatgcctagaacagagctctcattaagctgcagggcagctagggagcttttggtatctgtgttccagacatttccctactcacctttaaaaaaaaaaaaatgcctagaagacagggtcctttaattcactcaaccctagtctgttcctagccatctcacatagcactaggggcacgtattgatatttgccttttgtatgatttggcacacctttgtttgcattcattcagcatttatttattgtgtacctactgtgtgccacacacagttccagacacaggagataaagctgtaaacaaaacatattctataaagtttctgccttcatagagcttacatcctgggggcaagaggagtggacagatggtaaacaaacaagataattaccaatggtgttagtatcaccgagggcagagtagagagatgtgggagtaactggaagcggccacttcagaagtgggcatggagggttcactggggagttgacatttgagccaaacctgaagcatgagatgcagccaaccctgccaagtgctggaacaagctgctcttccgtggcatgaggtcttgagccccagttatccctaaggatgaaacttgaggctttgctctgtcatttgtttcttattatgagaagatttagaaaaagcagacaccgaagtacctgagaaggaactagcaccaccaagagtacaagagagctcagaaccaggaggtggggaccactcctacaaaatgtgtgcaccacaggactttgcctagtggcagcatgattgtttgatgaccgcatatgcttctgctatattgcatgcacctgattttatgcagtggactaacaactgagcatgaccacccactatggtaccagcagcacctatgtcctgaaaggttgacccagggccctgctcgttgggggcagcgtgggcatgactggaaaagacctgggatcatgggaaagagctaaggtcagggtaagagggaacgaggccaagtagggctgggaaagtaaacagaaggcatatggtcaagaaggagtggatgtgctgggagctgagttggcgggggagggggtactgagaaaagttggtgccctgaggagaccagccaagccctgtggcatgggaatgagctctaggtcattgaaattattttcagagcatggacgaagccacccactgctagaaacagatggacatttaggcaaatataatcagctgcatttctgaccatatgaagaagcgtatgtctatgtggggcagggaagggttagccttttactctctcattgtacatgtcaagtttcattcatatccatggacgttatgaatgctacaaagaacttttttagaattccaaaattttgtcataccctggataggagccaaatttccaagtcatttcagggctgtagctattgacttgttaagtctgagtttagaaaacaaaacaaaaatccacccgtatatgctgttttgaaagtttgtcttttttgtttagttacgatagggtggctagccaaactaagccctgtatgcaaggagctgcctaatgaatagtagtggatgaggttaatgcagataaataacaatgaggctgttaaaaatggagttgattttcaaggtgacttacggaatgtcctattgtaggcggttggagacacctgtgttttaatgatattctgttggttttttttcttaaaacatatgtagaatacttggtgatatggcaagaaagagcttaatctccgtgttttgaaaaataatcattaatggtaaaagggatgggcaccctgaaaaagagtattatttttatgttcattctctcttggaggtggcagttattagctgtcgttaggagtttgattgtcagactaaatggaactttgtatgcacattaaaagcattatcattaagaagtgactgataatgaagagcacattcatattggaatgataggcagcctggaaaagcctgcagtagagagcaagcacctcaaacctgataaaactcacatttatctcatcttcctctaaacagcatagttttgaagattcttacattggtcttcttcactagttctaaaccatcaatgcctaattttgagagaaaaaaatagtatatttcagtgtctatattttaataaagtatgtgcatgttgtcatatggacagtgtcctgatgtttctccatcatccttgtgtgaagtcagttccgtgctcacacccctgccacatggagaggcccggccgcagggagggtctgtgcctggaggagttggtcttgcattgtctgtctaatcccatcacagtcatagagccccgtaaaaataaaatacgtgcaggtctgcccacagcagcttatgtgtgctattacctggagacaataaatgacttcttaaattcccattccagccctagaatccatgcatacggcaattagtccacaagttaaacagaagctttaatacccagttttaggcgaaactccatagttcctgtaatctctctccaggagattttatcctgtcaaggtttgtctttcagagacaccctctttgactccctctttgctccatcctgatctccctcctcaaacaaatactttctctgtgccccacattgcaggtcacaaataaagagaaagtgatgaatctagaatgatctggtgatattctttccttgggtgaaatgtttaaatcctgcctctcgaggtattgaacctagagaatgaattatgcgcagatgaaaagcgggatatttctggttcaggagacacatttacactgtccctccctatggaagcccagttcattattaggggaggctgtgggagatttaacatcagccttttgtggtgaggacgctgggaaggaggcacgcaggcaggatctgtgtttacaaggcttttcagaggaaaagacgtttggggggatgtctgtgatgggactgaatatcttcattcccctccggaggataacatatattctaatgcagaagtagtctttgagaaaaacttttgaggtttcttcctttggctaagtatttaatctgtgggcatgaatgtacaatttgcaggttattttagaaagatgccacttctaagagaagaaaatattggtgattgataaatctctttttaaattctcataatatttgcagatacttagaaatgtttacaaaacggctatttctgttagaataacacaaaattcttctaagtaaaaagccttctttacaagcgcatttgaaataatgcacctcactttacctgctatgctggaacaggccaactttggcaatcctaaaacctttaaccaggaacaactctgtgaaatgagaactgacagtgtggccttgacctggaccgagcgaaagtccagtgactggcaaagaaagccattcttttggatcacaggtccttctcccctgttggcatgtgtagaaacactttgaaaggatctcaaacacctagtcagttggacttaatttccaaggaagcatcgatatttctaaccattaccttaataaaccacttgggttataagaaattcagaaatcattatatgctcaagcccaaagaaataagtttcttaggtgaaagaaaaatatactttttctttatatctctcttctagtctgctcgttgtttcatttatgtgaaactgggtgaagaatgcactgcatgtatttaccctaaactgttggtagtggattactttccccagtgatgggagaacatgttgaaaatagagattgttatgagagaaaagaaagacagtcacacatatcacacatatgggtatggttgtcactgcaacatgtgtgaacagagtacattggcatgcggtgggttgaactttcagaacttttgttgttgttttttttttgagatggagtctcactctgtcgcccaggccggagtgcagtggcgcgatctcggctcactgcaagctccacctcctgggttcacgccattctcctgcctcagcctcctgagtagctgggactacaggcgcacaccaccacgcctggctaatttttttttggtatttttagtagagatggggtttcaccgtgttagccaggatggtcttgatctcctgacctcgtgatccgcccgccttgtcctcccaaagtgctgggattacaggcgtgagccactgcgcccggcctcagaacattttatgttgaacatgaagtttccagttgaatgtggactcctttaaggagtgacataaagaaggtaacttaaaaaaaaaaaaaggagaagaaggtagcttaaatccaaaaggccctttaaaggctcagcctccaagtgggtttggtataagtaaatccaggccaaatggggtctccttgcagcgcagcagatagcagtcaaccacttatggaggctgttcttctgcagatgaacttgcctgaatttgggaagtttggtaaactcagactttagatgatataaaaacaaaaaagtcaggctgggtactgtggctcacgcctgtaatcctagcactttgggagcccaagacagaaggattactttttgagcccaggaattcatgatcagcctatgcaacatagtgagacccctgtctctacaaaaaaatgaaaagtaagctgggagtggtggcacacgcctgtagtcccagcttcttgagaggctgagctaagagcattgctttagcccaggagattgagcctgcagtgagctatgatggcaccactgcactccagcctggactgccgagtgagaccctgtctctttaaaaaaaaaaaaaaaaaaaaaaaaaaaaaaaattctggccaacgtgatggttcacacctgtggtcccagctactcagggatgctgatacagtaggattgcttgggcccaggaggcagaggttgtgagccaagatctcaccactgcattccagcctggactgcactccagcctgaacaacagagcaaagcctcatttcaaaaaaaaaaaaatcaaaataggttccacattaaacccttttccttatagccacacacctcaaatgggaccagagccagatcccgggacaacaactggcctatcatgaaacctgctggaaaaaatatacatatatgtatatatactgttttgtcctccaaaatgagtgatcggtgaagtgtgaaaagagaaaatgaggacaggcagccccctcccctgaagtatggctgatagtgtgtttgcaaggggtggggcagggcagagagacaaaatgaattacataggaaataatttcagttaacactcataatgctagctagcacatattatatatttgcttaattttgaagagccacttctctggaataattcacaaaccttgccaaatttgttcttgaacaaaattgttgagtattttgtagttaagttttaggtgcagaactggtaaaggtggtagaattcatattttgctcagtaggctaactcaggtctcattgactcacataaaactccatttattgtagtaagcagaaatacagtgtctaatgtgtctgattcaatcactactgcaaagcataaccttgctgtacctctccacccaacaccaccgccaaatactgaataaaggatgaaactgagcaaaatctacacattggccctcagctggaggctttcctttttctaaagtcatgtgtatcagtggtcactatccacagacaagctagaatcgtgactttgcctgctagaggtctgaagggatttttgttttttctgtgtgtttttctctcttctgtttgcaaaacaaaacaaaaaaccagctgggtgtggtggctcacgcctgtaatcccagcactttgggaggccaaggtgggcagatggcctgaggtcaggagttccagaccagtctggccaacatggtgaaaccctgtctgtactaaaaataccaaaaaaattagctgggcgtggtggcatgtgcctgcaatcccagctatttgggaggctgaagcaggggaattgcttgaaccagggaggtagacgttgcagtgagccaagatcgcgctgctgcactccagcctgggcgacagagtaggactctgtctcaaaaaaaaaaaaacaaaaagtgtattcccaccttccaagaaagctattctaatattcatgtaaaaagtgtgtaactatattgtgattattagtttattttcaagtaggggcaataaatgcaaatttgttttaaaataaaatttaaatacaatattaaagtgtggtgacccagggactgcagtgctaggaaagtgttcctcccttatctcctgcttgttgtgctgttgcactgaccagatctttatttttatttatttatcttttttatttttttttgagacggagtttcactgtcacccaggctggagtgcagtggcccaatctcaactcactgcaacctctgcctaccgggttcaagcgattctcctgcctcagcctccctagtagctgggactacaggcgcatgccaccaaacctggctaatttttgtatttttagtagagacaggatttcgccatgttggccaggctggtctcgaactccggacctcaggtgatccacccgcctcggcctcccaaagtgctgggattacaggcatgagccaccgcgcctggcctgcactgaccaggtcttaaacaacacagtgatctggttgagattccaattgaaagccacaaagtgggagacagcgctttgactttctcctttgcaaggatgggacagagagatgctcatgtcccagaggccatgtggcaagtcacctaagaataaactgttgtttccatgtaaaagacatgctgaagatccaaacatgagaataaaccccgcacagtgagttgctccttgttctgtaatagttagtatgaccttacctttcataaccatttatctttcttgactgagtctttgggaagtactccatgaattaaaaattagctttttgaattgtataattcctaccttccataggatgttgatgtaattggtaatatccctaaggactagcagtcgtgaattgaagtttgtgtccacttttgtaagggaagagtatgattcctgccctgctttcctcccaggattcttccaagggtcaatagaaccactttatctctaaaaagatataaaatttccttgtgttatccacacagcatttctgcagactaggtagggacaagtacttttacctttatattgtcatatagattgagaccccagaaatcataatgaaatcttaggattttagaatgtatccacctagggactaggacaatttaatactctctcacctgagtttaacatttggaaaaaatatataaatgttctgtgaatgttgtagccacttgtatcatttaagtttaactatatggaaagcatacctgtagaaaaagcaggagctgaaagaattgggaaaacaaaagggtggatggcagtgcaggaatagaatcctttttccactttggctgacacttcacttgcgggaggttcaggacagttccccttccagggaaagtgagtccagactcagaactctcaggcctaaaatcggaaaagctggcttgtttgggttcggggcaaacattgggagcaaagacagccacagagtgaagtgcgcttagaagtaccttgctgaaatttggaaagaggaagatcgattataagaatattcccatcagcaggggtgttaaatagaaattaactatattgatttcattgttattaatttgaagtaggtattgaagtctactcatttaatgtgttgttattttattttaggaaatggtgaaaaatttcttgccttcattggttcacttattcttaatctgtcttctaaactagttatcccacaggtcccttaacacatggtagcccctgccacagggcttgtgaggactacagctgtgttggctagcaatggtggagatttgagtggtatgcctggtaactaagtacccagaatttttctaaagcccagatctggtgctgttttcattgtttacctgatcatcttaatgaactgcttgaaggcagatagtgccttgacttacctttgtgagctgaatgtctgtttacattatgaaaggacaattgttgtccttaagtgaatgttatcagcaaagacctggaggaaagtgtgatttattgacaaactgcagcaaatgacctgcttccttgtttatatggatttttaaaaagctgtcattactcttctacctgtacttctgttgtatattaatttctcttatgtaaccacagaacgtttttactcacttgtgtatgggttatttttctaaaacacagatctgtttgtgtcttttctgctttgcatttagattttttttaaatcatcttgattaaaaatttcatctcaatttggtttggtgccatctagcataaccctgggcctcgacaccacatcctccatcagtacattgcccggtaatgcagaagctttccattactgcctgaagaagaaaccgctagaaaagcccatcagctgccaaaagttatgccagtatatgatcatttcatcagtccaaaatattttaaattttgaattatttacccttactaagattatacataatttacatagatgattttaaaaattgactacatttaaaaagcaaatggtttcgtttaataaatgatagactaaagaaaacagtggaagttattaaccaaaaagtaaaaaaccttcaataatggtgtacaaagcagtaattatggtcacactatctgagattcctatgctgtgagatttttcagatccttacgagaagacaatttagagataagggtgcttctgggaatggagtgatagatatttatttttacatttatttctaaatgaaaccttcatttagcactttaaagtagaaaacagatttttattgctttcatgagcataaataggaactccaaacacaactatttcataaaatgtagatttttgtctaaaacctatatactatagattttgctattatatctagtcatgtttaaaaatattacttctatatctgtaaataccatttttcactaaaaggaatcaggagcgcttggagaaattactggttttaggtctgaggcaagaaatatacaagttggccttggaacatctcgtcatattggaaaagaagaaggttatcaaagaccactaagactgtgtcaaaagaacttagaggctagcttgaataagctcttgcaagcttttatcaataaaggtataatttcaatggattgaaacatatcaaatatgtttaagtccgtggattcataattatacttcaaaatataagaacaaaaacttcattggtcatgtttggagaatattagggaactactcatcactttgaaaactggcaaatagagaaaaagagttaggcacctctcctgcctttcctcgatgacctgtatctcagggtacctcagggggaaacttctctttgtagaattattccagctaataaatcaagaatgaataatagaatatttgaagttttagtgaattattggatctaggcaaatatcagagctaacaatatcatggaagcaggcagtcagaggtaatagttatctgccttctgatggaagttcaaacacggcgtgaaatagtctgtttgatgcaattgtcatatactggcataacctttggcagctgatgggctgttctattggtttcttcttcaggcagtaatggaaagcttttgcattaccaggcagtgtattgatggaggattaggtgtcaaagcccagagttgtgctagatggcatcaaatccccgtcccattagaacttgaataagatcaaggctctagatggaattatcagtctgtagggatgcagaggacagcggaacatgttaaaccacagcagtgtgatacaatgagaaaaatccagaatgtggaaactatcagacaacctagttccttcaacaacaactttttttttaattgcaaggaaagattagaaatagagaagaaactttataaagaaatttaaagaatgtatcaaagaatcataatgtatgaaccttatatgaatccagattcaagcaatctgaagttaaatttgtattataatatattgaaatgcatatttgatataagtaattattttcatttttaggtgtgataatattctgtttttttaaaaaaattatttttcagagacacactgaaacacttataggtgaaattatgtgattattggcacttactccaaaataatctggcttggtaggctaggatgggattgacacaaggggagttgataggagtataaatcaaacaagttggtcaagtattgataattcttgaatccaaggggtaaacctaactggtttgttattctcttctctctccttttgcatgtatttgaaagtttccaaaatagaagttaatacatagctacaatatatacatatacatacatatacaatatatcaatatatatatattccacaaactaggtaaaattgcaaagtttcatccaggtttaaatattaaaaaaagaatcctttatcactgcacacctactagaatggccaaaccccaaaacactaacgtttccaagtctttgtagtgagtactgaaataatgtatgaaactaacagattactctggtgtatactgctacaaacctggtaactttttaatatcacacgtagacttacagtcaaaagggagactctaaattgtgttataaattaggaatctcagaacctgaggaacatttggatttagttggagagatataaaatggtactgcatgaaaaatatgtgaaatttaataattttaatgcaaatatgtaaaatagaaaaagatgctaaagggcttagccagagcaggacttttacatgccctggagtcctgccaggatcttgacctcgaataggtatcttttgtgtttctgagttaatttccttgttgttaaataaactttgttttttttctagttggggaatggcggtcaatgtgtattctacctcgataacccaagagactatgagcagacatgacatcattgcatgggttaatgacatagtatctttaaactacacaaaagtggaacagctttgttcaggtaagacatattcttttaagtgtttacctaaatatttacagtctgtcatgtggaatgtgattttatgaaccacagctgctatattttgggtaggaaaaagtatatattgctattggcatgtaattaaagggggaaaaactcagatataactaaaggacgtattgggaaaagtgtttatgagcatccaggagcacaagcagagccacacggacacgtattggaaaggtctcttgcttgagcttcgtaatgcctttcactggctcctagcctcttctctgtcatcccatctgccatcacacttgcctcctgaaaacaccaattggttcttacaacactcctcctttaaaacctctagggctccacgttgtcctcactacaggataaacttcaaactcttttcatagactaatgaggtccttattagtctcaattccaccctccacatctctctcccttatacctcagacccacaatataatctttgttccctaaagactctttcccttttgtatcccatagcttttttcatggttcctttgctgagatctttccccttcttttcatttgtgggaaaatcttgctcatactttaaaatctggttcacctgccacctgctctgggaagcattccccagcctcgcaggctccgtggtgttcctgaaacactgtgctcatcctccaaaatgacacttgccacgtcgtgttaggatgtctaactccttctagccctgaaggtgctgagagtccttgaggacaggactgcgttttgttctttgttgaatgcctgtagttgcctctacttggtatgaggtaggtctgcaaggaatatatattgagttaaacttctttaaaaaataaaaatatttgacttcaatgacaaaataggaggatgttttaaaaaacgtgctgctaggccaggtgtggtgacttacgcctgtaatcctagcactttgggaggccaaaatgggaggatcgcttgagcccaggagtttgaggctgtggtgagctatgattgtaccactgcccaacagcctaggtgacacagtgagaccctgtctctaaaacaaaacaaaacaaaaaatatgctgctagtaaattaattcattcttaggtctgagtatttatgaaagaaataagcagtcctcctttggaaacagggaatgtttccttccagtaaacaaatagataagagatttcttctttccctttggcttcaacatgaaaatggtattagaaaataccactgaaatgtatttgtgtgaaatttcatgagtcagaataggtaggaagaagtcaacattgctctttttcccagagggtcaagtataaagattttatacagtgcagttagaatttcaaaagcccccagtagtcactttcagatgttgtctgagtccaacacccaccagtgtaaatattctcccttcaccaggtctggacttgatcagaatactcctagagcactaactttgagtatgattgacatccttttccctgtgatcatttttcccacgaggaagacagtaaggttggccagaacttaggcgttgcctcactcacaaatctatgcctaggtctcagacatgaagtcttgtgatttatgaggtcagtagtgggtgctagctaaccactcctttgcccttcaatacaagatagagaaaagctgacttagactacgatgatgatgtaccaggcatgtatattgttgatctactgaaatgtctctaaaagttactttcagaaacaacttgtattgcagcttatgcaacttcagatctctacatacccaaatattactgtgctgttcttgctgtgcattcttgagctaatattttatttttaacttgctgccaaaaaagaaaccaaaaacagtttctgttattagcaatcactttgttgataacacatacccctttgtattgtaattgtgaaattgtctatttcttcacaatgcctaatgcatggttttccttcagaaatactcattttggagatgaatgaactgcaatttgcaactgctaaggggcaaagacaaaaatgtgtatcttacccacaaagtgggtatatgtgcatttggataagggaaacaaggttggttatcaagaaaaagagacataggaaggaaggggataaggaaaaggctcacagagaaaatccccaggcatgagtcttaaatgttaaaggaaaccatgaggaacttcctatgctgaaatacacttggagagtttttggtagcaaatgaaataagaacaaattgtaatttttagatactgtagtaaatgtatttataagcaatatacataatctttgcagatctttgaaatttctcataaagcaaattcaacaaaattttaagggacatttgtaaaggattcatatatggtgatcttaaagcattggtgtacatttatggcctttgtagctacactgccatcaagcgtggcttgatttaaaaacacaaaaaaacctgtagaagcaattttgatcactatcaaacagatacacataattaccattaggataacttactggctgcctaaaattacaggattgatggttcagaagaatgaagtggatttaaagtttcctttctgctctgaaatatgtttctcgctagaaaaaaaaaaggaagttaatctccatagtagagaaacaggtcttttattttaggtagcagttttctcaaggtataaactatagactctattcttttataatttcctggggagctgctgaaaaaaagcagatgaccttctaaatcggtacctctgagtatagcctagaaatctgagtttaacaagtacaagtttaagtacttttgtgctgcagcctagagcttgcagtacattttaccccagaccaacaaaaatgaggttaaattatccaaacgtccttggaagtttccttgttcataatttaatctgtgacttttgtctttagcatttagcaggaagaagctatctttctatttatttatttatgaaattatttatttatacccttcattgttctagaaaatatttaaggcagctaggacagtgctattaggataggaacaaagccaagtattgttgacttaagtgacttatattcctcatacttatgagtagtcagatttcttatgtaatattttcttcaatgtttatttcaatttttttagtttactgtgtgggattttattttagcagtatgcccaggaaaaacatacaggaaatactttctcatatttaaaatgatttaaaatgtcaacatcatttcttactctctttcctgaagacttacgctccaatcctggtggttcccattttgaatttttttcctattgcattatttcctatttctgtttttaaaattttccagctaagagatctccctccagctcagtattaaaactaacaccagcttttctttaatttgtgaagagctaaaagattgcctcacattggtgttgtgttttactcagtattttctgcctttatgtaacatctaatttgtttccaggtaggcatttttaaaagctctttaaaggaaagatggcgtgagaaagtagaacacttggaaatatgtttgtagtaagttgcaaaacagtgaaaatgactcactgttatctcctgttattttatcccaagaatataacctcatgaaaattttctttgaacattaaatctgggtcatgtaattatatgggtatctggttttcatttatttcttgtgacaaacaacctttaagtttcaagtaaaaggtgagctatataaatggagagtgggctatcaatgaatgtgaatactacctataataattcagcaatctattgctcacctagatctattttgaaatgaataattgtagattttccatggtggagtgagaaggttgaaccacatgtagtatcagattggttcagcttatagatattttatattttaattcaaaagttatacagcttgggcaggggggtgatagggaatttttttttcattttttgctttagtactagctcaaactaatttactaaatcttttataaggtagcaatgagggtgaatggacagcatggtgctaaaaatctctaaaagctttagcaactttagataccttagtggaggtgatagagaagataggggacttagaggggaagaaaaggaaatggggagggaggagtagggtggagtgggagaaagtacatcttttccttgaaagtacatattttccttcttttcctctccctcactcctcacctcaagcctcctttgagacttctttgtgacattaattttctgtgtcttgatcctctgccctaggctggagctaagcagcaaaatcactgggtccaatgctgggtcattcttgctgcttggcagactgagtgcctgccttgactcccatcctcacaaggctagtgcagcctgcccttttctctttgtgcaccttgcctccctcctccccacccctccactagccgagcagacacctgacttggggcaaatgttaaatacagtctgcatgtagggctggcactgcctggactgtcactatatcctggactgtcactgtctgtcactgaaagctgttattttcctgagcattttagtattttaataaaatgtcatttgaattaaaccatttttagatggaaaattgagatattttcttgacttgctttaaaaaaaagaaagagaaaatgatcaggatttgattcagtttcaatttgtgcttccccaaattggtgcgagctttgtcttggatcaagtcactggtattttgttcttccaggagagcttctgaatttggctaatgatattgtagtcacatttgcaattctggttacgtgatggctatgtggaaggagcaagtatttagagtacactctggcattcacacaggtgtagccatcagatggccctgggacccgtggtgcaggtgctccgggccccaccctgatggccatcattcctgagcccagcagagtgttctttgtgaccatttttggccgcagatttgtgcctgttagataggttgatcccagcctcgtgtgttgtccctgtgcctcctctcttccatccacagagacctctgtcaggacaggttaccgatgaaatctgctcagagtctaaatttagtagggcttctcttattggctctctggtattgaaaccaagtaaggatattctttcagtgtctgtaagcataagagtttacttagctttataaaatcattgactgttatttgctgtaagaaagttaggtcatcttagattatattactattgttagggaggtaattgtaatggaatattattcatacttgtgatatattacatagagtctttttggtttttttgctgacagtttttttctctaattatttgactcatgctaattttaaaagtttacatggtctcagcatatcaactaattggagaagaaggggacaaaaaaaaaagagttggataatggtggggaggggtctagcctcatgttcaattgcttcaggcagtaatatatggtaatatactctagtgtctctactaatgcactggttgaaagggagtttatttttggagcaggatagataatacagtaggttttttttccctccaaatttgttcatttacatcttgacactttgctcccgaagatgaacgtaaattgctgtttctgtttttcttgggactttttgtttgtttactgtcttttgtaatgctgaataccatggtggtgaaaagtgtgtatgcattcactttcatttaccaaactgctctataattttttttacacatatggatgatatatctttgaaagcaaccagccacatcttcgtttatgtccttaactacattcaattctataatcaatttagttttatttaataggcatattttgagcctttctttgggctaggccctggggacccagcgataaataaaacatagtcattgccctcaaatagctcagtacagcagagtactgtcctacaaaagaccagagaccacactgtggtaagtgctggtttgcaagtgctttgagcatacaaagaaggaagtaaatgaagggaggtagggacatagggagtcagtagagagatttactcagattctttgggagtggctgggtgcttctggatgaaagaatggccatcgtttgggaaacacctcagaaatgtccccctccctcttaagtcagatggagtgacaagtgtgtatgtaggataatgtgtggggtacttagtttcatttaccctgacagactccccaggctaggggggcctttgtcttatgacacagggactctagtcagtaaaatgcatgtgctttagtgggtacagcccttaagtacatgaagcatattgtcatctctaaagaaatataaaggattttcttgatgatctcatcacatgagtatgtgagaattgttattactctacttgtttgaaggaactaggcatgcgtgtgggatattctcaggaaaccatagaattggccacttctttgggaggaatgcaccagatacttttaaatactaaagccaaacctcagtgataactgcttgggtctctaactgggtagatgtcatgtgactgcattagtatttatcacaggaacagacctacagatatatccctacatcctattacccatttctgctggagtctctcctggttagtgacgaacaccataaataaggggaaattagaaaaacaggcttagggaaaaatagatcacctggaatgccattgttttattgaagactaacaatatatatactgaacaaaaaatcaaggaacatgtgatcacagttaactttatatagtgccttaacaggaataagtgaatcagtgacatattagaaacaggattaataattgcctttgagaagtctcaataagttctctctctctctctcacagatacgcgcgcgtgcgcgcgcacacacacacacacacacacacatacacacacacacacacaattggtacaaagcagtaccattagtgggaatctcatatttttttccccatatgtgagaaattcccagatgtcatagttgagtgcagtctttgaggttcttattgagtatatcactaattcacaaatgctattgtatctaccctactatagtaagaccctgctgagatttacctgcccccaagccatgaataggtgggtggttgtgagcctagagatgaaaactgttgtaccaagggatgggtcatcaaaagaaatctaagttggatacagttaatgagagtgatactgaacatagtactaaggagtctctaaagcctcatcattgatttcattaacttcagtgactggagccctaactccatagccccagggatcttgacaaaggttgtgagaaaacttgctggagtccaaggacatgacaggttttaagactcatttataattcataattctaattacagaaacctttagagccatttctcttctgattttgtctctgttatatgataagttgctttcttttaaagtacataatgatatgcttattttgaaatcattcaccaagatcaataaaaaccagtatcttaacaagaaaaagatttatctttcaacatattgaaagttattttgaatttttaaaaacatgtcaatcactttatatgatggatatgttccttataaaacactattttgtatttaccatgatactttttctttttcttttctccctttcagtttagattatctaaagactttaacaggaagagtgtaaatttggggaaaaatagtcatttccttttataaatgaatttatgattacttaagcacctcatatgtttatctgaggaaagacttaagaattacagaaaccctcaaatgtttttccacagatgaactggaggatcttagaaatgtgttcataccctttcttgtctggtaggaagccaaggacctcattttattctttggttccttgtcctttgaatctaaaacatgcattttggagattcatgttttgcatctgaaacagtccaattcaagcccattcatttttatagctctgattatcttaaccggttacatactatatagttttatacattaggggtataatgatgtcataatgcctcagcttttatttctctctctctgccattttcagtgtgtttttatatgtattatttcttttaattcatataacaaccccatgaggaagaataggaatattttattcctattttatgaggctaaaagctccaagaagccatgttcacagctgataatgagaattgaggtgtccttggatcatagcccagtactctcattgctgtatgtgtggcagctgtggatgcaacgaagggttcactgtgtgtttgcccatgtggatgtgtttctgattctttccatatccatttagcagaagtcctttaagcatctcctctaagaaaagaaagaaagtctttatctccatcctttacattctacttgaagaaatgagacatatctggtaattctactaatgacaagggtgtgtcccaatggtatcatcatcaagaactttcttaccaaaagtaacgagacagagacatttgctcctagtcttatgaagttcttccttctccacctgctgcaagtagagtggggaaagagccgcctgttctctctgattgttctccttgttccttttcttcctctaacttctttccctccaagcaagatgaggtggctctgaaattttgccacctgccatggaggaactttgcagctctctcaggataattcttggccagtgaaacaacaaccaggatgatgcctccttagacatttgcatgtgcatgtctctgcactgtctacatttgaatcccaagaatatggtccttttcttatttttatcccaggctagcttttgaacaagcttgtacctgagagaactacacatccttatttcctcctttctatgctattgaggaaattacaacatctcctaggataattttcttacaagcttggttcccacaaaggatttacttatcaagttatcactgttttccatgtatttaatccagttcaataaacctgtattgcagtagccatgctaagaggctccatcagtacttctccaaccccttctttaatatgaaaagttgatggtttcttagtcttacgtaaaaggacttactaatgcaacatttaagagtagacaccgatttcccatccagctctatcccttcattcccatgtctggtttcccaactccagccagattgcagctcctgaactttttccatatagccattctagatctgccagtgggtatggtagcagacactgtgctagtgaagtagaaagatgaattgaacatcatccccagtcttaaagatttactcaccagtcagccaggagagagaactaattaaaatgtaagtcaaatccctgttagatttctgtatccagtatagtgaaacaattttgtgttggaaacaggaaagcttcgtagaggaggtgatgttttgactaagcttttaagaatgagaagttattcaagtataaaagaggacgaaaggacattttagacaaaaagtttgatcaaggcaaaaagaagttgcagtgttttgtgcatgtacattgcatgtgtaagacatctgtaacattaaaattcaaggcagcgaaagagggacagtaatacttcaagtaataagtgctgtattcaaagaaaggaaagattatttccatctagaaaagctttttgtcttacccttgtttgggtctttggccaaacagtcattcaaatttagtggatggtcaataaatatttatgaagttgaattgaattgaaatgctattcaaactaggattttaatatggataggattcagacggagaagaagatggtgattttgaggaaagttaccatttagatatcattttgatattctacacattgctttatttattcctgcagtcagcagatatttattgagtacctgcaatgtgtcaggtggtggattaggattggaggatacaccactatacaaaacacaacacagatcatatccagttaggacctatccctttactaccaaagttctccctgacaggtctattcagagagagcaaattcctttttctcagcttacctgagtatgaagcaaaggcagagaaaggcccctggagaaaggtacacgtccagcctgtcttgccatcattcagtgtagggcactaatgggcagtctgtacatggaaacatctgaaatattagcaggcatctggtttctacacagttaagataatcaagccaaacatctccaaattcttctgctcttcaaaagaaaacatttttcctaaccaatttttttctgaattgtgtttttaaatttctagtttatcagacatgtagacactattaaaaaggagtgtcagaaatcactgtcaaatgtttgggcatgttagaattgcatacctggaaacagaataatgaaattgcttggcaactcgtaaagacaccatcatttttcagattgcgtttttttttttcccaccctgaaaccattacgtaattctgacaaatagcaaattacctgtgtttgtcccctccctcccaagggtgtgttcttacccaaatattaatactcataagctttttatgaccaaattatttgacatgagaagcatataaatgtgaaactaatgcgagtcctgtttcctgcagtttctcttcgcattctgcatgaggaggatcgttctccattttcatttcttctagattacatttgtatgacagctcatggaagaactttacaaaagtgtagaaggagccaaattttaatgaaaagatgtacatcaactttaaaattgcgcagaattgtgttaaaatctactatttaaaaacctcacagaaatcttttcctgcttctttttttttccaaaaattattccattcttttatttctactgtggtcatatgattgaatccctgaagtaaatactgtgcattcttcaaactgatttgggatccttctgatactagagtgtacctagaaagcaaagtatattttgggattaacctgggaaatataaagaaagcaactcataaagaacaatattctgttagtatcacagtctgcacgaatgttatgtggtgcctgaatgtgagttcctctctgtctgtaattgctggaggcttcctttggtgccacacctggccttctgggctttctctggacgggactcttttcagggagctgccggggaaggagcatcctcctctggaaagtggtaataggggatgttattggtgtagatgaaagctagaggactggactggggagagtggccataagtatggagttctcacctgcaagtcttggggagagggtgaaatggctgaaatctggggaagaatcctggagcttctagtctctagtgccagggatagtgacctcagcctcaaaatgagcaacttgagaaaggggcgcattgtgtagacgtggaccgtgggtttgcgctggtccactcataccagtatattttaccttatactaaaagcctctctgtgggctgccatacatagagttcatgtagtggcctggcctgtataactgttgatagtatgatgtgggtaatggttcagtagaaattctctgagaaaatggggaaagggatcagctttaggtttcttacttgcaatttaatttgacctaaaaatacatacgttctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaatacatacgttctgaaaattagaacttaaaaatggcattctctaaagacgtttgtgcccagaaatcagcattggtttgcctaccaaattagttaagcttcttcttttcctggcatttaaagccttgagcaatctagctgcattccacctttccaacatttatccccacagcctccctacccataacctgtatttcctcaaacgcacgtttcacttatatgccctgattccttgtctttgcttggagtatctcctttgaaattcatatcaaatgccactttgccctattcttcctgatcacattcaacaaaatgtgagctctctctctcttttcaatgatcagacctttacaaagccttacgctcattgagtacttgttttaagtcttcagcattcggagttaagctccttggggactgaaatgatcatgcaagtttggcttgattttatgtgtttgataatactgattactctttgttgtttttttattgggcagactttgaactaactgtatggaactaatatttatgtatctatatttataaatattactaatatttatgtatctaggccatacagtttagcacttatagttgttttgtatttttgctgtttttccatgtgtatttctccagactctcaagactaagttacttggttcttattaagactaaggtcatattcctcaataagtatttgctggtttgtttaacattgctaaataaacaaagtgacatctctccatgccacctacagatgggcatttctttagaggtgacctatgactacaaaaattagataagatctcatatcttttcagattcttaccttctactcaagctcttcttaagtcttaccttaaatttaagtcttaccttaaatttgaccttacatatttaatcaatcctttaaaaaataaagcacctttttgtccattaaagtagaagggtaatacaagtgtgtgagaatacgtgagtgcacatgtggagaagctatatcccatgatattagagctttatgaaactttctattttcatgaccctaatgagaaaactgacttcttcagaatgggtttcatatgtaactttcgaacttgtttttcatttgtagtaaaagctttttatgtcccctttgctcctctatctggaatgtcaaattctaactttagctccactctcagactctagcctgtgagacatcgcactgccagtttcagtatcagcctccctggaagccagtgacattttgtcctgcacaccattcctgccctgtgctcccagtgcctctcctacttcttccttcttggctcctctggagaagccaaatcatattttaccaagtcagacaccttattttggtaaaatttgatgagcacattatcctacaagaaatcactggtgttagaatctaggcatgaaactgagcgctggccactgcaccattaatcagcagacgaaaagaaatctgaaaccaatgagatattttacttgccagtaaaatctctattttctaaaatttactttttaataaaaatgttgatacctaaatcttaatcaagggctatttgttatataggtttttactccattgaaatttccttttgaaagatagtagaaaatactctttattcttccatgatgtttctatgaagaagcacttttaaaatcaatttgttacagtaatattaatatctgatcaattttctctacagcaggcctaacatttaatgtagttctgcaggcttcttaataaattcagatttaaacattacattactttttggtgaaaccctgtctctactaaaaatacaaaaattagtccggtgtggtggcacacacctgtaatcccagctacttgggaggctgaggcaggagaatcacttgaatctgggaggtggaggttgcagtgaggcaagattgtgccactgcactccagcctgggtgacagagtgagactccatctcaaaaaaaaataataaataaaataacattactttttaaaaaagtattcttggttcttgttgaaagcaggttataaacagaggatactggcacctttaactgcagtttggtgcaggcctataagattcttaaaaaggttttaagatcatatgaattaatgaaaaactgagggcatttatcagataaaagaccaatcacatgatttgacaaggccttttaattaatctgctgatgctcttaaaaatctgcctctctgcctgaatgattattactagcttatttcttttcctgtacaagaaaagagatgaaaatgtccttcaacagtttattctgtgtgttcaagggaaaagatggggtgcttttcagcactctcttcagttcacataagccgcctctgtgtctgtaggagttgaaatcttcctgctggctattactccttttcctctacatgggatcagtttgaaagctacttgtctttggacttatttacaataggaataaaaagcttctgacaatgtcaggtagtggagagaagcaggaagctcagctgaggaccatgggaattcaagggagcaatctcagttgaaaccggatttctgaactcttgatctttattttggcatttgtggctcggggcaggtaaggtaaacagtgtccaaagttccccttaacagactgaaataatactgtggtaactgaagctttcaagctgctcctccatgccaggaatgtgaaggatgcctatgaaaacaacaaaaagctactactaatttaatcagatttttgttagattagaatgatacagttgaactttgggattttaaattcctttaaaatgttaatatttcaaagcattatttcacaattgccattaaactccttacagcatgtatttctgtaggtagagagatttctgctgatgtgctggaaatatgtaaccttgtattttgcagcctcactttcctctttagtaaagccctgatttcccaaaggggaatgcttccttcaacacgaggtttgggcttaggtaatagttgcagttctgcaggaacatcagttcaaggaatgatgagctaaatgccaaaataaagctgggatgactttatgattattgcgtatgaacaatctaatatgaaggagatttttcattgctaatattcaactactggatagaaaatatggctaagttactgagtttgttaatgtcaagatctcaaagagaagtacatggaagatagggtcaccagaactgaatctggaaagggtgtgtgtgcccccaggaatattccaccagaggcagcagtgttattagtaagtctcctcttatattaactatgacaaaagccagtgatggctagaagcaagagcactggcaaacatcttggtcatatgaagatgagcatcattgtctcctaattagcagaaatatcaagtatcccttaaaagagaacttggtgacagactgagaattagaaaatcatctaattttagagaccagagatcagtccaacactgacgttttgcagataagaatactgttggcttagcagagtgtgacgacatgtcactgttcattcaagatgagaaggctcagatccaaaggccaacatagttttctgtttcctgccttcccattctttgttgatactagcttgagataataagcttttttacaaatcatttacctgtaatgattcacatcatgaagagtatgatcacatggatgtgtccaattaattgaggttgttgtgcttttcttctaacctttcatcagtaccaaataagattatggaaagtgaaaagttgtaactaaatccctcagtgatataggcatctctgtataatagttccttggcctgtgaggaaatcagatgggcaatttgagtagctgtttgtggcagaacccaatctggcttgatgtgtttttccacagattgtgttgcatttctggaaaagtgctgtgagactttttttgacaccaataagatatatatatacatgtatatatgagatacatatatagatatgtatctcatatatatgggcgatcaataagattatatatagagatgatgtttatttttatatacacattgtatatatgtaaaatgaaattcttatgagtgtatatatactgaaatggaaagtcatgacattggagcagattaatgatctatcaagcccaagattctactataaatagaaaaggtatagctgatacttctaacaccagtccaaacgatttatatgttctcttgcattttcctttatatttccttttagaattatctataaaaatctataaaaatttctaaaacttaatctataaaaatttccaaacactctttgaacctttcaatttttacatataatttcctaaaagcagcatagaaaaaaggaatgtttttcttaaaaaaaaaaaattgaagttcagatcagagtttaaattccactctgcaatttcttagctgggtgactttctgagccttgttcccatacctgtaaaatatgggaatgataataaaaatacttacctcttaaggatactatgggattcagaatgtttaaaatacatatgaaaacgctaacagattttacccaaatgtgggtgtttttatgtcttatgtttcttgcgtaatatattccataaatttgttattagagtaatatttccttttatctgaaaatttccactttaaaaatgtccatttattctgatattactctatggttgaaatcctgggatctggtgaaaatgaaattgtcttaggcttttcatgattttatagacttaaatcatacactcctgaatcctttgagtatgaatgttcatttttgagctctgccatcttcatacagcctcccagctgttcattttttattcctgtcctcacacttgtcagcttcattatgtcaattttgatgtataacaactgaaaccaatcttagggctgcaggggtacagacagtgtagaaagaatagttttttcccccctacttatttccagatcatttcagaatcttgtagaccttcacaattgcagcagcaccttgagcttatgggctcagagtatatcccatcataattaacctcttagtaggcacagcatcctacaatttgggttgtgttacttgaatgtgttaccctatgcttagcttttaaagcttatcttttacttttctgcagacttggtctctagggtcattcttatatttgagtggctttaaaaaattttatttatacctcgtcaattcttaaaagaatttttagcaactcttctcataatatctctttggggagtttggcaacataagaattttactgtttaccagcccttgttgtggttcaactgctatgcagatcttcattcattagccagatatttattgaaacccacttatgccaggtactgtattaaatgtttagatacataggggaccaagacaaataaggcacaagtattcttgaaacttatattgcagcgagggaaaaaataagccacaaactctcttagtctgttttatgctgctataacagaatacttcaaactgggtaatttataatgaacagttatttattgtcttcctcttctggaggctaagaagtccaagatcagggaaccagcatctggcaaaggtcttcatgctgcgtcattccatggcagaaatgcaagagacaataggggagagaacaagagccaaatttgcccttttataacgaattgctttcccaagaatggcattcatccatttcaggagggctgaaccctcatggactgcttacctcttagtggtcctacctcttaattaccatcacaatggcaaataaatttcaacatgcattttggaggggatatccaaaccatagcaccaacataagagttaatacaatgccaacataagagttaataaaacaggatgaggtgaaaaagagtgcttagaaggctacttcatgtggcatagtaagggaggacctctctgaggagatgacatataagctttcatctgaatgtcaagaaggtcaccatgtgaagttctagatgaaactgtgtaaaggtcctaattcaggagcaaatctgaagtgttctaggaacagcaaggaagccagcatgaagggagcttcctaaaaggaagttagacaagggagaaatagacagaggcctgataacagggtattttaagccagggaaggaatttggattttatgatagtttcatagaaaaccactgtgatattcttagcaggagagggatgtgatctgaataagggtaaccgtggcataatgagataaaattgtgtttattcaaaatgtacctcacattattgcaagggtagttaaatggcacaaaagtctgtgtatctgttgatgaggaacattctgatttgtggctgggtaagacttccaggacactggcaatgattcctgaatatttcagtttgttgacatctatttttatctgattaaagaagaaaatatagaatttcaagagcaaaagaggtggtcaataaggccaaatactattaagaggttgagtaggatgcagaaagaaaaacaactgtttgatttgatagcagagaagcttttgatgaccttgaccagaacatggtgaggttggaagacaattgaatttgtattaaattgaattggatgtcagatgaaacaatgaaaacagagaccatttgaagttttactgtgaagaggaggagatagtacatagctcaaggatgatgtgggatcaagaaactttggttttattttgtcaaagttgaatgatactggagcatatttgcaggatttaggaataacatatgcaggaagaattttgcattgcaggagagaatgaggatagcagcaggaatgactcagtgagtaagaggagacgtgacccagagcacaagtagagagttgaactttgataggaactatgcagtttctcaaagaacgtgaggtataaatcgtcatgaccttggattatgcagtggtttttggttataacaacaaaagcacaagtgacaaaagaatgaatagctaaattggattttattgaaatataaaacatttttgcttcaaatgataccatcaagaaagtgaaaaaacagtccacagaatgggagaaaatatttacaaatcatatatctgataaggaaattatatctagaatatagaaaggattcttacaattcaacaataaaaaagcaacccatttaagaaacaagcaaagaatgtgcatagacattcctccaaagaagacatacaaatggcctaaaaagcacaaggaaaagatgctctaagtcattagtcatagggaaatcaaagcaaaaccacagtgacataccacttcacatccattaggatggttagaatcaaaacgacagacaagtggtgatgaagatgtggagccctcatctgttgctggtagaaatataaaatagtacacctgctttggaaaacagtgtgatagtttttcaaattgttaaacagagttaccacatgacccagcaattccaatcctaggtatactgccaagagaattgaaaacatgtccatgaaaaaacttgtacacaactgtttgtagcatcattactcaaaatagtccaaacataaaagcaatctagatgttcattaatgaatggatcagtaaaatgtggtaattcataaaatggaatattatttgctgtaaagaaaaaaaatgaagttctgatacatggaacaacatggataaaccttgagaagagtttgctgagtgaaagaaaccagacacaaaggccacatgttatatgattccatttatatgaattgtccagaatagtcagatccatagagacagaaaatagattagtggttgccagggcctggagggaggagagatcatagagagcgactgctaatgagtaagaagggtttttttttggcagtaataaatatatgctggaattaaatagtggcaatggatgaacaattctgtgagtatgttaaaaaccactgaattttacatttcaaaaggttgaactttagggtatatgaattatatcctagctttactaggataagatctggaacaagacaaggatgtccattttaaccacttctattcaacattgttctggaagtcctagccagagtaattagacaggagaaaggaatgaaaggcatccaaattagaaaggaggaactcagggccgggcatggtggctcacgcgtgtaatcccagcactttgggagtccaaggcaggaagatcacctgaggtcaggagtttgagaccagcctggccaacatggtgaaaccctgtctccactaaaaatacaaaaatgagccagttgtggtggtgggtgcctgtagtcccagctactcaggaggctgaggcagaagaatcgcttcagcttgggaggcagaggttgcagtgagccaagattgcgccactgcactccagcctgggagacagagcaagattcggtctcaaaaaaaaaaaaaagaaaaagaaaaagaaaaaaaataggaggaagtcaaattgtttgcagacagcatgattatgtatttatatccctaaaaactcaattttaaaaaactgttagaactaataaacaaattttgttgcaggatacaaaatcagcgtaacaaaagtcagcagcgtttctgtatgctgataccaaactatctgaaaaattaaggaagcaatcccacttataatcactaccaaaaaaatgagacacctaagaataaacttagcgaaggagctgaaagatttctacaatggaaacatataaaacattgatgaaagaaattgaagaggacataaataaatggaaagccatgccatgtttatggattggaaaaatcaatattgttaaaaagtccatacaggttaagtatctctaatccaaaaatcataatgcttcaagatctgaaattgttttagttctgacataccacaagtgaaaaatccacacctaatctcatgtgacagttcacaggcaaaacacattcaaacttgttttatgcacaaaattattaaaaatactgtataaaattaccttcagggtatgtgtataaggtgtatatgaagcataaacgattttcatgtgtagacttgggtcctgtctcctagatatctcattatatgtatgcagatattcccaaatcttaaagtatctgaaatctgaaaacacttctagtccaaagcattttggataaggtgtacttaacctatactacccaaagccatctatagatccagtgcaattcctgcaaaaaataccaatggcattcttcacagaaagagaaaaagataattttaaagttcacatggaaccacaaaagaccctgaatagccaaagcgatactgaacaaaaagaacaatgctggaggggactgcagcagatgggtgggctcctttgactccactttgcctccttggcaatgagtgggctatcccactctcccacggcatctgtatttaaaaaaaaaaaaaatactgaggcatcacatcgcctgacttcaaaatacactacagagctgtagtagccaaaataacatcatactggcatgatgtattagcctattcttgcattgctatacagaaatatctgagactgtgtaatgtattaatattaagaaaagaggcttaattggctcacagttctgcaggctgtacatattggcttctgcttctggggaggcctcagcaagcttccagtcatggcagaaggccaagggaaagcaggcacatcttacgtggctggagcaggagcaagagagagatgtgggagttgcttcacacttgctacacacttttaaacaaccagatttcacaagaactcactgcttactcactatcataagaacagcactgaggggatagtgatcacccattcatgagaaactggccccatgacccagtcacctcccaccaggccccacctccaaaattggggattacaattgaacatgagatgtgggtggggacgcagatccaaaccatatcacctgaaaatagatacatagaacaatccaacagaatagagcacacagaagtaaatccacacgtttgtagccaactgatttttgaccacagtgccaggaacatagggaaaggacagtctcttcataaatgatgctaagaaatctggctatccatgtgcagaagaattaaactagatccctatctcttaccacatacaaaaatcaactcaaaatgggctaaagacttaagtgaaagacctaaaatgataaaactactagaagaaaacataggggaaatacttcatgacattgatctgggcaaagattttttgggtaagaccttaaaagcacagctaacaaaagcaaaaatagacaaataggattatatcgaacaaaaaaactccttcacagcaaaggaaacagtcagcagaatgaaaagacaacctacagaatggaagaaaatatgtgcaaactattcatctggcaaggggctaatataaggaactcaactcagtagaaaaaagaactaaataaaaaatgggcaaaagacttggttagacatttctcaaaagaaaacatacaaatggccacaggtataggagaaaatgttcaacgtcactaatcatcaaggaaatacaatgggaaccacagtgagacatcacctcaccccgattagaatggctattatcaaaaagaggccaggcgcagtggctcatgcctgtaatcccagcactttgggaggctgaggtgggcagatcacttgaggtcggtagttcaagaccagcctggctaacatggtaaaaccccatctcttctacaaatacaaaaattacctgggcatgctggcgggtgcctgtagtcccagttactggggagattgaggcatgagaatcacttgaacctgggaggtggacgttgcagtgagccgagatcatgacactgcactccaggttaggagacagagcaagaccctgtctcaaaaaaaaaaaaaaaaaaaaaaaaaaggaatggctattatcaaaaaggcaaaaaaaattgttggcatggatttggagaaaggagaactctcatacactgttggtagaaatgtgaattagtacagccattataaaaaacaatatggaggcgcctcaaaacactaaaaatagaactaccgtatgatccagcaatcccacgactggatatatagccaaaggaaattaaatcagtatgcccaagagatatctgcactcatgtttattgtagcactgttgacaataaccaagaaatggaatcaaccttagtgtccatcagtgtgattaatagatgtttaaaaagtggtataaatacacaacgaaatactgtttagtcatataaaaaaatgaaatcttgtcatttgtggccacatggatgaacgtggaggacgttatgttcggtgaaataagccaggcacagaaagacaaatactgcatgatcttcctcatgtggaatctgacagagttgatctcatagaaatagagagtagaataatgatttccagagactggaaaggggaaagcagagggaggaatggagagagattggtcagtgggtacaaagttacagttaggtaggaggaataagctctggcattctgttatacagtatggtgactatggttaacaatattgtgttgtatatttcatattccccttgctctcaaatcccaggagtgtaccctatttagagctaacatctccctgacttatattgacctttctcaagacaagagtttttcaaatcatagcattatttataattgagaaaaattggaaaacaagcacaaggttaaataagcaatggtgaaataccaagtaaatattttgcagccacttgggaaaaaaatagcgactttgaatgttctcaccacaaagaaatgataaatgtgtgaggtgatggatatgccaaataccctgatttgatcattacacaatgtatatatgtattaaaagatcacacttgtaccccataatgtatataattatttatcaaaaacaaaatacaaattaataagttacctgtttttgaaagctattatttttatatgccatgaataacaaattcaaaaatataatggaaagaataaatggcatgataaaatttaggaaaattttgagaataagaggaggggaaattattctatagatagtaatacatgttatagagttttaaataagaatgtggaactgccatggagacaaaaaaggcaatttaaaatctagaaagagatctaagtacatgtattaggaaggcaatagatagtaaaaatagtgcttctcattggtggggaacgaatagattattaagttgtgatgttcaacacctagctaactttatcagttagtggtttaggttgaaaatagtagaagttaatcctggcaggcttaagtagaagaacaatctataggaaaaatgttgggtagctcagagtcaatggaaagccgagctcagaagatggacaggaaccaaaggatgctaaggagctgggaacacagcctcccttgtgtcacaagaataggatggcactgtgctgcttttgctgctcaggactctagaccccaccactctgccaccacaactaaactctaatggtccctgtgtgtttatatcatttcctcaactcagatactgaggcaggattcaaacacagagcctaggtcatgggccttcatccttattgttgtgagggaaagggatgcctggccactttcagcttctgtggtgggaggcagggcactatagcatctccccaggtagtaggtgtccaaatcctggagccaaaaatgacagatttccaccaacatttggaatgactaaaattagaaccatactttatatcatagacaaaaataaattccacatggattcagaatttaaatgtaaaacttgagaccataaaagtacttgacagaaatatgcatatttatgtattcttggttcgagaaagttgataagcaagatataaaaataagaaagccattaaaaatattgatagagcatattaagtgactcagaaagagaattatgatctgttgagtttcagaaagtttacattaaaaatgggtataatgtgattacatttttaaaacaggatcacatttttaagaaaatacacacacacacacacacacacacacacacacacacacacacgcacacacacactcctttccaaagaggattagaatggcatataccagaatatttcgagtggttctctggatgatgacactagagatgatttttccttccttccctcactatatggaagagggttttttttttttttcaaaagctgttatttctttttaaatctgaaacatgaggaatttggttggttggtttgtaagagtatatagtatctgggtctccatagataaattttatgctaaactctacaaaagcgaaaataacttctaagaccaggtaatgaggcagttgtgtttcaacaatcccatccatataaaaataatgttaaagtggcaattggaatttgctccatctggcggtccttcaaaagaaagaactggatagtgggtgatgactcaaagaataccctccagatcatgatgtttctctttcctcccccagtgtctttttttttcctttgatttgttttattttgtcttctctttaagagaacccatctgcttgactaggaacttactagttagtattcagggtatgtcatctaaaggacaccagatgcagagactctagagatattcgttatggcctatgttttatcactttacgctcttacctacaaaataggagttgccccagcatttcatgttttaacaacccttagattcctgatgtcttgttctctcttatctcagattgctgtctcagtaaaggatgcctaacctttatttcacatgagagacagagcagttcttgcttcctaaagtgagtcacccaagtagaaggactggctcttcacagaagtcttggtagtgtaaaggatgaggggaggcacttcatgttccagaaagactgatcatgagcacatcatagagagagaccaagagatctggagatagcaaagaaagaatgaacctaaaaatggtgacttgttcctattcttgccacttggttttctttcttgtaaaagaaaaggaatcattctggcttccagcttattttcctaaatgccattagcctatactagtaagaagatatgaatcagtaaacacagcttgccagaatttcccagttgtagtggtcatgttctaagagctcttcatatattttttcaaaagtcccctttttctatgatcatttccccagggggctcattggacatttctgtcatgtttcttagtcataaagaacatgactctgaacttctatagctttcagtatccatgtcttcatacttcatgttaatatggaaaccccattgctctggactggaattaaattagtattaacttggcttataacaaaatttaacaattaaatttaccaatttaatacttaataattaataagtataagtaataggtaataagtataagtaataatagttaataagtataagtaatacttaatacttaataagtaatacttaataagtaatacttagtaatacttaatacttaaattggtattaattgacttgtagttttcacctgtgtgggggttctgtagttttcacctgtgtggtattttgtaaataccacagctatagatagaaaacagcttgagcatatgtgtattttttgagctacacatttcatgagaacttttgtagttctctcatgttttcctctctttttcctcttaagtttattttgatgacttggagcaggtggtagccaggtggaagaaaatgtatatttcttttctctggtagaagctagaaggagctccttttatcctggtttccttggctttatagtgtgaggttctgttggttggttgtggaacctggtgatattctgatgcatggagtacaatacacggagtttagggttgggaagtggcaggtgctgtattgttgaggtacagtcccttccctctagctcccagatcctgtggacaaggagatataagcgcattggtaagaaggacacactctgctctgagtgatgatggtgcctgtaaggacaatccccttccagcctagcagtcctctaccacatctgggtacagtgagactcactccagtactgttcttgtttctttccaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaggagacttgtacctccataaaatgtgttgttttttcttaaaattgtttttgtgcataaatgcaaaagtccaggagcataccaatgggatatatcttgatatcccaacagtaggctggggtctgtacctagcataaagcatcaccctaagttcttgtatttttatgaggttttcatttcagattttctaaacttgtagccagtagactaaaaactaacagggctcacaaatgttaaagtgttattagttaaatttagcattgcagatgagaaacttttaatgtttgccagatgccactgtggttctttgtattttgttcttttggagaaacatcatgtcatggcagaaacagcatggttttgaatcccagcttcatgacttgagcaagttatttaaattctgagtctcagtttacccatctgtacaatgggactaaaaaccccttattcatggttatgaagttgacatgagaagcagtgtccggtatagtgtgtgcgctcagattctcaatgtccataatttgccctttttttctcccatgaattatacttttgtcctggagtggtgcaaatggcctggagtactttttctctcaataagggattattgctaaaacagtctctttctgcatgtttactgctatttaaatacatacttaatctatattccttatttaggatatatctcttagcatgaatgagcttggaaagaaatgaattttgaataagggaaaagagataaaccagcaggggagaaatggaaaactgttctttgcataaacagaggtaataaataggctatggaaatgaaaaataaaatatcaggttataaaagacagagattaaaggaaagtttgataaactatgtattttgtaagctaaggcaattaatatcttcttgacattcttatcaatatattaagaaaatcctgacttctcattgtcttggaatttttatttcaaaacatacattctctttaacatcttagccctttggattatttccaactttatgtcctttgtcatggttaatttccaattagctctttccatatgtatttaaaactagggatatataggttctccttacttttataatacctcttgtgtctttttcattcatttctctatacatgcttctagattagaaagaaaagaaacaccttttcatatgtttattgatggaacttgtcatacatcaaattagtgggctccatatctctctagaagtatatacacacagaatggatgagcagttgttaagaatgttgaagaaaaaaattattgcagtggaaggagactggccatgatggcctttgttagcctttctagctttagtatgcagtgatgtgatccaaaagtacggtgagagacagcattaagtaccctcattcatgtgtgtcatagcctgatggcacaatggaaagttctatgcttttgcttgccacctaggattttgaacttttgccctgaagctttcatgttgatagagaatgcagaattaagtccacagaagtaaatgccttcttttaacagctaatgtaccaccagtgtctaaaactatttataaatgttcatgtctggcaatagacaaaatatagtagtttgttagttaaaagctttttatgctctaaaaagcctctaaaaagttgatttctaacaatcaatatcagcataaacaaaaattttaaactcagaagacataaaagtgattaaataatacaattaaaagtcaattgaggctgagcacagtggctcacacctgtaatcccaacactttgggaggccaaggcgggagggtcacttgaggccaggagttccagaccagcctggtcaacattgtgagaccccatctctacaaaatttttttttaattgccaggtgcagtggcacatacgtgtaggctcagctactcaggaggctgaggcaggaggatctcttaagcctaggagttagaggctgcagtgaggtatggttgtaccactgcactccagcctgggcaacagagtgagactctgtctctgaaataaaaaataaaaattttaaagcaattgagttcacatgtggcaggaattcttccttgtaagcagacaattcactgaagtttgggggaagtgagagaagagcaacatatcaccaccaaagtctattacccaaagaatcttcatgaaaaatatggtatcttccaaaagattcccttctctttattttgctttgtacttggtttagtttctattttagctgcataaaaaacatttgtgcaaaatttattgctaattatttagtttaatgcgtgcttcagttgcttttttcttccaaattttcattgatatgtaaggtctttctacattttctaaagtggtcctattgatacattttaggatatcaatgatgtgtagctcccacagtggcaaagccttgttcaaagtttaatttctatagcttccattcatattgtcacatagcaaagctgtgagctgtgtgcttgtctgaatcacatgcttacacactcacacacattcacacactcacacacacaatctgactcacactctagctttgtaactatcttgtgattcacattcagctagtattcccacccaaagatgtaaaaggtaagaatccagtgataatataattcacatagctagatacctttccattttctttaaaaaaacagcaaattacaccagtgagaatggctattactaaaaagtcaaaaaataacagttgctggtgaggttgtagagaaaagggaatgcttatacactgttggtaggagtataaattagttcattgtggaaagcaatgtggcgattcctcaaagagctaaaaacaactaccattcaacccagcaatcccattattgggtatatacccaaaagagtagaaatcgttctaccttaaagacatatgcatgtgaatgttcattgcagcactattcacaatagcaaagacatggaatcaacctaaatgcccatcaatgacaaattggataaagaaaatgtgacacatatacaccatggaatactaggaagccataaaaagtatctattttattgatttaaatcttattcatctccactctctagtaactataatctttatatgagtgtatctcaacacaactgggctacatattacaaagaaatttaaaaagtttatcagccaggcacagtggctcacacctgtaatcccagcactttgggaggccgaggcgggtggatcacctgaggtcaggagttcaagtccagtctggccaacatgtgaaaccccgtctctactaataaacaaaaattagccagacatggtggtgcatgcctgtaatcccagctactcgggaggctgaagcaggagaattgcttgaacccaggaggcggaggttgcagtcagccgagatcgtgccattgcactccatcctgggcgacaagagtgaaactccgtctcaaaataaataaaataaaaataaaaagcttatcagtcttgaaatagcacaacattccaggcgtctgtttttccagagagacgttttgaggataaatgtactatgagtgggaccagcccctcttgacaactaaggatattccttttgtctggcttgttcagaagtactaaatattccaagaaaatcaataatgatgttttggtttagttcttttttttctatttttaatttttgtatgtacatagtaggtgtgtatatttatggggtacctgaggcattttgatacaggcatgcaatatgaaagaagcacatcgtggagaatcagttatccattccctcaagcatttaccctttgagttacaaacaatccaagtacactctttaagttattttaaaatgtacaattaagttactattgactataatcaccctgttgtgctatcaaatagtaggttttattcattctttctaacttttttgtacccaatcaccatccccaactccccctttccagccactagtaactgtccttctactctccatgcctatgaattcgcttgttttgatttttagatcccacaaataagtgaaaatgtgtgatgtttgtatttccatgcctggcttatttcacttagcataatgatctccagtttcatccatgttgttgcaaatgactgcgactcattctttttatgactgaatagtactccattgtgtatatgtaccacattttctttatccattcatctgttgatggacacttaggttgcttccaaatcttagctattataaacagtgctgccacaaacttacaagtgcagatatctttttgagatactgatttcctttcttttgggtatatacccaaacgtgaggtttgtaactcacatagtgattttttattgcaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtattgtcacaatgagattgcgggagttgctttcatctttgataatggctcagacccttctgttatttactgtgtgtttctgactgattcttctcaacagtcaatattttaatgccttcggatgatttctactgttgtctgtttcaccacatttatcttcctgtgacccatttgtcattagtctaaccatcttcatttaaactattaaaaaggcagagctatttgcattgtatcactgaagctggtagtgaaaataatgctcccaggatagatttctttttccttttagtttttcgagaaatttcaagtagcctgtttagattttgactgaagtatttttactgcttaattgctggcagtacagaccagcatatgaactgaactctgttgttaaatatggatcatcgtctctaacccttcaaaggaaattcgtgaactgtacatcctacctcctctgtaggcagtggcaatttttatgcagtaacattcagcaataccctatttatccagctttgtccaaaagtgaagtcgttgaggaaaaatatctggaacattaaaacttttaaaacttctgtggataaaaaaagaaaaaaccactttctaaaatatattataaacatccttgccataaacagcagaccttaccaagcagaatgtgttcttataaaattgggtcattattagaaacacagttgggtactgcacaattaagcatgaaatcatccaaaatcatgtttccatctcaattgtggaacccagtgttcaaacttgttaaatcagtaacctgaattttgtaaataaaacaaatttcttatttgtgcccaaactacaatctgaatgaagtagaaatggttaacaggaccacataggtggtaagagctttgaaatcacagttttgcttactgttaaacagcatttttatcatcttatttctggatttatggctgtattccaggcagactgaaaccattggaaaactggcattactttttgaaatttttttaatatttaaaaataaatatttttaaggataacatgaatactcatactcactagtatgaattagatgaattcttcatctgccttaaaatagtactcatgtagatgaagaggaatgaacaactctgggagagttgttaggaggcaaaatagactggatgttggtaatggctgaatgctgggataaaagagaaggagatgttaaacatgacttcttgtacaactggaaggatttggggttttgttcaagaagtgctgaaagagaaccagatttgggaagaaatcttgagtttgttttgaacatactaagtttgagattcttttgtgacatttaagagaagatctacataggcaatttttgtgttgggggtggtgcacatgtgtgtctggagctcaaaggagttataggctaaagataaacatttgtgattcttccacatattgatgtaatggaagctggaagcaaatactgaatgataaagggtagagtgtcttgagaaacttggacatttactggttgagtagaagaggaagggcttgcataggaagcagagaaggtgccagaaagaatgaaggaaactaggaagtgatgtgtcagggaagcagaaggtagggagcataatggtcaacaatgtctacatctgctgagaagtcaagttaaatgaggcctgaaagagttcattagatttctcaacttgaatgatttctccgttcagtagaatggtagagccaggaatggcttgaggaaaaagttggagaaaggaaattgagacagtggaaagatccaactttggagccataatgggtgagcctatatagaataaagaaaactaagcacagatctttggaaatacatacatttaagggggaggaggaagaagaggaagctgcaaaaaagatgaacatcaggaagaaaaccagaagagctcagcatcagagaacaaaaaccgtaggaaatttgtagaaagaggggtcaccaacagtgccaaatattaattgtggcgatatcaaataggatgaagcctgaaaaataggccaaagtctgactcctaggaggtgattaatagtccctcagagaattggtccattaaaatactgagggcataggcctagattgcagcaatttaacaagggcttgtggaagtggaggcagtaagagtagattcaacctttaacaaatgtgtcagaaaaaaatggaggaaaataaaaacatttggtttgtgtagggaaaagagtgatagtagcttcaggaaataagattggaaggaagatgttattttttttcaactgttcttgtttgcttttaggataaggcaatgtaagcaggtttgtaagatgggagacatgtctgtggagaaggaatcattgaaaatagaaaaagaggggaaattggagtatgacgctaaagctgaaaggaaaaggtgagatgtcaagggcatagataaagtgttagaaaggaaaagagaggatatttattttcttggagccaaagcgataggagaggctgggtaaaaattaagccacaaagagtttgggaaacaaacattgatggcagtttagataggccttcaacttttgtcagcagttttcatcagtctaggagctggggtggagaaaagggggatgttgtgccctctccaaagtctgggattcaggaggtatgtcgggtgggaggacaaaaagctaagaaaatcaagggtgtctgatatttctcatcttaatgtcattttctaaagctgtgaatgatggatagcttggactcgaaactcaactgccatttttttcaagttttctgtagtgagattggacagacctcagaatattttcttccacgatcataacctgtccttaatttttttctcattggtaccaatattcctccacacccaaatagcactgttactatgctaccttggcctcgttttctaggaattccctcatctgtctttcacaaaagctgcagataaacgtgtgccattttgatagaatgtccatgaacctgaaagagaaatatatattttctagagcttaacctcttgggtgacaatgctcaggaaacacattaaagtcaacagataataaattttatttttaatgttctggaaggcagtaatttcctgagaccatgttcctgataccttgaccatgtttacgttattggtcttaatcagggagaaatgatattttcagaagtcaaactgccattccctttctaataaaatatgctctgatttttgggcattgtagggtagtaaaactatactgggggtatatcacatatagagtgttattattaaaagccatgataggagaaaggctcctataaatgcattaagacctcattttttctagaagtcatatccagttattgggaatacagccaagataatataagccaaaatgtcttccaagagtcagaataggtgctataaaatgtatgcaccttagtcttcattcatgagtttctgaggtacttacccagagtgtgtttgctctttcttaatttagacataattgtaataaagatggggatgtggtttcttagcacatagctcattagggcaaggaatatacaggtatcaatagaaagtacaaacctcagttaaaaaaaaaaacttaaaaccttactaaagagcctcatagtatcctgggatctttattacaaaatcaaatcgttccattgcctctcagtagtctttagtatatgtatgacaccagcaggcagtcatcaatactctcataggtcccttacaattcttagaattgtcataattctctgtaatattgaccctgatttatttccctcatgagctctatttttacattatctaaactggcacccctgcttgtgggagtcactcaaagccgttctctttatacacagtctgcttttgttcatctgaaatttagagcaaatgaaaggtgatggtcagcggtctggaaaattcacatatctgtatcacatttatatcacagtgttgccaggtcactaacatgtagcagtaattttgttcccacctctaagccttggtcatttcttaattatctgcattagtggacgtaagcagtggctggtatcatcaaaaacaggtgatagtccttaatttttttttattttgagtttggaatacttgatttatttttttagtggatttatctctcccccaaaatttccttaggccaatattaaaattagcttatgtcctaactattatacagtaagagcagtaagtggcagctcccaaacattttgtatgacagagggaccagattagagtggaaaaagtgatcctggagtagattgtcaccatgaaaggactcagtctacattagcaagaaaaaaaattgtgcttttacattgtacagactacttatataagcatgcaccagagattgcttatgtataaaatagatacattctaaatacttggtgcatcctgtttttttaagaacatgctagatttttcaaccattttgatacagataaaagcttttctttatgattcagagaagccttagaatagtttggctgtggcttctctgtgtgtcgttggggactttactgtaacaagcttactgcataagcagaggctgtcacctaagggtaaatggctgcttggtaagttttattgtctacattctgaggagttgcatcttgaattggttttaatctaccaaccaggggcatgtattaaaatacacattttcacaatgatagatatataagtacatgcatcattgtgaatcatgatgtttgtaaatttattgctatgagccatatctgcaactcaagatagctgttggtggggattggtttttatgtgtgaacacttactaaacataaaaggaaattcaaagttatgtagttactatagcaacgacagctaagacacattgcagattcacatacattcatgtatttaaatcaaacgcccatatataaatatagtgtgatagatttagagttgctatggaaattgagtttgagctttctgctttccttagggacttcagtgttttagccttaaaatcagattaataggaatgccacaaaagtggtttcaaaaggaagcaacctaagtagaatagaataaagtatttgagcaatcataattaaatccctaaatgtagatttgaataaatcctaaggtgtttttcaagaacattgttgaatatttgaatattctcactcaacaattacccttaatgttgggttttctaaggctgtttgtatgactgtaaaatgtaatcatgtttattcatttatttgtttagcaatgtatgagcatttgttgagcacctgtcatctaagtactcatcacctctcaccttcttttgggaaataagaattgctttactttgttgggttttttgtttgtttgctttgctttttaagagaagcagtaaaaaatagcagtaaggagtggttttcatccttgttctgatcttggctttatggcccaggatgtagtcttttttggtcagcggaccacatgcacttgaaaagaatgtgtattctgcagtagttggttgtatagtgttttagaaatatcagttagatcaaggtgtttgatggtattattcagatcttctatgtgcgtttttttacttacctaataccagtgtcagagtaaacagatctgtattttatggatttttttgttgtccagttctaacatttgctgcagagtctgttgaattttcctgcattgatcatggaattgtccatttttccctttaattctctccatttttgtttcttgtattttagtgctctattactagatgtatatgtatttatgtatttacgagtgttaagtcatcctgttgaattgaccttttttgtcttcttctaaaaaaaaaaagggatacatgtgcagaacgtacaggtttgttacataggtatatgtgtgccatgatggtttgctgcacctattgaccagtcctctaagttccctcccctcacccacaacacccaaacaggccccagtgtatgatgttcccctccctgtgtccatgtgttctcactgttcacttcccactttgagtgagaacatgcagtgtttggttttctgttcctgtgttagttcgctgaggaagatggcttccagctttatccacatccctgcaaaggacatgatctcattcctttttatggctgcatagtgttccatggtatatatgtaccacattttctttatccagtctgtcattgatgggcatttgggttggttccatgtctttgctattgtaaacagtgctgcagtaaacatatgtgtgcatgtgtctttatagcagaatgatttatattcctttgggtatatactcagtaatgggattgctgggtcaaatggtttttctgattctagatccttcagaaatcatcatactgtcctccacaatggttgaagtaatttacattcccaccaacagtgtaaaaacattcctatttctccacagcctcgccagcatctattgtttcctgactttttaataatcactattctgactgtgtgagatggcatctcattgtggttttgatttgcatttctctaatgatcagtgatgttgagctttttttttttttcatatgtttgttggctgtgtaaatgtcttcttttgagaagtatctgttcatattctttgcccactttctaatggggttttttctttcttgtaaatatatttaagttccgtgtaaattctgaatattagaccgttgtcagatgggtagattgcaaaaatgttctcccattctgtaggttgcctgttcactctgatgatagtttcttttactctgcagaagctgtttagtttaattagatcccttttgtcaattttggcttttgttgaaattgcttttggcgtttttgtcatgtagtctttgcccatgcctatgtcctgaatggtattgcttaggttttcttctagggtttgggttttacatttaagtctttaatccatcttgagttaatttttgtataaggtgtaaggaaggggttcagtttcagttttctgcatatggcttgccagttttcccagtaccatttactgaataggagatcctttccccattgcttgtttttgtcaggtttgtcaaagatcagatggttgtagatgtgtggtgttatttctgaggtctgctccattggtctatatatctgttttggtaccagtaccatgttgttttggttactgtagccttgtagtatagtttgaagtcaggtagtgtgatgcctccagcattgttctttttgcctagaactgtcttggctatacagggtcttctttgattccatatgaaatttaaaatagttttttactaattctgtgaagaatgtcaatggtagtttgatggaaatagctttgaatctataaattattttgggaagtatggcctttttattgtatgaagtgttcctctttatctttgataatattctttgtcttgaaatctattttatctgacattaatctagctactccagcttttatatgcttactgttgcatggcatcatctttctccatgataagttaaatttctgcctgtctttgtctttataaagtgtgacagcatgtaatcaggtcttgcttttttattcattctgataatctttactgtttaattggagtgtccagcccatttacatttcatataattatgtaattattgatttggttggatttagagctaccgcattatcatttgttttctgtttgtcccctctgtttcttgttttgttgtttctcccttcctgccatcttctggatttttaaagtattttttagaattctattttaatttacttaccgccttttaaactacacctctttgcactaattttttaggggttgctctaaggattacaatatatattcttgttttttcacactatcctttaaattaatactgtacacctttatgtaaaatgtggaaaccctgcagccacccctatagttgtcatatgtattacatttacatacattatgaacctcacaagataatgttataacttttgctttaaacctacactgtctaatacacgttggcttttgaacacttgaaatgtgcttattcatcattaaaatgtgctgtgtgtataaaatgcgtgctgaatttagaaaacttagtatgagaaacagaatgtaaaacatctaataatttttgtattgactacatgtagaaattatatttcatatatgttgtatatgttttgcgtatgttaaagtcagtggagtttttttacctttttgatgtggctactagaaaacttatgtggttcacatatttctattagatggttatgctttaaacagtcatatctattgtagagaaattacaggaaaagttgtttatttcatatttttactattttcaacgttcttcatttctgaacacccaagttccctagcggtttcatttctcttcagcctgaaggacttttgttaggatttcttatcctgcaggtccagtggcaaaaattattttagattttctttttctgtaaatgtctttattttaccttcattcttaaagaatattttcacttgataaaggattcaagctgggttttgtttttccttttgttttattttttgcctgtaagcactttaaagatgttattccactgcatgtggcctccaaagataagaagtgcatactcattctaccctggaatggaatacatagtttttctctgagtgcagtcaaaattttctccttatctttggttttgagtagtgcgactatgatgtgcctaattatggttctgtttgaatttatcttgtttcagagttcattatgcttcctgagtctgtgaatttatgtctttggaaagattccaagcattattttttcaaatatttttttcagctccattctttctcctgtccttctgggacttcatttatccatatgttagagcttctgaaattataacacaagtccctgaggcacagttgattttcttcccagtacttattttctctcttctttagattagatggtttctgttgatgtaaattcaagtttaccctctctttcctctgtcatcttcattctactgttgtagaagtcttcatttttaaatttcagctattgtatttttctgtttacttttttttctttctctgctgagtttgcctaccttttcattcattatgagcatatttcctttacttcactaaacacgcttatggtagctgctttgaaagtttttgtctgctaattccatcattctggccatctcacaattgacatctgttgattttatttttctttgagaatatgtcacattttcctggctctttatatgtcaaataattttgggttatgtcttagttattgtgaattttagtgctctgaagactggattttgttatattgctgtaaagagggttgatgcttgtgagttaacaggcacttaactcaattagagtccaagggaaaaatactcaggaagttaactcccattcaaggggatcttcaaggggatctaaccttagcctcaggcctgtctgtgcctttatgcaagacttcgttttccttattattgcaaagtggcactaaatcttcatttaccttttgagaaactccttaatttaaccacaaatgttggtctttccctaaagccattatttgctctaagaaattcactttaggtcagtctatgatggcatttgacttaccggagccctgtagggtgggcacaggtactcttcttgtcccttgatggtcttgctatcaagatgagtcatgcctgtttattcttacaattttccagtagatgcctacttgatactgctattttacagtccccagtcacttatccacataccatcctacccaagtaccttacgtatgtctttaaggatcaaatattaattttagaaatcatgtaataatacaaggaaaagatgcatttttcttactagccccataattagcaagacttctcttcaaatagatgttagtacttctcattattatgcagaacactgtttctttctttctttccttccttcctttttttttttttttatggacggagtttcactgttattgcccaggctggagtgcaatggtgcaacctccgcctcctgggttcaatcaagcaattctgctgtctcagcctcccgagtagctgggattacaggcatgcgccaccatgcttggctaattttgtatttttagtagagatagggtttctccatgttggtcaggctggttttgaactctcaacctcaggtgatccacatgcctcagcctcccaaagtgctgggattacaggcgtgagctaccacacccggcagaacattgtttcttttacccaacccctaccccatattagcatggcatccttttgacctgttcatattaagaaactatcccgttgctaagctgcataccatttaatgcctactcccttagctacatcaagacttggagcaaatagaaagaaatattctaatggcccaactaattaaattattgtagaagatcccctactccctggaagaagagaggtagcagtggtttttttcttctgattacatgtgtaagatgtataaaagacactgctagacttttctcctcaaagaataactgaaactgcatttccctacattttagtctgttcaggcttctataacaaaatgccataaactaggtagctttgtataaacaacagaaatgtatttctcacagttctggggactgggaagtccaagaccaaggcaccagcagattcagtgtctggtgagagcctggtccacatacatggtgccttctcattgtttcctcagatggcagaagaggcaagcccccttaggcctgttttataagggcattgatctcattcatgagggatctgccctcacaacctagttacctcccaaaggccccacctcttaatactactgtgttggggattaggtttcaacgtatagatctgggggggaacacaaacattcagactatagcacctacctcttatgatgataaaaaccccagcataaaatatgagcagtgccctgccttgccaggacactgaatatttctgaatttaaactattgagcagagagaagagcagaaaattatgaagaattctggagtttcaaataggaatctcctggcagcgtctgtagaaaagcccaagggcttcttcctaggaagagccgtacatttttcattgccatcctaatttctttgcttactgaggtagcatttttgacagatgatttactaattcaatttgcaatttttaattattttggctttctgggtcaaagtatgtacattgttttttaaaaaaaaactagagtgttttaaagcttagagatcaaaaactacagaatgttgtgatactattactttgcaactcagaatctgaatcttaatatgaatagaatttttcatgaaagttaagggaaatgaaaacatttaaaatgtggaaggaaggccaggcacatgcctgtagtcccagctctttgggaggccaaggtgggaggattgcttcagctcaggaatttgagaacagcctgggcaacatggcaaaaccccgtcttttcaaaaaatacaaaaattagccaagcatggtggcacacacctgtagtcccagctactcaggaggctgaggtgggaggatcacttgagcctggggttcaaggctgcaatgagccatgttcatgccactacactccaacctgggcaacaaagtggaaccctgtcccaaaaaaataaaatatagaaggagtcatcagtaatattagcaaatatttattgagcacatattaagtgtcagctattatcctaagaacttaatatgtattcagcaattctaaaagacagatcatattattaccctccactttaaagttgaggaaactgaggcacggagaggtttagtaacttgccagggtcacacactagaaggagaggacttaagatttaaggcctgactctgtgattccagaatccatgctctttcatcattatattatattgcgtctctcatatgtcatggatgtggtcttgttttctcctcttacctcctccccacactatgctgaaccacggtaaatttcacaaccaaattcaaattacatggtgtatggaggatatacaaagctctgcaatgttgcttaggcttgagacagcagaacatatgctgttgtattgcgatgacatttttttttatcgtgatttttcaaaagttcaaaaacatttcctttcatccttacagtaggttctagggtgagagagagttactatactgtagagttactgtctacatttatagatgcaggaaatgttaaaaccatttgttccaggcctcttattagctcaaaagcagaagtgtatacaaagccaagaatattgagccctagattagtagaattactaatctctgatttcttaatccttcaagtcaattagctctccgtgtgaatggtctgggtgatttgaaagtgaaggatagatgcaattggcatgtatttgggcactcagagtctgttccttcacacagagctctgcagaggagggcgagggtctccactgttgtcctccctgcactggaaggcagaccatcctagccctttttaaaacagcattgggtcattaatcttatatagctgttcctgatatgtgttgaaatattaattctataactaaaccccatgtgctcatctgatggatcattccttttctctccataggaataatatcagattttacttctcagcctagctgtaaacctcgccaggccacacaagacagtgacttaggattcattcttagtttccacagcagaatatcatagattgtctgtgaacctatttttctttattattgatacttttttttgttgcttagtatattgggcaggaatcgaaaacagctttgacttgtagaattttctagaatccctttgaattgggtgaactacactataactcaactttgtcttgctcaatcattgttcccccattgcctggcctgtagaaggtcctcatataattattgagttgatgagtttaagttgaatcattgcagcattcatcttgatcaaggaagatgtagtactcagtcaacacatggctgtttttgaagtgctctccagtcatttccatcacctgagaagccccttacactgtaacttagaaagtatgctagtacactacacagtagctcagaaaatgtttccttttgaaattttgtttcaatagtttttggggtacagatggtttttggctatatggataagtcgttttatggagatttctgagattttagtgcacccatcacctgagcagtatacactgtacccaatatgtactcttttatcccacactcagcccccaaccttccccacccccgaatccccaaagtctgtcatatcactcttatgcctttgcatcctcatagcttagctcccacttagaaatgagaacacgcactatttgatttttcattcctgagttatttcacttagaataatggtctccagctccatccaagttgctgcaaaatatattatttcattcctttttatggctgagtagtattccatgatgtatatataccacattctctttatccactcattggttgatgggcacttaggttggttccatatctttgctattgtgaattgtgctgctataaacatgtgtgtgcatgtgtctttttcatataattacttctagaaaatgtttcttaccagttcctactttttggattccttgctctttttgtgaaagctttacctgaattctcagtcattcttttttactaattgatttagtttgtcaacaaatgtttgttgaagcactgtaagagattctggagatacatagtgattctgacaagacctgttttcaaggaaattaaatcctagtgggaaaatctgacaataaataggcaatagtaatagaggcgagttccttcagcatatataggaagaacacctgagctagtcttaaacatcttctataaaggtttctgaaaaaagtaaagttcaagcaaaacttaatgtataagtagatgttagccaaacggaggtgtattgaagagcattccaggcagaaagacaaggatgctgaagtcgaaagaatgtgctccattcagtaaagtgcatgttgttcagtgtggatgttgagatatgagactgcagagggaagcggggctcttcttattgctacaaaaataaaatcacaaacttagcagcttaaaacaacacttatgcattatttcacagattgtaaagtccaggcacaacttagctgggttatctgttttaggatctcaccagactataatccaggtatccactggggtggtggtctcatgaaaggctcaactggggaaagatttgtttccaagccccctcaagttgttgacttgaggctgcaggaccaaggcttcagtttcttgctgaaggccaccctcagttcctagaggccacttgcacctccatgccttatgggcttttccaacaaagatgcttacttcgtggcaactgcttcttcagggcagtaggggaagtctctctggtgtgtttgtcagcaagacagtcatgtagtaacataatggtaagagtgactcccattacctttgccatgttctgtgggttagagtcaggtcacgggtcttacatacactcaaggggaggctatcatacaaaagcatgaacaccaggaggtggagatcattagggtaaggggattactgtaggatttgtttgtcacaccgaggttacactttatagtagggagtcatggaaaagtttaagcagaagcatgctttgtattatagaaaacacattagagagggcacagttagaatctcgtaaaccagctgagaggctttgcagcaaaccacatgggagaagacagtggccttaatgaaggtagtagccatgcgggtgatggagaccgtaagatgatacagtcagcaaaattggatgattaatgggttatgggaagtaaagcagaggaggaaattggggataaatgttacacacatttctgacttactagtcggttgatagaagcagagatccctggaccaggagcctggtgagcatggggctcaccgcggagttctcccttccctgagctccagcctgccctgtggcctcagaccgtgtctctcttagccggagagtctggataagatggtgttaatggagcacaacaggctggccaccatcggaaaaacaaccgcaaacactggtcttgctagttattggtcaacaggggttctgactggagtctaaaggacaagacattatacacttagtacttacgttcccccaaaatgaccatcctagtgtataagctttttggttaaatgactgctgcgtaccaggagtgcagtagcacccttgatgtagttgttgtggtgacacctgtgtgtcgtctgcccagtgggctggctcagtgtgctgggctctgtcaccatcttcccctgttactgcagtaaacaggcgaaggggtactctaaattattgttgggatgtggtgtgtgtggttttcactggggtgagtgagcctcaccatttctgttgctctgagaatgatcaaaaaataatattttaaatgaagatagtgattggatgtgatacttaatgtgttttaaaggacacttaatattttaccaagatgcgaggggtgaaaagtcagtagtttattgaaagaaatagcatgttgaaataactatttaaaagagaatttttaatacttgagccattttaagatgcagaacgctttcctgcatttttccccctgtgaaaaattctctgaaaccagagtgactcaagcagagcctggaaaatactggagaatcacatgatggctaaaaataagcacatcatctctagcagggacagtaagcagcagggcagaagtaactcagtatgtgaaggctcacactcactggacatgctcaggagagtcaggccctctgtccttggcaggggcaggctttgagaccacaagtcagcgaagagaggtcctcaggtgctgaccactctgtgccacagcagccatgccctcggcaggcccctgacctgcagcgcgcctcactcgtatgctctcccaggggcagagccatttattttacactgtaatgacccctaaacagtggattgggagggaaaccggctgactcagctcttgttactgcccgttttctcttaagccctccccttggaatcaatagcacatgccattgatcacagaatgtctttttgttgctgttaacattgcaaaacataggttttgtgaaattgctggacatttggcgactgttctgtagggtacagaatagggtttcctaaactatagcattgcaagtactttaccaaaaacacaacaaatcttgtcttgggcactcactgctcatacccaggaaaattactgcagtagccacctagctggcctttctgcagctcccctcagcctccctggtctgttctcaacacagcaggcagagtgagccttttgaaagcaaagctagatcatgtcactctgttcaggatcctgcagtggcttcccttttcccttgcgaggtcctttgcgacctgcccttccagtacatctctgaccttctgtctacctacagtatcccattcttaccctgcctcacccacctgacctggctgctgagtggagaaggcagggcctttgcacccccattcagcatttcctctgcctggcctgctctgctcctggctgtccagacggccaccttcctctcctgcctcaggtcttggctcaggtctcacacttactgtgagagaccttgaagaaggaagggttactcctgcaactggcatgttccctgcagggaacctggaagttgtgactatggagtttgttacaagagctgttggcttctgtgaagaatgagacttttgagccccggtgaccccacacaggaggttctcgcctcccgtgtctgtgccagactgctgcaggactcccagcaagaggggcacctggcgctgccctgctggtgcttggtgttctgacctccgttcttctgggtggccttggtgtgagtgtggcccatgaaagtaccatgggtctgagttgaaaaactgaaactggaggaagacccatagtggatgcttaggccttccatgaaattcctatttaaaattgctacttacccacccgcagcccagctctgtctacccaaccctgctctgcttttctcttgttcatagcacttattttctagtttattctatcacttcctaatttatgttattatttattgtctagttcccctgttagaatgttaattccacaaggacaagcatcttgtgcgtttcattcattgtttgatctcaactgcctgttagcttcccaggtacataatagggttatggctcaataaaaatttgcacaaatgaatgaattaggataatttagaagaagcacagacggagatagatagggagtgcatggaatggaaggaacctatgccttggagcccattggtgggttatgggttaatcacattttttggttctaaaaacaaatttattgaagctgagcatatttacatgatgcagttgtgcatctttatacagtagttgttcactgtgtaaaaactgggttaatcaatttttataaaaatgttctttaaataaaaatgagccttattttcttagtatttcagctgtttttagtagtatctagaaatgggaaacaagtgcacttttgcatcatttgttgaatcaggtcttatttgctgagtaataatagtaatgtaagctaccatttattgagcacatgctgtgtgccagacccttgtgtaagcattttccatgtattaagtcatgtacccctcccaactctgagaagttggtgctgctcctcctttcttaaatgtaaagcaaggtggccacaaagccacaccagtcaggaagtagtggagctgggacccctaagaaggctctctggctgcagagcccccactcttgaccactgcactcactccctccctagaggcaggtgaaggatgtccaattccctaccaggtcttcattcccacgagattggtgtggctagtgcctgctgtgtggagctgcccctagctgctcaaggaggactgcccactcttaagagcctccactgaaaaggaagagctgcagacctcaccactggctgcactggtcagaacagaagtcctaagggctgtaaactgccaatttcagaattaaaaaaccagcctcctagtgatctcatgaatcagagcatcccagaaccctgttaaagtttcatttggatggaaatctgtccactgaggtgcttttttgccctcagctcagagcagattacagaatctacaaagtgacagtacggaggcagttttgaaggaaagactaggtcaatataacttgaatttgcagtaatcagaattctgtagggactggcaaccctattgcagtatgagggctgtggtgtcagttcagttactgaggaagtcctcttcctatggaattcactctcctcatcagtctagcccataccctttctccagcaatgacattacttttttttttaaccaagctcatcatctgttaaaaaatataatctctttgccaaggtgcaggggataagaaagtaatatcaaatccatccacaatgaatcaatacagatgcagtgtatcttctgccatagttgttcagctctgggttttcttcaattgagtgagaacggctagggggatggtttgggaagggaaggggctctcaaagtagagaaaaattgggattgaccatgaccagaagagtggtggccgcctgcatgtgtgtgtgcacacgctcatgtttttaatgtctcttgtcaacagtattaatgtcatatttttatctcctctgtttatgactttggcaaaaggaataatatggcagattatgtgaaaagaatttctaaattccagcagagtcttggccatgaaggataaagccaagtccagtgctttgatttgcttcatccttctgaatccattgggcctcatatgcccaacttgttgcagcgttttccataaacattaagcaagctactagttattgacattagacacggtaatgccctggcttcactaaggcagtgaatctgaccactccgaatttttttacaactatggttaaaatgtcagaatcatatttatacccccaaatcctaaaggcattaattaagacacaactgctcaaagactagcattgtaaatcatgtccagtgagcaaattcagagaattacagggacttagacagaatttatgcttttttcctctgcttctgagattcctttttattttgaaaggtaaaattagggaggtagaaaagcttgagggcaaaatggttacttgtaaacagggccactactaattatgttctcaggacatcctcaaatgcagcttgaaaaaaaatttgaaatgtttgaatcagctgcaagaaaaaaaaatctatatctgtattacagccaaagtaggtgcactctctgtaaaagctgttatgtaaatgttttccacataagcatcattgagccaagaggcctggtaaaggtacagaagtcaaatcactgatggagtggggcattctgggaagcaagaagatagctattgaggacttcagtatctaaaaccaggattggatgctgtcagagacatgtttggagcagtttacgagattggaatacagatggtagctcacataaaagtattctatcaatgttaagtttatgacattgataactgtgcagttttgtgagaacattcttgttctagtgcccaggtaagggggaaagagtatctggcagccccagaaattttagagtgtggttgttagaaggcagcgagacctagaaagcaaataaacaaaaacaagttcttaactctaaagagttatgctgtatgttaggatattgtcttttatttattctgaaaaagaaaacatgaaatcattgaatataatgaggacaaaaggtttcatttttatttttatacatttagtatttcttaatcatgtgacagctgtgaggggtaaattacttccgtttcaaattgcagcttgggatgatttaatgagcccactttacatttatttgaaaacaagcttttagtttaactgttaattatggggtttttttgttgtagttgttgttttacccaaacctcggaagatactaagatctttcccatgcctttcctgttctttaatttcttcacatttattcatttgaaggtaaaaatgtagttaagtaggcctgatctcacatatcctcatgcatcatttattttcctgttatcagtttttctccgaacaatagaatttcaagatccctctcattttaaatatcaaatactagttacctaagtgattgattattaaatgtttagaattttttttccatttcttccttcactcagcctgcactgtgtccccgttagtgaggcttaacggtggggcagaagcggtgcttccatcccacatgtgtgtaggtggtggagcagcagaggttgccgagcctgattttcatcgcctgcacctctctcatctcaaagggatccaggaggtgcacgtgtgtgtgccagtgggaaagccctggggccctaggccaccacctgacctttgcctgattcgtgagcacagatgccattttagggccgagactctgctgaaccacagcttggtgagtccaagccacacaggcaggttgaagttgggctctgttaacagaaagggatatttcctcaggggaagaaaacaaaacaaaacctgtttccccaagtggctgtgtgtggctagaagggggagagcatcagtaactgcagcagctgtgccctccctccctgccgtgagccatgctgagcgcctccagcggccggggattctccctgcgtgtctcactgctctcctggccagtgtcctctgcttcttcatagttgctcttccccgataacgtggctttgcccaggggtttggcttgccatgaccccttctacatcttatcaaacatttcagtttttttttcaagctctgtttgataataccctgagaatataattagtggtagccctttattgtaagcaatcagcttctgtttcttccatgattttttctttttaaattgacatcagactggataaggccagataccagaacatgagtgtgtctgatgatcctagctcagttattgcaacgacttttttgttgctgacctgcctatgaaagactgccagggtgggtgggtcatcacatgctatctagggaagccccctctgcaaggctgtgtccctcaggaggggccagtgagcatggcacaggcttggacagcccagcatagaccactcagagttaagcatatactgactgagtttactccacctctcctaattgtgtaggtaaggagcctaagtaatttacagaaggtaatcttaagaggaaaccaaggaggagctctctttctgggaggctgatggtttttatttggtttccttcttgtcttgctggttctttgtgtctgtgactttgacattggcatcagctcctcaagcttcccctggtgtccttaccctggagagatgcctctgctaggtcttatataatgaattataaaaactattattgaatttctctgggttaggcactgtgattggtggtgagagcataaggtgactaaaacagatgaaacacctatgtcctagggtttatgttcatgggagaagtagacattaaagaaatagctgtaccacaacagtggaaagtgttcagggcactgtggcctcccagacaaagtgacatctgagctgagactggcagggtggtagacctacttgctcagaggaggtaggggacaggaaggaggcagagagaatacagcctgacttgcatggtgtattagttcttacagtgccataaagaactgcccaagacaggataatttataaagaaaagaggtttaattgactcacagtttctcagggctagggaggcctcagaaaacttaaaattatggctgaaggggaagcaaacatgtccctcttcacacggcagcaggaaggaggaagtgccaagcaaagagggaaaaagccccttaaaaaaccgtcagatctcatgagaactcactcaatatcacaagaacaacatggaggtaaccgccccccatgcttcaattacctgccacggggtccctcccacaacatgtggggattatgggaactacaattcaagatgagatttgggtggggacacagccaaaccacgtcacatgggatggtcatggagtcatagaaccctggcttgttcctgagaacattgaaggtgccataccagaaattcttagatagctgttgctctgtgtgagactgagctagagaacaaagactgcatcttaggcatttttaggggcctccagtgcatggcccatggcaggcacttaacaaatatgtgtgtaaggggtgttgatcataggtagtcttcgcactgctttctgttagacttcctttatattaaaatatgaggtattgcttataaaaagatctgaaagaacttgatatttccgagctgtctccccagctgttaggctggtggctgcctcagagaagattctttgccagatcaggtgtcctcaccctgcctcccctgcctgcttgtctacttgttttctttacccagttggtttgcctttgggttaaagaacttggtcagcgggacatggaagtagtgttccaggagtgttttatatgggcttcaacagagctgaagcccatataccagtcacaaagcaaaacgtcagctctctggaaccctggggaagctcttctgcacagatttaccctgagaatattcaaactattttaagtctttcccaatttaaccattctcattttaaagtatattaggcacctccctgtgtttttaaagaagtttattttttaaaaatttttaacagaaaggcttatatttaaaggctgtaatgctgtcagtgcttctagggggtgtgacttgcatccggagctaatgaccccaggcacctgaagacacaaatataaattttatggtctttctgtttgctactttgtaattaggatgttggttgaaacttgtaactgctgtcacatacctgtctttataacccttcggctcttgctaatctcttggtactaataaactgtgaagttggaaataaactgtaaaattggaaaccgcatcactaaaagttttatttacttgtttatatagttagttaaacttttgctctttaagcaaatacatgttcagctgagcattgtgctacgcactggggttacaaagatgagtaagatgtgtttcttgctctaaataagagcaggggttggggaattaggccagtgggagcacagagaaggaacacctgcaccacactgaaggggtagtggaagacagagatgccacttcacagggactgtgttcagaggaaaagggaatggacgggcccccagtagtggcttggaatttcataatccatgaagtacactgcgtatacattgggacatctattttggccgcagaggccattcttgtgtctgcgcgttgttctaggtagtgagagtctattgtgacctgagctccagataggcgaggtcttacctgaaaccaatggtttttcttttttccacttcacaacattattagtgatgctaagtggatcacttccttaaggtgctgactctcagatctccccattgtaagggtgtgttttcccctttagagtaacacatgtaaatatcttgttccccaaaaccctctcacctaaagtttacgtgtccaatgacgagccctttgtgaatcgcttattagttacggatgttgcaaaattgtgatttattttctagttccagcatttcttgcatatttagtggctgccagtgttccttaaaaaggattgaaaagatctttatattcttttctcttccctctccctctccctgtcttccagcccatctctttttcagtcattatagattaatagatttttatttatccagtgcattacaataaatgaagctattgttcttcctgatattcagctgtcccaagtgtgactagttgagagccccttcaagctcttgatataaatcctggagcacctccttgctttttgacacaagatatcctaagcttaccctgaacattccctgcaccatccctagaatcagccatttctcaagaagcccttttattgcagaataacatttagaaaccaaagtttgggcatcaggagtgccactgctatggagatgtcattgctcttaggtactttagtggctaaagctaggaaatgttttaaaagagaaaaaaatacatttggattgatatttctgctgaagtattaattggttataagatcttttctcttgtttgttagaaattcaattagggtgatacttttaagtttatctaaaaacctttcctcttaaaaatcttaaaatccctttgttctcttactcttatatctccagagggagaagggacaatggcattaacctcatgttacttgaggaaaaaaaaaacagcactcacaaaggtgagataagttgcccaaaacaaccgtactttaactgtgtacactcctgctgaaatatttatactccttctatatgggaagggatcactggaggtatctcttatatgttgttgtaagctcttttcatatcattcattttctatgtatctaaaacacacttttaatattgccagtatttatcatttattctgattgctttcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtaatgcatcagctctggccacgcctctaggagcagtgacgtgtgtaagaggtagggggcctaggatcccctaggactggggtaagggagggaagggtaaggaagaatccttggtttcaagtaagtgagaataaaaagaattgttcgaagacaaaatcagtagcccatgatgaataaaaagtgttagtcacaaatctcaaagctgtacattaagatggggcagatggctcagccttgctgcagacttcaggctaccttcccctcccctgctcctcagggccgtcaagagctccaggctagaccgttgcccatcctgcccacttctggccattctagatagtgctgcattagggtgagtctgcctccctctctttttaaaggctgggtcagggttagtctgtctccctcccactctcttcttttttcccttcttcctttctttcttcagctattagtagttgagcttattctatatgaaagatattacgcttaatgctggtaatataaaggtagtaaaatagatacctttccttccttcatagaacttggagatagcagttgcacacagtaagttattacacaagcaaaacaaaaaacctgatacttcccacaatggcagaagttgggtgctgcaggagcaccgaacccaatatttgggggatctgaaaggccacaattgtgttttaagtagaagagctttccttttaatttaatatgcctcacagttatggtaaaatctaactagctccactagtctttgaaattttcattataaaatcttaggtactgctcatctttcctaagattatatgtagcttaaaagtaataaaagcaacgggtagtggagggcccatcgaggagagccttttatcctggctaccctgccgctatgagaggagcctttacttcagggccccaggctgttcccagccgctcactgggcccgtcgtggtgattaatcttattcttgatgagccagcaagagtttaaaaacagcttttgtgataattgtatatttgtaatcaagaatctagtttaatggaggcagtttcttagctagggtgtttctttacaattctgatcactttatggaaaaaggtataaaaacaagccatccagcaggtaggacttggatttggaaactagaatgttctaattacctgctgattctcagtttgagccctgtttccaataatgacttcttctcaattaaaaggcagtaaggacagtcataatgaaccttggtccacatgcctcaggctccaagaaaatcagagtagacctaaaggctgtaatgccttggacctaaagttagtcctcccatatccatgggttaccacatctgcacattcaagcaaccaagtattgcaaatattcaaaataaaaaatagcaatacaaacataaaagctaatgcaaattaaaaacagtacaacataactttacattgtattaggtattataagtaatgtagagataatttaaagtatacaggagtatgtgcgtaggttgtatgcaaatacgatgccatcttgtatcgtcttatatcagggacttcagcatccatgggttttcatatctgagggacatcctggaatcagttcctctcagataccaaggcacaactgtagaactctttttccttaaggaacccaaattcttttggtatctttcttatcttgtgtttcttcatgactcctccctctcttccccgtctgccacacccagtgtcccacctctccagcccaaagtataaccacgtggaaaccttgaggttctctcccgcttatagcctgaaccgcccagccccacttcccctccttggggctggctgtaggctcccgctagctctccagatcacacacagagccccatccccagggaactcagacctctaaaatgcctccactaaaccatgctaccatccacaatgccactcagagaaccgagtgagaagagagaggaataggccagtgccgccttcctgttataatcctttcattacttcccaaaggcctgcctccccatttctgcccccaacaccttcacaccgaggaatgtgcctgcccctgtctgtccctcagaaggaagacacaccctgaattctgagtccttcaatcagtattactgagcacttactccaaatttatatccgtggttcactgttgacgttccctcctttttctgtcttggagccaacaggatgccccctgagcctggtagggggccccacaggcatcatggtgttggaacaaagaacactcgggcgaggagaggctgaggggagaccctgatgctgaagggtgaagcacagtcatcactgagaaagagacaagtgccataaacttagaggagtctcatttgcttggcctcctgcattttctcaggcaatttcccatgatgcactacagaagtaccactatgctagaccattcccatgatagaaatgaatcaaaagatttaggaaaagtcataaagaaagtaattagggactcgttctgtatagtgggttagccacccagaagtgggttggagtcagtggattagccaactggaagtaggttggtcttcgctcggagcgcgggtggggccacggatgggtgtcgattagcccaggcagagactatagccatcactgaaacagcaaggcctgcaggaacctgcagtctatggccacactgggaggagttggaagaatggtaagaagagtgctgcttctcattttctaagatcatctacagcatctccttcattgcttaagcatctgccataacccaagagggatgaggctggcattggtctttgtgagggggactatgacagtggaattttgcttgccaattgatctttcatcatgtaagttagctagtgttggtttttactagggaatgttggtagtggcagctgttacctaatgcatgtggaatatcactgaagcctgatttgcactaaagggttgtctggaaaagcctcagctatgtgttcattgtgcagaacaaagccctagggagccagacagacctattttcgtgggttggatgtgtccttgcctggtacagggggctgggggggggtggcacatctaagctgccacagatccatctgctggcactagcacagggttgagatggattttatgtccaaacctggggagaggttggtttgttttaaagcaggaaaggatttctagaataagagttttcttttttctggaatttaagctggtcaccttcagtttttttgtacatcttacaaatgtgcaagctatagtattaatagaaatgagttaaaagcaaactggttctccactgctttgcaagcagccacatgggggtgtcagtgagggtaaccctgaatctacaggatggatatggtttgccaggtgcacaggaagaggatggacactgcatgggctcagtgtgtgtttgaatgaatcagtaattccagatggataaagcatacacaaaggcccagaattattagaaggagagaggaggaaatttgcattccaaatgtaattttttgaaattctattaggggtgatttttaaggtaatgacagagagattttacctaaggagggccatgaaagacttaatttaccacctgaagcatataccctacataaaaataaacgaagggtttaaacaaatggggatcctcagagaccaggaacggggtaatagtttgggcctgagtgtagctgctgcgcctgtgggactatggtagactgagatttgaaaccagatctagtcacaaccccgtgagggtttctttagctctgggtgtccgagttcttggaccctcttttgaccactgcctcctcccttcacttggactgttctgtagccaccctgagaagctgcacaaccctggaaactctgaaccaggatcgaggggaagaaagaggaatgagggctactgtggtgagggaataggccttccttgccctcctgccttcccagtgacgtacccaaagcccgaactagagaaattgagacagatccactcagccaggctttgggtcttacccagttttcctcgtgtcacgaaccctcagtttctccctggagagcgtttgtctaatgtggctcagtatcatttgtgaaagggtctagctaagcgtggcttccatgtaagtgatctaagggacggagagtcctcaacataaaactaaatagccatgcttacagcctctctgttctgcttctctttcctcctcccattctccatttcctgcagaagatgaacaagtatttcagtctgttcaggctgctagagcagagtactgtagacagggtgacttataaacaacagaaatttacttctcacagttctggagactgggatgtccaagatcaaggcgccagtagattcagcgtctgcttgaggccccattcttcatagatggcaccttctcactgtcttcacatgctgaaaggatgaataagctcgattgggcctcttatcagggcactcatcctattcataagggctctaaccccatgacagccacctcccaaaggccccacctcctaacaccatcaccttgggtgttaggatttcaacatacacattttgaggagatacaaactttcagaccatagtaagaagttagaggaaagatgtgttccagcctatgttagcaggagacgaaagctcacttccagcctgcggggaaccgcacaagcagaaagaccactctgtccctggttaataaacgctcagttgcctgaagggaatgaccagagtgctgtggagaattggacgttttggcccagggtcaagctccagacaacagccctgttgtttctccctcagacttacacattggttatttctgcttctctctctctctctcttttgggttttattcacaggaattgctggtcatgtcttatactatattttgggtggttttttttcttcactctcactcccttgcaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgtaagtgtgaggagcatgtgactcctgtgttctaaaatgactctcttggtcaaaacacagtagatcagcactccttagaatacttccccaggacctcaatgagaattactgctcagccaagtgcacctgatagtcccaaaggaataaacatcgttatcatcatgatctattgacccatgcctgtgggacaggcagtcataaattaatctgggaagagacaggtggggtggggaaggctttgacagaaaaatatgcttatgcagccaaactgcaagtggtctgcagctctctgagcaaatgagcattaagaatttgtatacggattcctccttcttcatgcaagtacagagtgtagttaaaggagaaaataatctagatgcttttcccatccccagaagccccataattgactgtttttatttcgtagctggttgtcttggttactcattgccaggacagactagagctgtgggacagccacatgcccatctcctttatggggaggagctgccaccagagttgctattcacaagtgctgctattcacaagtgctgctattcacaagtgctgatggagacccaggatgtggctgtgtcagggtgatgaaaagcagatgtgagaaatggaggaggaataagaatctaggaagcaaggagagaaagcggggcaggatgcatggcagagactgaggcaaggcaccccgggtctgccagtgccaggagagagaggcccagcagccagaggtggaggtgggagcctgatgtggcttcaccttccacagagccaagttgaggggttggggtgtccagcttctcttatgccaggctgatgctagtggaagtgtcccggtctctgggtgttctgagcctgtgatgttctgagggcctccagtggagttgtatgtgttgatatttctataggacatagcaagccatcagcaagtttactctcttattccagctgaatcccaggcaaatgtttactccatttatgcctcaaaatactagcagtgaaattctcctaaactgtaaggcactgtatctgtggtttggaagctctttatcacttttttttttcacttcttccaaatattttgatttaaattatttattggttatcaatagctcagaatttgaagccctgataatccacctggtttccatgatggcttcataaaatacggttctcagtattttcagatctgatggaataaaccagagactgatttgtagtatgtctgcagctgccacagtgtcacatatatgacgtcctgtgtgtacagagtgcttgccctctgtaagcactagatggactatggttattctcttcacaagcttatttgaggctaaatcagctgagatctccacagcgccatgagactgagtgaatggcgctgctgtctgcgataacgcctgctagtgggaataaggccggcgtgcaggatcaaatcttcttcccagccctgcacttcaaacggggaaaccctgagtctaacctcatgccagattttgtcccaagagggagtccatgtgcaggagcactgtctgacagtgaactccaaatgaagtgttggagaggtccactgaattcccggctaagataggtggacagcctcaggcaagagcccttgcctcctgggtgtgatttccagggggtctacctagatgaccgcactcagtttctgttctgccatacccatcaccacccgaccccacacacacatacatcccagcaccaccttgccaccatctggattcagagagccattcctgcaatgtacatgcaactaaaatgcaagcaccccaagaagaaataacactttaaggcctcatcattcattaagactaaataataagtttagcagacacctcttctgagacacctggttggggtttgaggtagaagggtctaggacttgacgtatattagcttattagctcctataattctctagagaatcctattaggtagctattgtcatcccattgtacagatgagggaaactaaggcagcagagaggttgaataactttcccaagtctaggagcagaataatttccatttgaaccctgaaatctgaatcctgagtttatgttctcccttctccaagtctgaggcaccttttaagtgctattatgacagtagtaatggctaatactgattgagcatttagcatgtgctagggattgtattcatttactacgtagattactgaccttaaccacatccctgtgaggtgagtaattacttatctacattttacagatgaaattactaacccaatggctcatagttaataagctccagcactaggatttgaacccaggtttatctaactcagaggctaaaatcataaggactgagttacctccctcgccgagtggtgggtaccatggagcagggaggaaacgaacatagtactagttggggaaagcctcaagattaactgtctacttgacagtcttcagttgaacacgccctgtgtgtgaagaagaaagtttccaaatttttacgtgggttttctctaaataactccccttacctcgttttgttgattttcaccttcgaaagcctagttgtggcctctttttcggggcattcatctgattttaaatgagcatccacaaagaacttcagttttcttctagccagtttgtaacttttttaaacccactttgttgttgtatctctggcactgcgctgacatcatcaaatagctttaagggaaggaagagagagggaaagagacagaggcattgccctgtaagtatatgctggggagtacccaaaattcaagaagagaattactcagagtaaccaggcagttgaatctggcagagaaaacagccttaacataaattgcatgtgtgggttaccagagcaagatgttcaaatgcagttactggcttaatttttctagttccaggatatttttattgcaactttgtgtctgcaaaactccaaaagagacacatcaggctatactgagttttctacagagagtaagccgtttgatctggaatatgccaggtgtccttatttggaatgtgacaagacccatttgtttaaaccttggtttttatgcagaaagaaaaggaaggctgcagtgggcctggatgccgtgctgggtgctttccatatcctgtgcatgcatgactctgccgagaggctcaggagcagctagatactctcctttctgccccctagcactccacctcccagaggtccaagaaatcatcctagatatcttaaagcctccaagcattttcatttcttcctgagaatatggaatctggtttctctggaaccacccagaagcacatagccagtcctacactgggggagtgagccttcctaaagctgtacccttgcctgccttcccctatgtctatggtctggaaaagcaacggttttgaaaaacaatgtgcttagtggttacgatgccatcatacaccactgcccccatctctgggaatcctgcctttgccccactgtgctttcccctgacattgtgtcctgttttctggccagccccacacttgtgtgatgggtagatttgcacccatgtgcagggatgatgtacatggcgtctgggaggaagtgccagcactttgttcatgatgctgttggtacagctgtgtgtacagagctgagatggcacagatgcctggtggtctgcctttcccagagccctcctggagctagaaggccaggttgcagcacatgctgttcagctaaacatagatggacatgctttgctttgacatttgaggtaggagtatttgctggggagatctcttcccctgagtgattacttaacactcttattttgtgatgattggcctctgattgttatatttaagccatcccagaatatggtgtttggaagatgtgaaaatccaggtgggagttttgagcagaaaatcaacagaggtggttcaattcccagttgtagagacctaatggaagtttccagagcagatacttattctcattatgttttcccctgatacgtaacttggagccacaggagtctgggctgaagcattggttacctgctccctgtggattctgtcagctgaagggcaccagcttatgaacagttacttgtttcctgcagggacaggctgtgcttctgtcactggagggcctcttgtcactggactaagtgctggctatagaaaaagacccaaccctacctcagaggagctcccagtcccagtaagggagacagacagggacatgactaactggaatatgtgtcagatgatgacaaatgtgataatggagacataaataaacttgtgtggggagcagataaaagccgcctggaggaccatgcagagacttcacagcgaagatggcatttgtgttggatgttacagggtgactgggaacatcaacagctctagagctaaggtagggagaaactgcatgagcaaagcagagaagaaagaccagcagccacagctggcaaggtggcaggagacaaggctgcagggtggtgccttccacagctaggaagccaggagctgttggagcttcctgatgggccttcctctctcctttgcccccattttcctcccacagtggcctagagccttcttcaataccatcttccagtttgcctctctatctaatgattataaggaaactaaagaatgatagttttcttacaatcactcacagctcaacggaaagatgtgaatagattgatacgcacatattagaattattaggtgatgctctggtgcattagtctcatatttggtataggttttgcctggcctcctacttagacatgggtttaagttcttcattctcgtataaggcatagaaaaagattgttttttcctgtgagcctgcaatagcattgtgtgggctgtgagctctcagttgtgatttgtaacaccccagaattacagatgtgttctgccagactctcagactgccttaacttgcaggccaagcatgagcaatccattgataaattgggagctttgctggtatttcccagtgagagttgtctggggtccacagttcctgcagatgcatgacatcacagaggggtcctgtgactgagatttaagctggatgtgcatgagaagcagctgccctgggcatctggaagcctcagagccatagaaaaggccagcaaacctgctgccttgttggatgtgtttggaaaggaggcctagcctagtggcttcctggccctctagtttattacaggctcaatgattacttgaatctaggtctttcaactttagctccattagcccacaataaactcccagttgtgacgtgagcaaatgagaatttctgcaaaatgtaaaacagttcctcatttctgaaatcttcttttcagaagtctaacatgcacagaaacaattatataaagaaaagcatactttagaccagctgaagtttgagcaatacaatatggaagacaccacactcacgttcaagagttaggatgctgaataaaacaatataactcaccgtggagggctcagagcccggctggagagacagatgtgtagccacccagcaagaacacacgcgggactgtggtgcgccctcccaccgaagcagaaactgaggataggaagcttggagagggaagccattatctcggggctgcaggcagtgagagaggcttcagggaggagtgactttctcataatttagaggagcatgtggcgggacagacagctgggagttcccagcccaccattcttgttaaactcccatgaatgttagtttcattcttctcccttggatgagaggagagcactggcttaggaaggccagtaactgtttcttgtcctgcgctggcccaagaagaagttctctcctgctcccctgagcatgtatggccacactgttggtgaggcactgactctgagctgagaggaccagcctcacatgtgccagacagaaggcaaagcagtgtgcagaggaagtgccaagagcacagctgctgtgatgcccaggggtctggggtcgatccggcagaaggggagtaaagaggggatcagggctctgagatctccctgaggtcaaagagcacctgcaattaaggaatttgggagtgcaagggtcaggaagacacatgatgtgatcagagagagcaagagattgggcctaacgttccagaagtggagctagttctaggtggtgaacacagggtggtcatggggtagggagagctcacatttgctgaataaggggcctgtcggcacggtaagagacaatgccagatttttccccaagttttcaacacaatgtcactgtctactgttggttgacacagaaagggttacttttttaaaaaaattacttgcacttctagaatatattccagagttctcccactaagaaataataatcacagctcacatttctatttaccatgtgccaaatactcttctaggcacttttcctattttaactcattaactcctctgttggattcgaggagtcctttgattcattgactaatgaaaatgcattgaaaatgctcctacatggataccttatccccaactttacaggtgaggaaactggggcccagagcagttaagttctagacccaaacccacacggcctgtaaataacagagctgggatgtgaactcgagtccatgttgtaaccttgacattctacttactgcctctcagaaaataagtggctcgtgaccttggctgatagtctgatagtctcagtcattcatccttgaatccactgcaatttgttcctctcaacacgacatggattgagtcttacataagaaagatgtggcaccgagaatccgatccctgacctcagtaacctcagcatccagtgggtggggccaaaagggtcaagacaagattccaaatcagtgtcatagcagaggaagaaaacaaatgctgcaggagaagagagaaggaattctggctcagtgatcatgccatatttgaattggctaaagatgggtttgtcctaagctccaaggaagaggggcccgacagacagggaagggcttgggcagttcagtgctcgggagccagcgtgccaggtgtgcgaggcatgggcacttccatatgtcccagcacatgctccagactgcatcacagaagctgtgtgcccttactgagggaacagggaactcctttgattagccatgctccctcagcttgggtaaaaaacagcaaatattttgtgtgagttcagaaaatgaatgaatgtacagatacggctgactgaggctagtgctccctggagttggtgttcatgccatgcttcactgggttagataaaggaataaatagggctgtttatttctaaatagtgggaagaacaattcacctatctgattctcagttgataaacataacgtaagccaaaagggccccaagcagtctaagtagatgtcccaaagtccttgagctaaagctcctgagctccctcattgggaggggcctctttgcctgggacaacccatgaaatgtggctgctgtcctttccttagcctgggaacctctaacactgctgctctggtatctaagcctacatcaggttagtaacataacaaagggtctccttcagggcgacactgccgagcaagaagaatgacagcaagggagggactaggaaatggagcaaaagcccacatccctatccattagtgaggagtgacaccccgcaccaaaataccatggaggccaggggtgctgcttttatattacagcagctttactcatggttgtcatgatgctcttggatcactgtgtttggtttactcttttacaaaggttaggaaagtatgccatgtattctaagaagatttccttccaaaacaaaatagttgggtgcctaaagcctgacgactgtgctttctagaatgatctgttctttgatcacatggggaagctaaggcgcccctgcatatgtatcagacaccggaagctgggagacgtttgcatggcgagttgtgcctaactaagcctggtgccctccacagccttgagacgccatgctggcagtggcaatgggctgggatgctgcagggccccattcccagtcaattatctcagctgaaacttctcccctgcccacaggagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacactttccttagcggcccctggtcacatgtcatcgggctgggcaggaagcgtccctgggtgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaatctgcctggagttacagattcttaaatttttatgctgaagcttcccttttcagtcagcatgtgaataggaatagatttgtgtggatttacacatctacccacattttattatgatttccccggggcgggggttgtctttgtttttattgatggccaatgttgttaacaagagttacagactcgtatttgatatcaaatgtagcagctataataccttttaaaaactttaccaaaaaaaaaaaaaaaaagacataaagagaaaacattcccttgggaaacattccacctgcaagcaaacagaatcctagctcctgcaggtccagcatactccatctggacaagacagtgctgggcaaataggaaactgtgggagaagcaggc

SEQ ID NO: 12738 - DNA, 28213 bp, Human
  misc_feature (1)...(28213): n = A,T,C or G
ataccacaataatgaaagccattaattatagggaaaatggaggggttaatatgggtggctggcttttgctatttctagcagctccattttatctacaaaagacaaacattcattaagtcccaaaaaggtaaagaatgacaaattaagcatgtatcttattagtaagagtaatataaagatgctcactcatatttataaatatttgacaatcatgttaaggccagaaaagagaaaaaagggtaggggcaaaaaacgcaaagagaaaggagttagtatcttttctcccgcactcattagctattaaaagaggatgtttgtttaaagctgctcagagctggtaaactaatgttaagtcactaacgggaatttaaaaggtttcattaagaactgcctgcactagattcctccaccctgagacattaaacaatcacgataaacctcctgagtggtaagaacgtgtccatttaaaaacaggctatagattgtcatgcagttttatctactaatcggctaatgcaccgccaaaaacaaacaaaaaaacccaaagggatgaaagtttcatccatcaaaggaaacaacagtcaccttggttcccatcccactcatatactgccgccgtacatgtcaatcagatgaacctgtgcgtatctcttaacgacaattgacccacctttttaactgaagtgaaggggggttctgctccgcgaccacttcctggatctctcccttcaccctctgtgttctttcgggtgcaccatcgggtcaaagccgcagcaacgccgtctctgtgtgatcgcatgtgcccttctgcacacgaccttcccccgagagtgaccagctaccggacaggcaccaaggagggctaccgagcacctcccggaccggcggctgcaggatcgcgagcgcctccgctagggagaccgcacgttgcgcctgtgcttcctgcggtggcgccttctgcaaggagacctcgaccctgctccctctccggggctggatctgactccttgacggtgattccagacgcgagacccaaactgacggcttctagaagaggggcgagcccggccgcaagtctttcacgtagctaagtcatcgttgcttccggcttcttaccgttctcccctttgtaaacggttacctcccgaaaacccaggctctcctccaacagtggttctcaagcgaggcgatcttccccgggaggggatatttggcaaagtctgggggcatttttggttcactggggctgctacttgcatccactgggtagaggcgggggatgcagctacacaacctgcgaagcacgggacagcaccctccccaacccagacagaattagccggcccaaaacctcagtagtgcccaggctgagaaaccctgccttaaacaaacaacaaagaaaagccaagtcccataagtgggtcaccgcgccgagactggggtccacgggacaccccagccacgccaagccgggaagtccccgcctcctggagctgaacccgcccctctcccagaggtggagctgcggggggcgggaacaggcacggagaaaataaacaagactaaaaagtcctgagtagcgctgtgtggccgcaaacctgaacccaccttttgcaccacgcgggacccggcactcttcctgccacccacccctgagagggctgcgcggccgaccccagtactagaaaacactcgtcacctcactcaagacgggtacgaaggccaacggacgccttcctttagaacgctcagcacacagagcaacttctcacgcctactctcaaatggcgtactccaaactagcactcccgacgtccagctgtgaacccagagcggcggaaagcccctgaacccagcgcccgggcatgcgcagacgcgttgttgtggtgggcgtggctccctccggacccggcgccccgccctccgccccgtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggacgtaagtgtcgggcggggagtgggggtaagagagtagcggccgcaggctggagaggcctcggagccggggccgtctgacgggctggtgcccacagcacaggctcgttgccgccaccctcccggaagccgcagacccgggctgagccgccgcggacctctcctctcctgggtccggcggcgccaggagaaggcgacggcgtccagaccccgccaagacggagaggggaccgcgccctcccccgggacaccccaggatccctggaaaatcccccgatcccccacttcacagctggacaagccgaagccccgagaaaggagcgtgacccggccagctccctcagcgaggggtgccccggctaaaggtggctcccccatcttccagcggcgtccctcgagacctaaaagtcccagagtttggagggcggggtctggcttgagcgtaccagtcgtcgtgcaaagaaaaatggattcggggtggggccattgggatgaaccgaaaataacacttattgaattgcagttcttcccggggaagaatcaaatgagtgaatttcctaaattgaacttgtcccaaaggcatcttagcattggctgtaatcatatattttaatatttaatttttaaaagagaagttaaaaatgggagacgttgctctattgtagggtgtcatatttttggacaaccataattgctggctacaaagtatcttaaggaagtcaagttcgctgtaggagtttgggtgttgttattcgcaagttatatgtatttcaggctttttcatactctgaaatagagataacatggctgtatctcaggtctctactgctcggcttacaggaatgttttatataatttgtaaagacagcttgggtcggctatatttaaatagcagttggatttttgtaatctgaattactattaaccacgattctgtgcttgcttttggctggaaacacccgttaggatcagagatagggatattaaagtggatgttctttatatagaaatgacaccaaaaggcaggcttgcagaaagaaaaataatgaatgaagtgaaaggaaatgatgtgggtagaggtaagaactgcagtgcagtgtttaatttcttgatttaggtgtgaagaaacacacgttctgtgataaaatatgtaaattagagaaatatttttcatttgaatctgtaattccactcagagccaaagtttatcacttgtctctctactaatgttagtgctcctggactgtaaatatcaaattcatttaataagtttggaatcaaaatgatacaaaagagctcctgtggattagtaatcatatacttggtattaaaagtaccacctaaactaatttaatacctacttagaaataataggatgtgacagattttcaggaggaggtcaaccagtagttaaaattttttcaatatttggagacccacctttgttaatactgcttaaatatatccaaaccatttatttctatttatttattattatttttgagacagagtcttgctctgtcgcccaggctggagtgcagtggcacgatctcggctcactgcaactttcgactcccaggttcaagcgattctcctgcctcagcctcccaagtagctgcgattacagacatgcgccaccacccccggctaatttttgtatttttagtagagatggggtttgccatgttggccaggctggtctcaaactcctgacctcaggtgacccacccacctcagcctcccaaattggtaggattacgggcatgaaccaccacgcccggcccccaaaccattttttacattaaaaaagatactaaatgaatccagatattactttccaaagttataatgtggaaattcatcaaaaactaaatcaaatattctgaagaagtatgtggaaccaaaataaagcatttgtaatttcacttttatctaattattcctgagctattaattatttttcgggcttgaagcaagtaaatggaagtacttatttaattgtttgtttgtttgtttttaagtgacctgaaaaaaatgtctggatttctagagggcttgagatgctcagaatgcattgactggggggaaaagcgcaatactattgcttccattgctgctggtgtactagtaagtgtcattgattatttgggccttattttttggtgcgtttgtgtttatgggttttgaattctgcaggatgttttaaaatatgtactatttattttatctttgaccactttgaccatgttgatattttgttgtttgtggagagttattagttccactttaagagtttatggtttaaaatttgattaacaagtggttgggttgttttaactgcatggtaaaaatggcataataaaacatttgttcattatatggattatatctccttttaatgagtatattaaggtacaaggaagtgtttaagacgcagtcaggtcaaaaccagtcaatagatgtgattgcatttctccataatccagttaactttcttctcagtctcagggaaaaaaaagtgctcgctttggcaacacatacactaagattggaataatacagagaagattagcatggccccttaaaatttttttttaaaaagcaaaaacaaaaaggaaactcattaaaatacattgtgtggaagtaatttacagaataaaattcttatttacacttcagatccctcaagggatctgctattagttttttatgatcatatggtgtcgtaggctctaaagagtaattttttatttttattttttgagatagagttttgctcttgtttttttgttgttgttgtttttgttttttttggttttttttgagacggagtctcagtctgtcgcccaggctggcgtgcagtggcgcaatctcagctcactgcaagctccgcttcccggggttcacgccattctcctgcttcagcctcccgagtagctgggactacaggcgcccgccactgcgcccagctaatttttttgtattttagtagagacggggtttcgccgtggtctcgatctcctgacctcgtgatccgcccgcctcggccttgcaaagtgctggaattacaggtgtgagccaccgcgcctggccttgctcttgttttagtagagacggggtttctccatgttggtcaagctggtcttgaactcccgacctcagatgatctgtctgcctcggcctcccaaagtgttgggattacaggcatgagccaccgcaccaagccattttttcttaagctttaagatttatttattttcgagacagggtctcactctgtctcccaggctggagtacagtggtgaaatcactgctcattgcaacctcgacctcccgggctcaggtgatcctcccacctcagcctccggagtagcctggaccacggatgaaggccaccacaccgggctaatttttgttttttttgtttgtttgttttttttgtagagatgaggtctctccatgttgcccaggctggtctcctactcctgggctcaagtgattcactggccttggcctcccaaggtcctgagattacaggctattgcacctggccaaaaagctttgagtttttagtctatgaagaaaatatcttaaatacattgagctgagggtaaaaagaaaggcatatgtactcatgctagccattaaaaatgttattaatcgagtatggatctgtctgtaacctgataaaagtaatttgactagcctaaaattgttactttaaaataattgccagaagatgtcagttgccagagctaactgagtcagggtttggtgtggggataggaaaggaaagggggttacttttaaaatcttctaggctacttgtcagaatttggttaatataattttattgtaaatatctgctcagatgataaaaactgtttttgaagttttggcgttattttgttatacctttgcccttgataatatctagagccaaattcaattagataaattgtaatctggtgtttaaattaaatttaaaatcacacctgaaaccatatttagactgcactggaattcatcaaaagcagaacctcagagctgttatttcacaccaagaagatagctaaaattctgtgaacaatagttgttctccatattaatttgactgcttttttcttgattttggggaatatttctctggaagtttatcatatatcaacaggacacttctgtcagttggaattggagtcacttttttcctttccccctccatgagataactggtttctagttcaccaaattagattacaaggctttattatgataaaaattaaataatgattgaagtaggcttagagaaaagttatgttaataaatataaattgctctcagatttaagggtacctaatcagttattaggccatgtgcaaattacatgtgggaaaaagctagaacatttttgaaatgtattaaaagggatctcctcacttaaataccttgcttttagccagtgagatacagaattgctatgatttctcattggtatcacctttgttttagttttttacaggctggtggattatcatagatgcagctgttatttatcccaccatgaaagatttcaaccactcataccatgcctgtggtgttatagcaaccatagccttcctaatgtaagtgtcatcgtaattggcattacttacatagcttgccacaaaataaaaatgtttcaaatatagttgcatagatttaaaattctaaatattatcagattaacacactggacatgatttaaaagtcacacagtagagatggacttatacagaaaagcagcagtcctctttattctttttgtgtacctctccactccctcccagcttctctcagctattcttttattttatacccccagggtttatagctttatatttaagtccgaaactgtgtattttgtctaagggataattctttcaacaatatttattaagcttttatattccagactctgctctaggtacaggacatatagtagttagtaaaacaggaaaaatccatgtctttttgtcatttaaaataagtgcaaaggagaaaaaatagagaaaggagatatgtgcaaataagtgcaaaggagaaagggatgtcaataggagggatagaaattaaaaaaattttttttttatagagagggtgtctcattatgttgctcaggttggtctcctgggctcaagtgatcctcccacctcgacctcccaaagtgccaggattacaggtgtgagccaccacacgtggccagaaattttcagcagagtcagagaaggtctcactaagaaggtgactttgagtaaagacttgaagaaagtgaaggagctgaccaggggatggggatatataagagaggttcattccaggcaggtgaaacagcaagtacaaaggctttacggcaaggagaccagtataactgcagtagcaagatcaagggaaagagaaattgatgaggtcaaagaagtggtggagagggacagatggtatagggccttgagaagcattataagaactttactttcagctggatgcagtgactcatgcctgtaattccagcactttgggataccgaggtgggtggatcacttgagctcaggaatttgagaccagcctgggcaacatggtgaaacctcatctctaccaaaatacaaaaattggtagggcatgcctgtggtcccagctgctccggaggctgaggcgggaggattgccagagcctgggaagtcaagtcgatgttacagtgagtcatgattgtgccactgcacttcagtctgggtaacagagcaagaccccatcacaaaaataagaactttactttcattgtaagtgtaatggaagccattggaaggtttcgagcagaggaatgaaatgaccttatattttaataggagcattcctgttgaaaaatttttaaaaccggtaaacaaaatttattgcagtgccaaatagtataagcaccatgactctgtgcttctcaaatttatcaatgtattttgaaaatattcttgtattcttaccagtttctcaaattcataaaatcgtttagtttgcttcatacttgggctgtgactttgttatttagtattgttttttcctatagttttttttttcttctttaattaagacgaggtctcaccttgtttgccaggctggtcttgaactcctgggctcaagcgatccacctgccttggcctctcaaagtgctaggattataggtgtgagccactgtgcccgacctttcctagagtttctgattgtttttttttgttttttgttttttgtttttttttggtggttgttggtagaaagaatgtatattttctttaggattcattttattcttcttgaatgctgcagttctaatttggacagttactatgtggaatgtagtagccttgttcagttttttgtttttcctagagtttctagctgccttttctttgttttcttgcattttctactattatcacatctttatttttttcccaaattctcaattatattctttaatgtattataacttcttttgttttagaaatcaacatcccagaagcccgtatctgtctgtttcattatgaattaatgactgtgtaagcctgctgcagcactgtcaccatgggacttccctcccctgttgatcagggttgaatccactgtttttccagttaccacatcttcttttttttttttttttttttggatacaagaagtatttactttggccgggcatggtggctcacgcctgtaatcccaacactttgggaggccaaggcgggcagaccacctgaggtgaggaatttgagaccagcctggccaacgtggtgaaaccccatctctactaaaaataatttaaaaaggctgggcgcaatggctcacgcctgtaatcccagcactttgggaggccgaggcaggcagatcacgaagtcaggagatcgagaccatcctggctaacacagtgaaaccctgtctctactaaaaatacaaaacattagccggctatagtggcacgtgactgtggtcccagctactcgggaggctgaggcaggagaatcgcttgaacccaggaggcggaggttgcagtgagcagagatcatgccactacactccagcctgggcgacagagtgagactctgtctcaaaaactaaaaaataaattagccaggcacggtgttgcgtgcctgtagtcccagctactcgggagcctgaggcacaagaatcacttgaacctgggcagcagaggttgctgtgagccgagatcacaccactgcactccagcctgggcgacagagggagactccgtctcaataaatttaaaagaaaaaagtatttatttannnnnnnnnnnnnnnnnnnntgagaaaagagtatgtgagatttcgagaatggtgtgaaacaaacaacgaagaataattgatgagttgtagaagaaattttggtacgaaatgtatcaaaacagaaactgatcattctaaggtagtgaattcttccattatgttcaactgtgctattaaccaccatattcccaacaaccttaactttcaagtactgaatacacatgtgacttttaaaaagttaccagtgtttactatgtaaccattatatgtctgattatttatttttttttttgagatggagttttgctctgtcgcccaggctggagtgcaatggcgtgatcggtgctcactgcaacctccacctcccaggctcaattgattctcctgcatcagcctccctgagtagctgggattacaggcacacaccaccatgcctggctggtgtttgtattttctgtagagacgggtttcaccatgttggccaggctggtcttgaactcctgacctcaagtgatccacctgtctcggcctcccaaagtgctgggattacaggcgtgagccaccacacccggccgatatgttttcttagaattctcatctctttatctttttattttatgttccaatctgttaaacatttttgcatttcagttctcatgttttaatttctaagggcctttgtttccttaattatgaatgcttcctttagggatcaactctctctgtgggcctttcttttttttcttttcttttcttttcatgttagacgtgtaaggtgctgatgtaagaacaaggtttgagggaggcacatctcaaacatgcacatgaacacccaatcatcgtgcctaagaactacaaaagaatcaggttttccttttaaattaaaaaaaaaatgttttagaagtagggcctcgcttgtcacccaggctggagtgcaaatggtgtgatcataacacactactgtctcaaaatcctgggcttaagcagtcctctggcctcagcctccccagtagctaggactacttgcacataccaccacacccagctattttttaaacagtttttttgtaaagacaggatctcactatgttgcccaggctgttcttgaactcctggtctcaagtgattctcctgccttggcctccgagagtgctgcatgataggtgtgagtcactgtgctctctgcctttattattttaaaaatgtaatataaaatgcattctggccaggcatggtggctcacacttgtaatcccagcactttgggaggccaaagtgggcggatcacttgaggtcaggagttcaagaccagcctggccaacatggtgaaaccctgtctctacaaaaaaatacaaaaatcagccgggcatggtggtgcatgcctgtggtcccagctactgaggaggctgaggtggggaatcacttgaatctgagaggcagagattacagtgagccaagatcacggcactggattccagcccaggagacagagtgagactctgtctcaaaacaaacaaacaaacaaaaaacgcatttagtgagatacataaagtgcacaagtcatatatacatctcaacaaatttttcttatatatacacccatgtaaacagcatctagatcaagatttaaaacatcaccccagaacattctcaatcagcacttccatcacacctgtatagcccccatcctgacctctaccattgtccatcagctttctgtagacctttttttttttcttttgagataggctcttgctctgttgcccaggctggagtgcagtggcatgatctcggttcactgcaacctctgcctcctgaattcaagcaattttcctgcctcagcctcctgagtaactgggattacagacgcccaccactgtgcccagctaatttttgtatttttagtagaggaagggtttcaccatgttggccaggctggtctcgaactcctgacctctcaggtgatccacctgccttggcctcccaaagtgctgggatgacaagcgtgagccaccatgcccggccttctgtagacttttaatttaggttgtagagtcatctcatacaggcttccaggtaatccaagttgaaaattacacacatttttaaattttgctacagttacttaagtgtaaacacagtaacttgtattttcagagtaaagcaagtggctaagggcagccagtttgactgtgcctggcatggagtcagtgccagagtagttattcattcgcagaagtaaaggtctgacttcagaagccactgatagcaaagggctgtggtctttttctttgaagttcagccagtatgcagctatttctagttctttccatcttgttgcaatttattttaccgtaataatgatgctgttagaattcttttagaaagctgacacctaaatttcaacattggtttagatttaaaagttttatttttgtgattgtatttttgtcctgcttttgttctcagatctttaaaaaattattttgttccattttgaagcagtagcaagtctgactatggaggggaattatagctgtatatgagcttgaatgtactattcaaacgtgtttcctgctaaacttacattctgttgcattaacataattatagcagagctgacttcatgtctttataaatgtttatcatctatttggcttcagtttacatctttttattatagtgtcagatagtgtcaggccataattttaaacaaaaactgttagttaattataattcaaatggataggagtcaaaaagcagctattctttcattaatgactttattattttttctcttattacaaaagttctctgattttgtggctttaaaaatattaataaatgttctgtgtattactctgtattttttaattttaaaaatgtagggtaggccgggcacggtggctcacgcctgtaatcccagcactttgggaggccgaggtggaaggatctcgaggtcaggagatcgagaccatcctggccaacatgatgaagccccgtctctactaaaatacaaaaaattagctgggtgtggtgacacgcgcctgtggtcctagctactcaggaggctgaggcaggggaatcgcttgaacccgggaggtggaggttgcagtgagctgagattgtgccactgcactccagcctggcgatagagcaagactccatctcaaaaaaaaaaaaaaagtaggatatgccaataagcaaaaacgaagttgcctataatctcaccaaactataacattttgacagatattctaccagtgttctcttctgttttctctttctctaacacacatctatatgttttaaaagtaatatttaactcttctccacttcctttcctcttcctggaaaaattcagtccaaaaactattaggtgaggtcaagcatgagaggcatcctctatagaaagacaagttgtggtggcccagagcaggctgctgggctcaggcagggtgggaaggggcagctcagcatgggctcagatcctgagcagggtgaggaggggatccatgcagcggagcgtgggatggaagaaggcagccctacatgggatgctggagtctgagcagggtgaagaggctgtccagatggggcaggagaagcagtgtggcagctctgtccgctaagagtgcccagaacagctacaccccaacaccaggagcacacctatagcccccagttatggagcatcatgttgacaaataccagacgtttcagtaaaaagattatttaactagtaacttttctataaattggagaacatacataaaaataatcatagcagagaacaaatagagattgttcattccaaagtgtccctaatagtgaagacaggattgtggtggctcacagagggctctgaagtttattcagatggctcagcaaggaaaacgagctgagaaccagtaacccaagaacatttatttgtgttttacttttatatatgaaacctgtttttaatgtatctattttatatacaaaataatttagtactgtacagagatcactgaaaataattgagtattttgatcattctgaaacttagatttgtatgaataaattaagacatcatattactgtgaaaaaaactaggattcctatattcacttttttttttcatagatacaaggtcttactatgttgcccaggctggtctcaaagtcccgggcttaagcaatcctcctaccttggccttccaaagtgctgagattactggcacaagctaccaggcctgacctaaacacatttattgagcacctactatgtgcgaagcccctagccttgtgctaggcattgagaatgaaaatgagaaacaagacagacaatggctcctgtcctcatgaagcttatattctagtgttagacacacacaactaaatgggtatatatatcataggtataatgttttgtaactttaacttgatgtattgtgaacgttttcccatgacatttggaatgtttcaaaggatacttctaaagaaagcaagcctatctcaatttagagtggtatgctatgaagagttagtaaaacaccttatgtttagagcctgtatcaaggatttaaaaaacaagattttaccacttgaatctctattcgataatatcttcagagcaaaaagttattgtattgtttgaaatataattatttctccaaacatttgatatcagtacaaaattactacaaaaaaatttattccaaagccaattttaagaaatatttggattatccagggcccattttctccctctgccattgccatacatgagtacatgttatgtctgatacatacaaatggaatatcagatagaaccaagcaaaattatctttttacctgttccaatcttagcaaaagaaaattttgagaattttgttcccgattttttttttaagagacggagtttcactcttgtcgcccaggctgaatctcagtggcacgatctgagctcaccacaacctgtttcccgggttcaagcaattctcctgcctcagcctcccaagtagctgggattacaggcatgtgccaccatgcccagctaattttgtatttttagtagagacggggtttctctgtgttggtcaggctggtcttgaactcctcacctcaggtgatccgcccaccttggcctcccaaagtgctgggattataggcatgaaccaccacgcccagcctcgttcccaaattttaacaatccagactcacctgaaagacttgttaaaactcagatttctgggccccatgcccagagtgtctgctttgctaggtttgggttagggccaagagaattttcttgtcaaataggttgccaagtaatgctgattccgctagcctggggcccatgaccactgctctagagagtatctggctgggcgcagtggctcacacctgtaatcccagcactttgggaggccgaggcgggcggatcacaaggtcaggagttcgagaccatcctggctaacacggtgaaaccccatctctactaaaaatacaaaaaaaattagccgggcataggtggtgcatgcctgtagtcccaactactcgggaggctgaggcaggagaatggcgtaaaacctgggaggcagaggttgcagtgagccgagatcgtgccactacactatagcctgggagacagagcgagactccgtctcaaaaaaaaaaaaaaaaaaggagtatctggttgaagagaccagtcatatgaactctttactcaagaactgaaggcttatgagccaggtgtagtggcactttgggaggtcaaggcaaggaggatctcttgaggccaggagtttgagaccagcctgagcaacatagcaagactttgtctctacaaaaatttttaaaaattagctgggtgtggtggtgcacacctgtaatcccagctactcaggaggctgaagtgggaggatcacttgagcctgggatttcaaggctgcagtaagccatggttgtgccactgcattctagcttgagcaacagagtgagaccctgtatctttaaaaaaaaaaaaagactttcaggcctaaccttacatttgagaaactgtagattattgtttctggtaattggtgtcatggaccctgatttcttggttttattttattcatacaggattaatgcagtatcgaatggacaagtccgaggtgatagttacagtgaaggttgtctgggtcaaacaggtaaataggtgcaaacagcatcttattatacatgcttaaatccttaagatgagaatttcacatggaaataccacttttctatttgttttaatatatctgtgagtaacagcttattattttgaatctattgttttatgttttgggcttgaaattgggaattaatatataacattctatttgccgtgctttattgagtgtaggcagtgtttttattaaaatgtatttatgcaaattaaagaggccctatcagaattcattttaggcagtcatgactccatttatttatagcaaatcttcataaacatgttaatgtgatttgaaagttgcctgtcctcctctgttaacataattttaatgcaaccttcctaagttctagtcacagtaaatttgaatttattttgctgcctaacttccctgaaagtgaaatatggtagcttggagattcgtatgtcactgaatatgaattttttactgtatgtctgtgttactgtttgaaagtactcttggaagatctgggagcggccgggcacagtggctcacggctgtaatcccagcactttgagaggccaaggcaggcagatcacaaggtcaggagatcgagatcatcctggctaacacagtgaaaccccgtctctactaaaaatacaaaaaatcagctgggcgtggtggcgggtgcctgtagtcccagctactctggaggctgaggcaggggaatggcatgaacctgggcgggtggagcttgcagtgagccgagattgcgccactgcactccagcctaggagacagagcaagactctgcctcaaaaaaaaaaaaaaaaaaaatgtgggatcattgtctatataaaagcataaggagaatgagcctctaaatatggtgaaacagattttatgagatgttttataggaaggttgagtataggttttctcagtgtaggcagttggggaaagtaagtatatgcacttatacagactcataaataatttttaaaaatctatacagaccaaccaagaagaaaaaggccaacaggtacactgatgaagatgtttaacacatcctttactgttctcacgttagactttaatggcagttgcactttttttttttctgtttgggttttattttctttttgaaagttaattgtactgccctataagaaagaattctggtaaaatattatttctttgaaggtgctcgcatttggcttttcgttggtttcatgttggcctttggatctctgattgcatctatgtggattctttttggaggttatgttgctaaaggtaagagaaaacataggttacaatttacttcagtggaatactggaattttgcattaaagttggttattttagaataaaatttttttcctatagttgggccaactactagcgatgcatttatatccgggaccccccaccctccaccgacagtgtttggttttctttgtcttatatatttttagtattcctttcttcagtcatttttcttcttatccagagcctggaagggatgagacagctctaaacactgcttttctttggcttccaaaaatctcaaaagcagaacatatgttatctagctagttagcaagctttgtttcttttttagagacaagagtctcactatcacccaggctggagtgcaatggcatgatcatggcccactgcagcctcaacctcctgggctcaagccatcctcacacctcagcttcccaggtagctagggccacaagcacacacaaccacacccagctaatttttaaattttttatagagatggatcttgctatgttgctaaggctggccttgaactcctggcctcaagcctggcctaacaagttctgactttcagaatatctgtgcaaagctctaacatcccagaattgagatttattcagttaagcctccctggtaatatgatgtcacctcctttcagacagaaaagtaaactaacatttaatatacatctgctatataaggccactttaaggcaagctcaggaaaaggtatactgttagaccctgggagaaatttcaccttgagggaccctagaaaaatagaaaacccatttaatggtccaggtaaaattgctatgggtgtcatagtaaaaatacagtattaatgatttataaaaactggaccaggttatatatattctgctcatattttaacacttatttgaataaaatgtaacttgtagattaaaataatgtttcctaaatttttattaaaatcatttaatctcatagatgggagtaatagatatttccaaatatttgtatttttaattttattttaattattttttttattttttgagacagggtctgctctgtcacccaggctggaatgcagtggcacaatctcagcttactgcaacctccacctcccaggctcaagcaatcctcccactcagcctcctgagtagctgagatgacgggcgcatgccaccacgccctgctagttttgtattttttgtagagatggggcttcaccatgttgcccaggctggtctcaaactcctgggctcaagtgatctgcctgcctcagcttcccaaagtgctgggattacaggtgtgaaccactaggcctagccatgtgtaatttattattaaaatcatgttaccaaaattgtagaaaataaaaaagggtgggtgcagtgtaatcccagcacttcaggaggccaaggagggagtactgcatgaggccaggattttgagaccagcttggacaacatagggagacaccatctctacaaataataaatatttagccgactatggtgacgtgcatgtgtggtcccagctactcgggagactgacgtgagaggatcacctgagcccgggaggcagagattgcagtgagctgtgattgtgccactgtactccagcctgggtgacaaagtgagacgctgtctcaaaaaaagagaaaagaaaagaaaaaaagaaaaagaagtaataataatttcaccactcttcaatattttggtttatttccttttttcttatgtttttagttattatcataatttttatcccccgtttgcatttcacatgatattataagttagttgttcttttgctgctataaaatctgttttttatatgtatatttgttgcccaggctggagtgcagtgatgcgatctcagctcactgcaacctccgtctcccaggttcaagcaattcttctnnnnnnnnnnnnnnnnnnnnnnnnnnnnnnnnnnnnnnnnnnnnnnnnnnnnnnnnnnnnnnccacttgtactccagcctgggtgacaaagtgagacgctgtctcaaaaaaagagaaaagaaaagaaaaaaagaaaaagaagtaataataatttcaccactcttcaatattttggtttatttccttttttcttatgtttttagtcatcatcataatttttatcccccgtttgcatttcgcatgatatcacacacctccaatcccagctacttgggaggctgaggcacgagatctcttgaacctgggaggtggaggttgcagtgagctgcgatcacgccactgcactgcagcctgggtaacagtgggagaccctctcaaaaatcaaaacaaaaaaaaaggaaaaaaattaccttgttatcatgggaattgcataatgcttattcattatagaaaactaagaatataaaagaactcaaaagaagaaaatgaaattactgataattctttcccagatacaactattaatacagggtccctttttataggaatgtctttatctcataattttaggctattttcctgaaagcttctggagcaaggttatgttttgagaattattagcagcagatctgtaattttataaagttggctttataacatttttagaagccattctagtggtaatggttatttaacgtgaaatagtggtgaagacctatgcaaaccatctgttatgttaatcagattaaccaaagctgttctgaaatgagaaaaatttgacagttcacctatttattgtgcctctgtcaatgagcagtcattaacaattccagtagtagaaatttatgagaatttcaacttcacttctagatacaatcagaaaaaaatgttgctccagcagtccttccaatcttagttaatggctggctactctatctttccaggtgtttaggccaaaagccctggatggtgaaggcctgtcaaagatgacatttgtcttcctcccacgccccatatccaatctatctgcagatcatgttgactgtgctgtaaaatatatcctgagtctaaccaccatttaccatctctccattgctaccaccctggttcaatccatcataatctctcacctgatttcctggaagagcctcctaactggtttctgtttcctctcttgcctcctttaatctaccctcagcacagcagccagagggatcctcttaaaatatgtcatctcagatcacttttctgctcacaacccagtggcttctcgtctcactcagagtaaaaatcagagtcctcactgtgactgccaggtctctgctgcccagttgccctctttctttaccctgtccctgctcttccctcttgtgcctacgtggctgttcctgtaattcactggcgtgctccctcagggcgtgtgcatggcttcttccccacttcctgcgtgtccttactccagtgtcaccttctcatggggtcttcctggccatctgtgtccaatgtcacactacacttctccacctttcctgcattattttatcttctttttattcagtatattctctagttccatgagggcaaaaaaaattttacctgttttgtttattgcagtatcctcagtattaaatagggccagcatacagtatgcccccagtaaatatttgttaagtgaactaagggagctatcatttactaaagccatgctagactctgttacacattatgtcttttaatactcaagccaaccctaattctaagaaaaatcaattcttctaggcaggaaaactggtatttgccaatatatctgaaactaaatgttttgagatcataaccctctaaacactgcaattatttttacagaaaaagacatagtataccctggaattgctgtatttttccagaatgccttcatcttttttgggtaagtttgttttgcattctttatgtttgtttgtttttttttaaaatagcttcttttatatcattttctatatttagttgcctaattactcatccaatgcccctcccccatgatattttcataaaacatggagagtaaggttgagaaggatattttaaatagatgagttggtttgctgccaaccttaggagcatatattaatttttaagattgctaccacgcccccttttaatgagtgagtaactatgattcatgaaaatttagttacataacactggtgatgttcattttaaacttagatctctaacagttgctttaagtgaaagcctgcctaaaaccatttatccttaaattttggtttctgatatattttataattcttctgtccttgatatcgtagagtttgtgagtgagatttgaggtgtggaggaaaagcccaaacatttttttatccttccctttcaattacaaatgaaaagatgacgaaaacctctaaaaacctcaaggcttttatcagtaatcttctctgatgttcatctttcctagaaatttagggcctgcccttttctctacccatgctgttcctccaaccagcccccacaacctacccccatcactggccgaaaaaccccacaaacaaaacagctcaacagctcttaatcctctgtatcaggagtgtgtgtgtgtgtgtgtgtgtgtgtgtgtgtgttgtgtgtgtgtgtgttgttttgagacagagtctcagtctctcacccagtgtgtgtgtgtgtgtgtgtgtgtgtgtgtgtgtgtgtgtgtgttgttttgagacagagtctcagtctctcacccaggctggagtgcagtggcacgatctcagctcactgcaacctccgcctcccgggttcaagtgattctcctgcctcagcctcccgtgtagctgggactacaggcacacgccaccacgcctggctattttttttgtatttttagtagagacggggtttcaccatgttgtccaggatggtcttgattcctgatctcgtgatctgcctgcctcagcctcccaaagtgctgggattacaggcatgagccaccacacccagcctgcatcaggagttcttttttttttttttttagagggagtctcactctgtcgcccaggctggaatgcagtggcgtgatcttggctccctgcaaactctgcctcccaggttcaagtgattctcctgcctcagcctcccgagtagctgggattacaggcacctgccagcacgcccagctaattttttgtatttttagtagagacagggtttcaccatgttagccaggatggtcttgatctcctgacctcgtgacccacccgcctcggcctcccaaagtgctgggattacgggcatgagccaccgtgcctggccaagagttcttaacctttattctttcagtagtcttctgaaggtgaggtatcaccagacatttccatatgcaggaaattggtgttttgtgtatttctggaaagagatagtctgtggctttcatcagattttcaaagaagcccctaatccaaaaaaggctaggaatctgatgtatattacaggacctttccttccccttcccttcccacccacctccaaaaaagaaacaaaaatcccatgtttactgaagccctcttgaaatagtaatagttgcccttcagaaagagccaccagttggtattcacacctattctattccatcaccaggcatttttgccattttgtaaaatcagtttggaaataaaaatgtaaacttagatgtgacaagatgcacagcctctttgggttataccttgtatcctgtaagcagattgaaccccaggtaattttgacagtgtaggagggactggtccctggctcttgcccaggaaactcttccgattagagttcatatcttgtgacgagtattctgaagttacagcatctcttttaagctatttggacagtagaggcctctaataaccaacttcagtttttctttgttacagcagtagatcctatattaactagaagagcagagatctgggattacaggcgcatgccaccatgcctgactaatttttgtattttttgtagagacggggttttgccatgttgcccaggctggtctcaaactcctgggctcaagcgatctgcccgccttggcctcccaaagtgctgggattacaggcatgagccactgtgtctggctcatagcccccatttcatttggtgcctgggactgcgcaccagctgccccatagagcatgcaggcaggcatccccatagagcatgcaggcaggcagccccatagagcatgcaggcaggcgtctgcactctggctcatctaaggcacctgtgggtaatttgccacccttggcaattggctttccaaagcctggctgtgtccattccctgcctcctcatggccaaccataatctggccatggtggattcttccttgttctgttaacacctcaggtatcattttatgcatacagttgcgctcttgcctcttttaaattgaagccttaaggacaactgtagacgttccctcaccgaaaccctagaccaggggtgtccaattttttggcttccctgggccatattggaagaattgtcttgaggcactcatagaatacaccaacaatagctgatgagctttaaaaaaaaaaaaaaatcacaaaataaatctcataatgttttaagaaagtttacgaatttgtgttgggcctcattcaaagctgtcctgggccacatgtggcccatgctttgtgggttggacaagcttgccctggactgtaagctctgtgagggcaaattcctgtcatactagtctcctgggcttttccagaagccccatgcttttttatgcctctttcccctttgatgtactgtttcctgtccccgaaacacctgccttcatcatcccgctaggtcttgttcctaccaatctcccattcaaacccctgtttttccacaaaagcccatctcacatattaccacctctgtaaatccttttctaacttattcagggtgaccgaattctgtgtttctgtgcccccttaatacttgttatataagtctccttccccaaccacccccacacttaccacatcacgttagcaagaatgagagcaatttgagggcagtggctttgtatcttatttatagccctggcaccaaaacagtttgttgaatgaatttgataaaatcagacgtatagggctgggcacagtggctcacgcctgtaatcccagcactttgggaggccgaggtaggcggatcacgaggtcaggagatcgagaccatcttggctaccatggtgaaaccccatctctactaaaaatacaaaaaattagccgggtatggtggcgggtgcctgtagtcccagctactcaggaggcagaggcaggagaatggcatgaacccgggaggcagagcttgcagtgagccgagatcacgccactgcactccagcctgggcgacagagcaagactctgtctcaaaaaaaaaaaaaaaaatcagacatataatggttacatagtaaacactggtaactttttaaaagtcacatgtgtattcagtacttgaaagttaaggttgttgggaatatggtggttaatagcacagttgaacataatggaagaattcactaccttagaatgatcagtttctgttttgatacatttcgtaccaaaatttcttctacaactcatcaattattcttcgttgtttgtttcacaccattctcgaaatctcacatactcttttctcaaattcagggagtcatgtgatatttcttgttttattcacagagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacgctgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactcttaaactaagtttttagtctttaattttttaatatcaaatctgtctctgaccttgtttcattatacataaggagactttgctgtcatgagcgtttctcacgtacaaatgcaggcaacagtgagaggaagttgtcttgtttttgaacaggccttgtttttcttggatgcttttgcttaaaatccaacagccaaatgaggaaactgtaaaagcaaaacaaacatttttattgcagatgaacccacatactgattttggcttgatctcttgaaacagcctaaatgtctcattacaaagaccttagaaattctttcataaaatctgaattggaagagatcttggatatataggttttatttcatctaacgttttacatggattgttgataaatggccatctggcttttatttgaatgcctccaaagacagaggactcactactgccatatgaagtagctcattccatttggcagacagttgagattgttagaaatttatactgcacctcccctgggcctagttaaattctttggagaagtgtagagaaaaagtatttttcttctacatgccagttttttttttggttttgtttggttggttgtttgttttgtttgagatggagtttcgctcttgtctcaggctggagtgcagtgatgcaatctcagctcactgcaacctctgcctcccgggttcaagcaattctgcctcaaccaccggagtagctgggattacaggcacccgccaccatgcccagctaatgtttgtattttttagtagagacggggtttcaccttgttggtcaggctggtatcaaactcccaaactcaggtgatccacccgcctcgacctccaaaactgctgggattacaggcgtgagtcactgcgcccggcctacatgccggtctttcaagtgttcgaagagccttcttaggtctcctctggccttctcttctgcaagctgtgcatgcgctgagttctgaagtggtgccacaccacagcctaccatacaacgtcactgcatgtggcataaactgggaccacagaactctgaaaccggaaatcagggtagctaacacttgtttgctaacatttcacatacattatctcctttaaaccctaacaacacagtgagacagttactgttatctccatgtcagatgacgagactgaagctacaagatcacagagctggcagtggtagaacccagatctgtctgactccagagcacaaactcttagaacatgggatttgatctcattttatagaggaagaaactgagccccagagaagcgacctgcccaagggcaccagcctgccagtgggtgaactaggactagaattcagatctgcctcccagaacactggccctcaccgaggctaggggagtctgttggcaggctgctgatgtgttttcctagtttactttttttttccttttttttaatatatatattttttgagacagagtctcctcactctgttgcccaggctggagtgtagtggcaagatctcagctcactgcaacctccccccaggggttcaagtaattctgcctcagcttcccaagtagctgggattacaggtatgcaccaccacacccagctaatgtttttgtatgatttggttttgttttgttttattttgagatggagtctccctctgtcccccaggctggagtgcagtggcacgatctcggctcactgcaaccactgcctccccagttcaagccattttcctgcctcagcctcctgaatagctgggactactggtgtgcaccaccacgcctggctaatgtttgtgtttttagtagagacagggtttcaccatgttggccaagctgttcttgaactcctgacctcaagtgatctgcccacctcagcctcccaaagtgttgggattacaggtgtgagccacggcgcccggcctgttttcctactttaaaagctggctctccttgtgttgttgaacaagcgtttgttgggcccttactgtgtctctagaacatttat

SEQ ID NO: 12739 - DNA, 51043 bp, Human
  misc_feature (1)...(51043): n = A,T,C or G
gcacttacctgcataactcagatagtgtttttaacttcctcaactcatgcttggcctagttgggtcaaaagaactacttgtgaattccgtatgtccaattggtaggttactgttttttctcaagagtttagctatacagtaatgttggaagtcttgaggaacttcagctgctgtccctacttagccttgcaatactacggcatcttttcttctttttcttttttttaaagacggagtctcactttgtcacctaggccgaagtgcagtggcacaatctcggctcactgcaacctctgcctcccaggttcaagtgattctcttgcctcagcctcctaagtagttgggattacagaacatgcaccaccatgcccaactaatttttaaatatttagtagagacgggtttcaccatgttggccaggctggtctcaaactcctgacctcaagtgatccacctgcctcggcctcccacagtgctgggattacaggctgagccactgtgcccccgacctacagcatctttttaagagcaatgttttctgttttaatgtggccaagcaatctctaaacgaacatggtctgacaaaattgtgtagtgacatacttgacaactgggtgagcttgagtgtgatacttatttgaccatacggtatttcctctatatgtttccttatctttatatacaaaaaagggcaaatgataatgtcttagtcataggatcaagtacaacccaagtgcttactgctacactctacttggcaaattccaccttatgaatgtttcttaatatataaacctaatctaaaccaagataagctacaggtgcatattaacaatctttactcataaagttttgcatatttttacatactattcttcaagatggaaaaaacaccatcaaactggcttattttcatagatgtctttatatagtctatgatgtcttcattccataaaaaatccacacgattaaatatgaaattaatgtacccagctatgaggctaccgcattctttaacccaagaacaagaaaatacatgaatcagagaactgcaattacctacttgctggtctatttcctcattagagtgaattttttgaggactaaattgcatttctctatctctaatgcttaccccctatctcactggctctgtgtgtttgagtgcatgcgctgaatgtttatatcacttaatttctgttcggaacacgctgtctcttagcaccagtagatctggccttagagctaaggaaagaaggcctttctaacccataaggggtactaatcctgtacagactccaatatctcccgggctgggtacacgcaggttcacacccaggtgtgagcaagattgccaaactatacctataaggcgtttggaggagagagtccaaaagtcacgagacccggctaatttagctactatttcacaacaaccctgatcgtggtcggacttgtttctaggaagatgcgatgggctggaacttccttcaagaacagattgcaaaaggcagccgaccagggcgtgtcaggtcactgccaagggaagcagcagcggaaaccgtcgcctccggcttaggctgcggagcgggaaccccattctctgagttatgtttctgcctaaacacgcagaacaaaagagttcgtggctgcaagggtggcgcgcggtagtatttcttgctaataaaaggtccccacagggacatttttgctatgactgcaggcgtggccagtctccctgcacagcttccgggaagaggtggggataggaggctcgccccggggaaggtcacgctcggggtccccagaccaggtctccgcacgcccctgccccgtcgcctcccgggagcggctgcagtccccgttggctgcagacgggcagacacccgaagtgtccgcgccggcagccggaccgcaagcgaggaagagcgaaccgcgctcccgggcctggccgaagcgcttcctgtgccaggtttccggctccgggtcccgggaggaggatcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggtgaggttgggaggcgcgcgcccggcggggctcagaggtcacggctccaatgacagcagtgggcggaatgaatgggagcggggagcacgtgcgtcgcgacgcgggggcgcgcggggtagctccggggtagctccggggtgggactccggagctgaggggtgcccgcggtgggacggagccgcgcgttggactgaagtaggggcgccctacacggggttgcagaaagcggtgtcctggggaccccgggagcgttttggggggtggagaaagcggtgggatccgtgtcctgggggaagcgcaggagcgatcagattgaccgctgctatatggacaaggttaattaagcctggagagcgactgcagctatttactttggagttagaggaagacagatcttgcctgaaattttagagccaaagtgctcagagctctctccgagaaacggaggatcgaatcggcctcggaatagtccgaaaaggtcttgtggagaatgcagggctggtgctagggtggaccggaccttagttgtccagcagtggcttcgggaggagagcacacctggatggggctggaatgacactggaaggagaaaggcccgaggccgtcaggaggagagaaaccctggagtcatctaaagtcagaatctcagtgatagcccattctttcagggtctcctctgctgcctttgggttccgatctcctttttctccctttctggtcagtttagcccctgtaaatggacactgtgagcccttctgcactttgtaatgattctcagtgtgccatggggtaggcccatgctattagcataaccgtgcaaaatctatggactcactgttacttaagtttatttgaatttagtactcttttaattcagatttggtatactttatgtgtccgtgttctcatcaaacatcatttcccagtatgaagtatataacacttataaatatctactttgtaccaaagtagatgcgtatcacaaattatccaaaacaaggcttgggccaggcgcagtggctcacacctgtaatcccagcactttgggaggctgaggtgggagaatcggttgaggccaggagtttgggaccagcctaggcaacatagcaagactctgtctctataaaaaatagaaaaaattcaccaggtggggtggtgcatgcctgtagttctacctactcaggagcctgagggaggaggattgttcgatcccaggagttcaagattacagtgagctgtttattgtgatagtgccagtgcactccagcctgggcaacagtgtgagaccctatctctaaaaaatctaaagcaaaaaagacgtttggagaccaagtggcagctgggcaactagacaatgctagagagtaaagagaacagaatatggggggtgaggggcacgtgggagaagaggcttagaggaggaaggtaggctttgctgtgatccatttcaggactgttctctccagacttcagatatttctagttccacagaagaagccagtatttgaagagatgggtgcatccaccctcttatgccactacatgcttcttcttcttcttcttttttttttttttttgacacagagtctcactctgtcgcccaggctggagtgcagtggcggaatctcggctcactgcaaactccacctcccaggttcaagcgattctcctgctgcagactcccaagtagctgggattacaggcgtacaccacgacccccagctaatttttgtatttttagtagagacagcatttcaccatgttgcccaggctggtctggaactcctgacctcaagtgatccaccccctcctcggcctcccaaagtgcggggattacaggtgtgagccaccacgcctggcctgacacttctttttaaaaaagtttcttgcccaccaagcaaccttagccagggaaagtgtgcttttctggagagaatatgctttatggcctccccgtctgcatgacgacaaggaggaattctgtggactcatgatgccaagatcatgtatttctgatgtgtgtgtcagtgatgcctttcactatacgttaatatgttagcattctggtgtctgcctcaggcatgtgtattttggttacttcaagtctcttagggcctgatagtccttggggacacagaactacaataactaagccacagggacaaagagcggcaataattaagccacgtcttgctctccaccagagctctactacctcctaatggttgtacattcttctgacttcactagtagtgtgaacaaatattgtaatacaataaaaaccagtgtgcatgtgatcgtgccaaatcacttctcaatatatctttgattttttttttttaatttatttttttagagacggggactttttgtgttggccaggttggtcttgaactcttggactcaagccattcccccctcccccccaccccgcttgaggattggcacacggccatgtatttgattcttacccagcactttctctttagctgagcgtggtggctcacgcctgtaatcccaacagtttgggaggccgaggcaggagaatccctttagctcaggagttcgagaccagcctgggccacttagtgagacctcctgatacggtttggctctgtatgcccacccacatctatctcgaattgtaatccccaattacatttggggaccagggagggtcaagggagggaccaggtggaggtaattggatcatgggggtggattcccccatgctgttctcatgatagggagttctcacaagatctcctggttttataagtgtttggtagttcctcctgtgttcattctgtctcctgccgccttgtgaagaaggtgcttgtttctccttctccttcttccaccatgattctaagtttctgaggcctccccagccattcagaactgtgagtcaattaaacctctttcctataattataaattgcccagtcatgggtaatttctttatagcagtgtgagaatggaccaatacagataattggtaccaaagtagttggcattgatataagatacctgagaatgtggaaattactttggaactgggtaacaagcagaggttggaatagtttggagggctcagaagaacaaaggaagatgtaggaaagtttggaaattcctagagtcttgttgaatggctttgaccaaaatgctgaaagtgatatggatgatgaagtccaggctgaggtggtctcagatggagatgaggagcttcctgggaactgggcaaaggtcactcttgctatgctttagcaaagagactggtggcattttgccccaccctagagatctgtggaactttgagcctgagagagatgatctgaaattggaacttaaatttaaaggggaagcagagcataaacgtttggaaaatttgcagcctgaagatgtgatagaaaagaattttctggggaggaattcaagctggctgcagacatttgcataagtaacaaggagccgaatgttaatagccaagagaatggggaaaatgtctccagagcatgtcagagaccttctctgcagcccctcccatcacaggccaggaggcctaggagggaaaaatggattcatgggctgggcccagggccctgctgctctgtgcaagagcagccttgggacttggtgccctgcttcccagccgtagctaaaaggggccaaggtacagcttgggccattgcttcagagggtataagccccaagccttggtggcttccatgtgctgctgagcctgcaaggtgcacagaagacaacaatttgggaacttctgcctagatttcagaggatgtatggaaatgcctcaatgcccaggcagaagtctgctgaaggggggagaaccctcatggagaacctctgttaggacagtgcagaaaggaaatgtggggttgcagcccccacacggagtccctgctggggcactgcctaatggagctgtgaaaggagggccaccgtgctctagaccccagaatggtaggtccaccaacagcttccaccgtgcacctggaaaagctgcaggcactcaatgccagcccatgagaatagcagtgggggttgaaccctgcaaagccacagaggcagagccacccaagttcttgggagcccaccctttgcatcagtgtgacctagatgtgagacatggagtcaaagatcattttggagctttaagtaatgactgccctgctgggtttggacttgcatgaggcctgtaagccccttcgttttggccaatttctaccatttggaatgggaacatttaaccaatgcctgtacccccattgtatcttggatgtaactaacttgtttttgattttacaggttcataggcggaagggacttgacttgtctcaggtaagactttggacttggacttttgagttaatgctagaatgagttaagacttttgaggactgttcggaaggaatgattggttttgaaaaatgaggatatgagatttgggaggagcaaggggcagaacgatatggttggttctgtgtctctacccaaatctcatctcaaattttaatccccatgtgtcaaaggagggcctatgtggaggtaattggatcctgggggcagattcccccatgctgttcttgttatagcgaattcttatgagatctgatggttttataagtgattggtagttccttctgtgttcattctccttcctgctgcctagtgaagaaggtgccttgctttcccttttccttctgccatgattgtaagtttcttgaggcctccctagccgtttggaactgtgagtcagttacacctctttcttttataaattacccagtcttgggtatttctttatagcaatgtgaaaacgtactaatacacctcgtttctaaaaatcagctacgcattgtggcatgttcctgtagtcccagctactcagtaggctgaggtgggaagatagcttgagcccaggagattgaggctgcagtgagctatgattgcaccactgcactccagcctggaaaaataaaataaaagtaaattcatgagaggcaaggttgactttcagagagtgtgtgagggaaaggtaagaaacaaaatcggaattagaaaatgactgttgcccctctcttttcattcttcactgcttttctgagcacctctcacctccctttgaaaaactgctctaaagtacttttaaagcagaaaatagtagcttgattgaatagatactgtattaaatgtatattgtgtaccaggctctgagctaagagctttacatctgctctctaaattaatctccacctctctccatgagtaggtattatcagaaagacatcacaaggtaacacaaatgttgagatttgaaccgagatctgtcttccaaagtccatgctactaataattgttaggccacttggtggtaaaaagcgtcccctgtattaattagctgtgtaattttaatccttcaacccagattaggggtctataactgaataaccaaaaagttattcagttagaatagttcagttagttattaactaatcatagttatttggtcaagcgcagtgactcacgtctgtaattccagcacttggggaggctgtggcaggaggatacttctaataatagtaactattactagagacctgataataattattaagtctcttactgaagaagttttactcttccattaagatgcccttatttataagtattataataaaatactgaactcatatgaattaattacccatgtagactgaaagacataggttgtcatataatggttgtcatataaagcatgaaggaggattgtcactttgttttcttgttgcactgtaattgcctgggatatcatgaaagttcttactggtttaatgaatatgtaatgctgtgggggaaagaatgaaactcaggccaactactttgactggtgtctggcaaagtcaactttcattgtcattttaatatggcgccgggcgcggtggctcacgcctgtaatcccagcactttgggaggccaaggcgggcggatcatgaggtcaggagatcgagaccatcctggctaacacggtgaaaccccatctctactaaaaatacaaaaaattagccaggcgaggtggtgggcgcctgtagtcccagctactcaggaggctgagacaggagaatggcgtgaaccctggggggcggagcctgcagtgagccgagatagcgccactgcactccagcctggacgacagaacgagactccgtctcacaaaaaaaaaaaaaaaaaaatatggctagagcaatacatgttcattagagaagaatcagaaaatatctaccaaaagaaggaataaaacaaaacacccccacaatccgattcattccagaataactacttttaacaccctggtttgtgtgctttcaaactctgttctcccatttccaaaggatgttgaggaacacgaacttaaaatagacagtgtttgtataaatataaattccttccttgctattgaaatcttttttcctctgaccaatcttagttaaatggaaggaaattgttttaaaactaattttcaggtctggaaagatagatatgaatatggaaatggctttctttgggggaagggatggactgaagatggttattattttctccttttttcttatttatgttttctgcaatgacaagtattttgtaataacaaaaggaaactttaaaattattcttcctctaaagtttgcaatctacctgtaaatgggtgattagaagataaagattataattatgggggttttatcatccaatgttacagtttttcaggaatattcttacaagtttcttgacatttttatttatagataccctatattaatcttgtgaagcatttaacatctgcctgtccaaatgtatgtcgtatatcacggtaagtttacagtccatactgcaactactaaaattatccatttttaaatttattattgtttaaaaatttttttttgtagcgatggggagctcactgtgttgcccaggctggtcttgaactgctggcctcaagctatcctcccaccctcaggttcccaaagtgctgggattgcagacataagcacccggcctaaaattattaattatattgcctgtaaatttctattctaaattgtagatctctgcctattcaaaaaacaggaatataataaagtttgagctcaacccagaacacaatgaacatagtttagtttttctttgattttgtgggttctcaaggccctatttataaaagtgatctattgatctgtcatttagcaagaatagaattctgtatgtttttccaaattataatgaccttttcagattcatgattaatttctagcaaatatttgggctgaattttccgtatctgagtctactaaatatatatgtatataaaacttacttgaaaatgaagtcatgtgcatttttgcatgtcccaggtttcatcacacaaccccagacagtaaaacacacagtggtgaaaaatacaccgatcctttcaaactcggttggagagacttgaaaggtctgtatgaggacattagaaaggtgagttttttattctgctgtgatgtaatgttttagcttaccaaaacttactaaaattttattttattttttattcttataattattattattttttgagctggagtctcactctgttgcccaggcttgagtgcagcggtgcaatctaagctcactgcaacccttgcctcccaggttcatgcaattctcctgcctcagcctcctgagtagctgagattataggcatgcgccatcacacctgggtaatttttgtatttttagtgaagacggggttttgctatgttggccaggctggtcttgaactcctgacctcaggtgacctacccgccttggcctcccaaagtgctgggattacaaaaaaacagtgcaggttttcagatctgtacaatgcagtttgcaatcttgattcacgtatggtcaagtttcaaatgtttcttgagaagaatacatatgacccagtgccaggcaatatgaagaatgcaatatgtatttatgtccagaaagaggttatggcagggttgggaacctgaaggaaaaaaatggtccaggtagctcatgcttgtccaatgagttatcccacctttcctcttaaaacccaccacctcccagtgactccagctgtctcttccttatctaattctgaatgtcattgccagtgtgccccaaatatggctttcttcattcaactctttttcctgaaaactttcagtagtttccaacctcacgtggttgggcaccgtggctcgtgcctgtaatcccaccaatttaggaggccaaagcaagaggactgcttaagcccaggagtttgaggctgcagtgagccatgatcccgccattgcactccagcctgagtgagagagcaagacattttttctgtctttagaaaaaaattggctgggcacggtggatcacacctataatcctagcactttgagaggacaccacttcctgtttcacagacagtaggggctgtggaggaagaactccttcagctcctgctctgtcgcaattggccagcttgcctgcgccttctctggcgattgcctgctctcctcccacccgtggaagtcatgtcccttccctctctaggggcagtcccttagccaacctccctagtttcttaggaactcccccagacatggcctctccctctgtctgcaaactttcattggcatggtcttccatatccattgggtgttcagtttcttcacctgcatttttaaaaggcccatccactgacccagtgcttcactccctcccttccctcacagtatcccctgccctctgccttcctccagtgccttcatgttccctccactattgcactggggccccctttccagcctctcctctgaagctggttttgcttgggtcactgatagcttccctgtgctaaatccaatggatgtgttaccagcagcaaatttgtacaggtctgcagcaaccttaattcttgcctcctcagaagaaagaattcgactgaggggcctaaggcagaaggagagacggaggcaagttttagagcaggagagaaagtttattattaagtgtagagtaggaagggaaggaagtaaagtacacttgtaagagggccaagctggtgacctgagagaaagtgtggtttgaccttggaatttgggttttagatgttggcatacttccagggacttgcatcccgatctccccggtttcttcccttggggtgggctgcccgcatgcgcagtggcccgccagtgttggggaggggagcatgctcagtgtgtttaccggagttttgcgcatgctcacgtgaggcattcttcccataccagtcccagttttcctagaaggacatacaccaattaagctctgccattttgcctcttagtgtgcatggttgagccgactcacccaactcccgagatcttattgggaagctgatcaccagtttcaggtttttgtatctattgagagactgccgtcccttggcaccagctgtgaccaattagtattttagcgacacagttaacaactgcttgaccatcacgtgatggtcgccttcctgttgtgggtcggggagccctctcctgccctgctcatgcctgactagctatctactgtaacggacacttcctggttttctgaccattgggcactattgactgtaacccctccttgaaacatggttcccttcactctgcactttgttccccctccttatcctgaggcttttcttcggttcatcacctccagctcacttcctttaattttgccattccctggggttccgtgggccccctcctctctctcttccttatatatctgtgtccatacttacgtctctcaaataatatcactactccaggttgaatcacatctcccacacccaggtagctaactactcaccgggaacgccatggggcggccatgacggtctcaggcttaactcagctgagactctacttttcccccacgagttgtttgttctgctgttttcctgttccttgggaacctgggaagaacccaggacttgtccctctccttcccctctatgtccttctagtctgcctcttgtcagtccccactgccccaggccaggcaattccatgcccctggtcctttcattcgtgctcttctcctccctgtctcagcttccgaggtgacagcttacctgggtgacagcaccacacccatcacactgtgttgtgtcaacggcagtgatcgttttacttctccccatctagaccctgagctccttgtaggcaaggcttgtcttactttacctttgtgacctctgtgtctgttacagtgcctggcactaagtcggtaatttactgaatgaacgatgggcccactttgttgtgttcacctgtgccgagctgaggttcattgactcccactgcatccaggggataaactctgacttagtcttggagtggcagatacaagcgacacacacccgtcagctggaaggctcttgtcctctttgtgaatcagaaccctgtttaggcttctaatcccacatcaaagcccatctcctccatgaaatactcagtttttctagcctgcactgatctcttccttccctgaactttcaatgtatttaatgtacagcattgttcacgctaccactgtattcgtcattgattgtttcatatttgcaaaatgtttctctccccagttcagttgtaggctccttgtaatccggcagcccatgccttatatgggctctatgcgcttacgtgggcctctatgaaccctcaaaatgtcttttgccaaataaaggccaagccagatggactgagccctgtttcttctccttggctgtggccttactatcttcctgcccctcgtaaacagctttgcccctgggagtttgaggctgcagtgagttatgatcgtgccactgccctgaggcctgggtgacagagcaagaccttgtctctaaaaaaattaaaataaaaaatttaaaaaaacaactttgccaccctacccatcacaccccacccgcctgacctgcttcacaggctcccgacggccactggcttccaccttccccatctttctcttcccgcctccatcttttaagctgcgaaccagcccctgttcctttcactgtccagctgtcaatgagcccagagtcccttagccacctagtgctttcttccccctcctgctgtctcttggggtcttctggtgtctgattctgtcagcggggcaggtggcagtacctgttctagcattcaggccacttggggctgatccacgcattgtttatgttctagcctgcaggacagccaggtggatggccctgcagcgtgggagccttgcccacggagtgttgaatttcttaattgaaatgaatacacttaaattaaaccaaagttttgtagaagaaatcctggccaggcacggtggctcacgcctgtaatcccaacactttgggaggccgaggcgggtggatcacctgatgtcaggagtttaagaccagcctggccaacgtggtgaaatcccgtctctactaaaaatacaaaaaattagccaggcattgtggtgggtgcttgtaatcccagctgcttgcggggctgaggcaggagaatcgcatgaacccgggaggcggaggttacaatgagctgagatcgttccattgcactccagtctgggcaacaagagcgaaactccgtctcaaaaaaaaaaagaaatcctgttggctttctgtgcagttttttgatgccattgtgacacagagaaactttatttcaggaactgcttatatcaacatcagaacttaaggaaatgtctgagtactactttgatgggaaagggaaagcctttcgaccaattattgtggcgctaatggcccgagcatgcaatattcatcataacaactcccggtgagctctttttttcattcctttcttgtttttatatttggcaagtctttcttcccggggttacttactgtttcatttcccatttaagaattagcatataccggctgggcatggtggctcatgcctataatcccagcattctgggagcctgaggcgggtggatcgtgagatcaggagtttgagaccagcctggccaacatggtgagaccccgtctctactaaaaatacaaaaaaaattagccgggcgtggtggcaggtgcctgtaatcccagctacttgggaggctgaggcaggagaatcgtttgaatctgggaggcggaggttgcagtgagccgagatcacgccattgcattccatcctgggaacagagcaagactccgtctcaaaaaaaccaaacaaaacaaaaaacatgggggatttttaaaacaaaactttggaggggattttaataaacgatagaaggtatatcttaagaaacagagcacgagggagaaactactacttactgatttttatattttcctttattaagcttttcagttgtccattaaatgttccctactagattacggggagttcttaacttgaggttcacgggagttgtgggatgtctgtaaacaacttgacattgtatgcaaaattttgtgtatatttggattttttggggaaggatttctatggcttacagtttattctcaaagggaagtagggccctgaaaagctcaggaccccgtgtttgttttctctctgaatcttgctaaccatggtgtctgggtagagaaagtaggaatccannnnnnnnnnnnnnnnnnnnttactagagacctgataataattattaagtctcttactgaagaagttttactcttccattaagatgcccttatttataagtattataataaaatactgaactcatatgaattaattacccatgtagactgaaagacataggttgtcatataatggttgtcatataaagcatgaaggaggattgtcactttgttttcttgttgcactgtaattgcctgggatatcatgaaagttcttactggtttaatgaatatgtaatgctgtgggggaaagaatgaaactcaggccaactactttgactggtgtctggcaaagtcaactttcattgtcattttaatatggcgccgggcgcagtggctcacgcctgtaatcccagcactttgggaggctgaggcaggcgggtcacgaggtcaggagatcaagaccatcctggctaacacggtgaaaccctgtctctactaaaaatacaaaaaattagctgggcatggtggcacgcacctgtcgtcccagctattccggaggctggggcaagagaatcgcttgaacccgggaggcagaggttgcagtgagccgagatcacgccattgcattccatcctgggaacagagcaagactccgtctcaaaaaaaccaaacaaaacaaaaaacatgggggatttttaaaacaaaactttggaggggattttaataaacgatagaaggtatatcttaagaaacagagcacgagggagaaactactacttactgatttttatattttcctttattaagcttttcagttgtccattaaatgttccctactagattacggggagttcttaacttgaggttcacgggagttgtgggatgtctgtaaacaacttgacattgtatgcaaaattttgtgtatatttggattttttggggaaggatttctatggcttacagtttattctcaaagggaagtagggccctgaaaagctcaggaccccgtgtttgttttctctctgaatcttgctaaccatggtgtctgggtagagaaagtaggaatccacacaacagtagactcagacttgacatgtccagaacacagagttgtggtggatcctgagacttgcccccagatcccccgtcagtgcacgactctgccccagctgctgtaccaggtatggttggtacctgttggccttcatttcttagcctcttcaaggattgccttggctacaaagagtcctctcaccttaggctgtgccccttcgggaggcagcccacatccagggactgatagatgaagggccattctacctgcacaccctagagggtgtttcaggctgttgattccagctcagcttctcctgctacccagtcctgtatcctctccccctccctcaggtgtcagtaatcccaagggataatcccgaataaacatcctgtcctttaaacttcatctcagagtctgcctcctgcagaacctaacttgcaacagagctcagcaaaacccaagctcattttattaaagaacccagatcaaaaaagagctttatgggctgggcacagtggctcacgcctgtaatcccagcactttgggaggccaaggtgggtggatcacatgagttcaggagtttgaggctagcctggccaacatggtgaaaccccatctctacaaaaaatataaaaattagccagtcgtggtgacacacacctataaatcccagctactcaggaggctggggcaggagaatcgcttgaacccaggaggtggaggctgcagtgagcagagattgcgccactgcactccagcctaggggagactctgtctcaaaaaaaaaaaaaaagaaaagaaaaagagctttatgatagatttctataaaattgcttcactcactgaatgcagcacagttatagtgtctgcatgtttctcagacaagccaaacctacctagcctgctcagctgcctcattgaagacactgttatcactggcacctggatcttggcaccatccattcctgtgtgaaactcttttagttctaagaagtgaatatcattgccagcaatcaggataacagactacccaaattgtgctgtacagagatctgttgatatcaattttgcaaatagccaatggcattggattacattagtccagttttcaaagctgaactagatgtttagggggtcaaattattagacacagttttcacagtagataacaggttgagagtccaggtgtgataacaatcctgtattcagaggaggtaacttttatagcactataaaaaactaaggaaattaccaaagcctatccctgaaaagactgtaacaaaacagccatttagcactgactggctccagtgattccaaaggtcaggccactaacaactgtagagccattcctggtttctgtgtgttctgtgtcactgagccagccactgctgctgctgtttatgggataggcaagaaggttgctaccaaaggaaatggttttgtctttcacctaggagatggttctgtggatatgtccatagtcactgttaaaacggatctttgaagtacattctacagtaagggacacccattaagctggagattttgatgagcagatggtcatcatttcatgcatgagtgcaaggtcaagcataagaacctcagtgagagcaagagggctgcagggcttgtgaccgtggtgtgtgcaccttgttcagcaccctccatgccaggatgaggctgattctgtctgcaaaggaatcaactcctatacttttttttttttttttgtcttgctctgtcacccaggctggagtgcagtggcacaatctcagctcatttcaacctctgcctcccaggttcaagcgattcttctgcctcagcctcccaagtagctgggattacaggcacacaccatcacgcccagctaatgtttgtatttttagtagagacggggtttcatcatgttggccaggctagtcttaaactcctgacctcaagtgatccgcctgtctccccctcccaaagtgctgagattaaaggcatgagccaccgcgcctgggcactcctacactttccttacccatccccaatttgaaagaactgaatgctggttagtccatagtaccctggaccctatagagaaagctctgcacagagcaacctggataagttgtagatccaggtatcatcataggggtctctctccacatatcccaagattcagaagctcttgtaatttcttcttcagtggcaagcaaataagcaatagtgtgaaccctgcatcatttatgatgcaactttgcagacatccattatatccacagctaaatctgaaaatattcaggggttgctgcttttagataccaattattttctcttgacattaaaatgctaacaaatctatgactgttaggatcaagttaaaaaaattcccactgaagagagacagactttattctgagccttacgtgtttctttaggtttagaaggtgaatgagcagtggctggggaggatggcctagaagttggagctcacaggcttcctccctgcactctgccattccttagattggaggcgcccttgatacagatccctccctacacactgggggtttacttgcaatttaagacttcacattttatattagtatgaacagggaaaatatattttgtaaaaccacatgtaaacctcgtaaaggattcactggtagggtcattgtattattctatctatttttaggtatgtttgaaactcttcattattaaaaaaatttttttggccgggtgcggtggctcacgtaatctcagcactctgggaggccaaggcaggtggatcatgtgaggtcatgagtttgagaccagccttgccaacatggcaaaaccccatctctactaaaaatacaaaaattatctgggcgtggtggcacacgcctgtagtctcagctacctgggaggctcaggcagaagaatcactaaaacaaggaggcgaaggttgcagtgagtcaagattgcgcccctgcactctagcctgggtgaaagagcaagactccatctcaaaaaaaaaaaagataattttttaaatctaatgaaggaggaaagaaaagtcctgacaggcatgctgaatcatagcatactcttgcaggtgtgaagtacagaggacgtagccaactctcaagaccaagggcttcattttccatgctaccttgcctgtcacctctcccagatcctgggaaaatgtgatccactatttcacagtaggaaatagaaatggtgcccagttttttgaaggcttgattcagtttggcattttggagatgtcatcttaaggacagtgtgaggtttttctgtaatctgtgcattttggtcatctgtcccaccctcatgttatggataagcagtggcagcatttcccagatgtaagctgacacacactaaagctgaactggataaaaaatacatcaggtaaaactatggaacatctgaaatatgatgtatattctacgtagaagctgtgttacagtaccaaataacatttcagtttcatcctgatttcatcagtcaacaatttagccatgcaaaatgacattttttattctatttatttatttattcggagacagagtctcgctctaccccccaggctggagtacagtggtgcaagtctcagctcactgcaacctccacctcccaggttcaagcgattctcctgcctcagcctcccaagtagctgggattacaggcacccactaccatgcctggctagtttttgtatttttagtggagacgtggtttcgtcatgttggccaggctggtctcgaactcctgacctcaggtgatcctcccgcctcggcgtcccaaagcgctgggattatgggcatgagccactgcgccaggcgcaaaatgacatttttagatggatatatagtctatgaaatttcaaaatattttaagaaatctttgttgtaataatagcttcagattaccaaaacaactctagtatcttggtgagtgctgccaatttcattgcaacttctcagcaggagccccgtctgctgatgtaatttatcataatggaagtggtgcccaacttctgaatgcatgagaaaggctagaccttacctgttgttttaaggtaaggtctactgctaactagtaggaggtgtctaatttattagactgaaattcacttgcaaaaatattctaaaagccttatattaaaaaaaaactgtaaaagtttatatcttttcctgtgcattcaactcaaagaagatagggcctagtaaatttacctgaaaaatatttaagtattctaatataaaaactgaatctcactgagggattcaggtggcttaaaactcacctgaaccctgaacctctattttctcatttactgaagtttattggggtttttggtttttttgtgtttttttgaaatgaagtctctgtcacccaggctggagtgcagtggcataatctcggctcactgcaacctccacttcccggctcaagtgattctcctgcatcagcctctcaagtagctgggattacagatgcacaccaccatgcccgactaatctttgtattttaagtagagttggagtttcaccctgttgtccaggctggtctcgaactcctgacctcaagtgatccgcccgcctcagccttccagagtgctgggattacaggcaggaacctgtaactgtgcctagactacagaagtggtttttatatgctaatttgtccctaccctccactgcttttgttttaatactccccccttagaagaatttgttgtgatctagacatattaagaagttgtaactgaaatattaataaagaatgaggccaggcgtggtggctcacacctgtaatcccagcactttgggaagctgaggtgggtggatcacctgaagtcaggaattcaagaccagcctggtcaacatggtgaaaccccatctctactaaaaatacaaacattagctggatgtggtggtgtgcacatgtaatccaagctacttgggaggctaaggcaggagaatggcttgaacccgggaggcagaggttgtagtgagccgagatcacaccattgcactccagcctgggcaataagagtgaaattccatctcaaaaaaaaaaaaaaaaaaaaggaatgagtagcactgtagacatgatttccaggctgagagcagttgaaagggtctagggtttagttctaaggctgctggtaagaggagccagcgtgacatcatattttaaaattatatgtaaagcaagatcaaaagctttcctcatgctgatttagtgtcgatagttaaattacagcaccttttatgtagttatacttcatttttcattgctttctgccgggtctgaggaattggaatgagcattaccttgtgcagatgttcagattcgatttttaaagaaaaagtcatatttcagaatccctctcccttttttcccctctaagatacaacctgatggtatttgaaaataagcatttggaataagtgcaacatttggttagtgtgtgtttaaatgaggatatgttttaggttccaaatggttatttcgccagtttgattttcttgaaatttagtttttaaaaattgccatagatgatggtggtaataatgattaaaatgaaatgggggacattccctctgaactgtaaaatttatatctgtgtcctgtcttcttgagcctacttatcctatagtttgtgttaaacttgggaaataaaagtttaaatttctaatgagaaggttaaatgtgagttggaagaaagttttacaaacatcttctgttggttactgaggttgtcatactaaacgtttaatttaagacattactacgcggggtgcggtggcttacgcctgtaatccacactttgggaggccaaggcaggcggatcacttgaggtcaggagttcgagaccaacctagccaacatggtgaaaccccatctctactaaaaatataaaatttagctgggtgtggtggtgtatgcctgtagtcccagctactcatggaggctgaagtgggagaatcacttgaacctgggaggcgaaggttgtgagccaatattgcaccactgcactccagcctgggtgacagagcgagaccctgtctcaaaaacaagaaagacagtattaaaagccttgaacattgagacagttgagtctttaaaatacttttaaaaaatgcttctcacctatcttccctatccaccccaaaatttaattgtaaacttataaacttaaacacctgaccaagaacactgttataaagatgattcttcagcccaataagatcagccagacttctgatcgtttactgtttttttggctaatggtacaatttctacttcttcaatggggaattcataaaatgtagttgtggcagggtttctcatacatttgtaaatgtatagaaatggctgtgtggtgaagccagagtttttataccgtttctcttagagaaataacattctttatcctagatccgatgtccagttttcacaagctgattgctgagaaggttctaggcggcgtctgttaaaaagcattgctttctgttaattagacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggtatggttttttggtttttttaaaatctctcttactgaatcacacgcttttcggaccgcatttgtttctcagatttgtctcattaaaaatatgcttgctcaaatgtaatgtggtcttctgaatttcaaaaaagtattcatgtcttgtccaaatacagatatttgataaataaataataaaaaataccatggaaaaataaacttagtatttctaatagaattcctttggttataaggaaagggattttcatgggtgtccaaaaaatgtatttcatgaggaatcatacgttttacttttgggcttagattacccagattcagtttaattttttaaacatttgtataattgagtgctgcatataaatgccaaagcaaacaaataaaactaataaaagaaaaaagaaacctcagagagatactgttctgccatgaaaattctgtcttttgaaatagaagttctgtaattgggtttggttcatatatgtatatattaaagcatatttctatattattagcattgggaatatgggaaacagggacttggtttgaggatgcatagatcctgggttgaaggatgagaataaagttgaacagatgagaatgaaaatgcacaggcatccatcgccatcaccacacacgtgctctacaaacaaaaagtttgtgcaggccaggcgcagtggctcatgcctgtaatcccagcactttgggaggctgaggtgggtggatcacctgaggtcaggagttcgagaccagcctggccaacaaggcaaaaccctgtcactactaaaaaaacacaaaaattagccagtgtacacctgtaatctcagctactcaggaggcttaggcaggagaatcgcttgaacctgggagagggaggttgcagtgagccaatatcacactactgcactccagcctgggcaacagagtgagactccatttcaaaaaaaaaaaaaaagtttgtgcaaacaactaccccaccctcacctccttttctctcatagatttatagtattcctggttcattcctatttaattctccttattaaaagaagagatatatgtatatacacacacacacacacacacacacacacacacacatacatatatatatgtttattgttatcttcacatgctggttttatttgaacataaatgactgttttgaaatcgagtcttgcaatttcatttatatgccttttatttcaaattttagattaaaaggttttacgtcctgttgactaaattctgtacatcagaatgttggccaaaaagcagatggcgtttagatttggagaggatgtgggtaactctatgacccatccctgccgtcagctgtatctgttttcaggcatagccagtcctaaagccttatgtggagccttgggcgggggaagaggatcaagagaacaaatgatggtctccgccttggctagcccctgtgtgtctgcctctgccactggggacctctttctgagggcaggtcaaggacacatgtgccgccttcacctgcctctttcagttctgacagccatctgcttagcacagggctacttgccagttcctacctgtttctgcctctgacccacaactgctatgttaccggtacaaaaccccccacacacagtgccccctcggtgagcccttgttaggcctggcctgggcttcctagcacttctttcctttaactcccacccctggccgtcacagtcctgtggcttccatgtcatatgctggacctttggtctctaggatctccccggccaggtgaagaaggaactaaaggccaaaggatcccgagccttgagctgctaatgatgtaggggctgggtcagggaatgtaagtgggtacctatatatcataatttgtaaaatgactttataggcatatacttacatcaggatgtcttacataatatgtatattatataaagtggtgattaattggtaaacacaatgaacatcactgtttagatactgaagaacctaagacaataagtacctaaatagttatgttgaaaattctgtgaactctagcctttataactaattactacagaatgtaacacttacggccgggtgtggtggctcacgcctgtaatcctagcactttgggaggccgaggcagttggatcacttggggccaggagttcgagaccagcctggccaacatggtgaaaccccatctctagtaaaaatacaaaaatacctgggcgtggtggtgtacgcttgtagtcccagctactcatgaggctgaggtggggggattgcttgaacccaggaggaagagtctgcagtgagccgaggtcatgccactgtactcaagcctgggcaacagagcaagactctttctcaaaaaaaaaaaaaagaatgtaatatatatctttaaatatgcaaattaatgtgatatatagggtgtatttggttatagcatataattcaactatttatgcagtagtttataactagttgctaatacagtgtagacatccatcacagtctaaagaagactggaaatatgttgattgcttagtgttcaatggaaaaacttttttttttttttgtctaggaatgaggggcagtgtcacatagtacaaaaagcatttcacttggagccaaaattctttggtttaatttttattgaaaataacatgtatcgtgccatgctctggggtgtgctcagtactagctgagatgattcctagtctgagctcccactccactccaccctccccactgccctgggagcatagagactagagcatcactgactggtacgcaaggtgtgatggtcgcagcatgcatgggtgttgtacacgcacaaaagggaggcatctgaccagactgagggatcggggggaacttcttagaggtggcatctgaaccaattatgcaaataagtccactcagtgaagaagggggcagaactttttgagcagaaggaacagtaagtggaaaggcacaaaggaagaatgaacatccagtgtagtgaaactgaaggcagctgcattttggtggggctggtgagtgaagctgctctccctctccaggcattgatttcttcaggtgtcaactggggagatggacatggtcatctctgagagccaatacagttcaagtactgtcccaaatctgtaaccgattattagaaactgggaagagtgacatggtcatctctgagagccagtccagttcaaacactgtcccaaatctgtaactgattattacgaactgggaagtgacatggtcatctctgagagccagtccagttcaaacactgttccaaatctgtaactgattgttacggactcctgttgaggaagaagaaggtaaaaaaccctgcatccaagatgagcccccacttccacgaagctcccttccagtcagtttcatcattggctctactgctctgatggatttttcagaacgttctgttttccccctgtctttttctaggctgttcttgctggagatttaattctttctgcagcatctatagctctggcacgaattggaaatacaactgttatatctattttaacccaagttattgaagatttggtgcgtggtacgttgattctgatttttcttctttgttattcaaccctggtgtttagccaggcaataaagccacctctcaaatgactcctttccttctttataggtgaatttcttcagctcgggtcaaaagaaaatgagaatgaaagatttgcacactaccttgagaagacattcaagaagaccgccagcctgatagccaacagttgtaaagcagtatgtacgttctgtctttcttcaagttaaagcctcatagctcttttttgggagctaattttcctagaaaatatttcggtgaagaatcttaaaatagtacccaaaaatcccaagaggttaatgaggaaaagaatgacatccccaaacaatagaggacttctgctgtgttttcatttttgccatcttcttttggtatgcaggcgttgacttttcatcttttcttcccaagaattcaatcaaaataagctttcccgcaccttccccaatctgattgccaaactgtatcattttgaacaatttatcataatttctctaatgattgatatcacacacactctttctgacacttcaccttttagaaatgaagtgctctgttctttaatataatatttactcaggaaaagatatctgttagattgtactagcattctatgaacttttttttgtttttttgttttttgtgtttttttgagacagagtcttttgctgtgtggcccaggctacaaagcagtggtgtgatcttggctcactacaacctccacctcccaggttcaggcaattctcctgcctcagcttccctagtagctgggaccacaggtgtgcgccatcacacccagctaatttttgtatttttcatagggatgggggtttgccatgttggctgggctggtctcaaactcctgccctcaagtgatccacccaccttggccctgcaaagtactgggattacaggcatgagccattgcacctggccaatacattgcacctggccaatccttctaatatttttacatgaaatataaacaagtcctatttcttcagagtacaaattgagtataagccataactgtttttccccttgctttctccctccctccgctgtgcatacacatgtatacattttttttttaatgagtaatacctttaatccgtagacaaatgtgtggtattcatcgttagtccaagaatgaaaagcagtctctccatagaattgtttatctgcccatctctaagcctgacagatacacagagacaaaacctggacaaatgacattcccatgtaattacagccacaaaataaggaagacctgtaagggtcgcatgtcaattgctgtcatgatagactcctaacataattaacaggtaaagagagcttttgctcagacctctcagatgaaaaagtctcttgctgttagtgtctctgttttgaaaagtgtcaagaaatgtataattgcaaggcagaaaagaatgaggacaatcttttcttcctaaaaagacctaatagaaactttaaggaatgtgaattatgtagaacatgctagccacagtctcgaccacttttgtctttttattaaaagggctattatgtttttatttccaagaaattatgtgggttttttttttaaagtgagatggaagaaagtatagacacgagatgctaaataagagaatagcctattttaagtgggtgctctaacacttttacagtaatcctttacatattatcatgcccttgatggcccaactctccctgaaggtcaggatccatcctcttaacacattagggtgccttaatattacttactaatatttatccttaagaggatgtgttaagtgaggctcattgataatttcacaatttgagactgcaaacttagaagcattagcatggtcaggcaaggtggctcacacctgtaatcccagcatttagggagactgaggcggaaggtttgcttgtgaccagaagttcaagaccaacctaggcaacatagcaagatccccatctctacttaaaaataatgtttaaaaaataaagtcttagaagcattagtagtagtgagactattggaattggaaacaccaagacttactgtctgcaccatgcagacatcctgcaggcacggggtggggcggcaccaaattggagctagcacagaaattcactcagtgatggaagcttacaaagggtccaaagaaatggacctgagtcatgatagagaggtttccttgtggtcactgttttctgtttaagaagccaaagataatgcacaggaattcttttataaagatatgcacctcattcttcaaagattagcagctgaacgaacagtgaacatgttaacgtggctggacccttattaaaaatgaaatgtttcatgctgcccactagggggcatgctggcatcgtcccagcactacctccttttcatgtggtttattcctaaactccacagctcttagaataataaagcaaaatgatagtgtgagctatttgaataaaagtttctatatttaagtgcctatgggtggaaatattccagaggtgttatggattcaaaatggctatttttacgtactcttggtatttaaaatgcaaagccatgcgagctccaaataaatgcatgcaaagcaaattagacacaccaaaaagaggggaggaggagaactgaaagagcagaattattacagaagaagaactaatgggattgcaaaatgtattgagaattggagggaaacttacaagctgcattctactaaggataccatttcttcatctcccttcctttttttagtgaaaataatattaaaatctaagagagggctgtctagggggattgttttgtgattgactgatattaaaatagaatccattttaggccgggcacggtggctcacacctgtaatcctaacactttaggaggccgaggcgagtggatcactttagtccaggatttcaagaccagcctggccaacatggcaaaaccccgtctgtactaaaaatacaaaaattagccgggcgtggtggtgcacgcctgtaatgccagctacttgggaagctgaggcaggagaaccgcttgaacccgggaggtggaggttgcagtgagccaagatcactccactgcattccagcctgggcaatagagcgagagtctctcaaaaaaaaaaacacaaaccagaattcatgttattatcaaaagatgacttatttatttacatacttactcacttgcaaaatacattttgtactcatgcaaaatacattttgtagcttactaataaagacagtggcttgtttcccaggaaatctggtggaaatgagacctgagaggtcagagggcctgtccagttgttgttaagccagacagtagctgagttgagacttgaacccagagctgggtatggtaatcctgccttgtttctctctctctctctctcttttttttttttttctgaatttctattttctccagggctgcttgtggcctggaattaatgggctctcttcctattacttgattttcaaagcctcagagtaccactacagaattgcatattgtgggtcacattagcagaacactctttttttttttttttaattcatttttttgagatggagtctcgctctgttgcccaggctggagcgcagtggcatgatctcagctcactgcaacctccacctcccaggttcaagtgattctcccacctcagcctcccgagtagctgggattacaggtgcacaccaccacatgccacacctggcctcttttttttttacaatattcatatctatctataggcctcattcagatcttgccagttgtgaactgttataacgaaagggaaaacatatttttctgttccagcatccagtccaggatttcacgttgcattttgctgtcatgactctgtagtctcttgtcatctagaacagtctttctttgcctctcattaccttggtatttggaagagtgcaggccagttatgttgttgagcctctcagtcgggcttctctgatacttctcaagattcgatccaggttatgaatatttggcaggaataccacaagagcggtgctgtcctcagctcctcataccaggaggcgcgtgctgtcttgtctgtcccgttactggtgatgcatgcctggatcgcttgattaggatactgtcgggccgggcacagtggctcacgcctgtaatcccagcactttggaaggccgaggtgggcagattacctgaggtcaagagttcaagaccagcctggccaacatggtaaaaccccatctctactaaaattataaaaaattagctgggcatggtggcgggcacctgtaatctcagcactttgggaggccgaggcgggtagatcacctgaggtcaagagtttgacaagcgtggccaacatagtgaaaccatgtctctactaaaaatacaaaaattagccgggcgtagtggcaggcgcctataatcccagctactctggaggctgatacaggagaattgcttgaatccgggaggcggaggttgcagtgagccgagattgcaccattgcactcaagcctgggcaacaagagtgaaactccatctcaaaaaaaaaagatactgtctgccaggtttcttcaatctaaaattactattttaacctattttgggcaaagtattttcagattatgtaaatattattctgatggttgtcaaatggctgtttttctattttcatcatttcttctatatcactcttctacaagaaagttggtatcctattttttttgttattattatttcattctcaaaagagctgaagagttggtattccattgtaaggaagctcttaactgtatgggctcttggattcttattttattctgtatcttttttttttttttttttttttgagccagggtatcactctgtcacccacgctggagtgcagtggtgcaatctcagctcactgcaacctccacctcccgggctcaggtgatcctcccacctcagcctcctgagtagctgggattacatgcggctgccaccatacccggatgacttttttgtatttttagtagagacggggttttgccattttgcccaggctggtctcaaactcctggcctcaagtgatcgcccacctcggcctcccaaagtgctgggattataggcgtgagtcaccgtgcccagccatcttattttattctgtagattataacactgtcattattttaatactcaattatccaacgtatggccagtaggggaggccctttaacctggctctgtgtcctccatcattttttcagcaccccatttctggcaggagatattcagccctgttattcactgttctccaaggagcccacattccttttggtggaaaatggtgttaagaaaccagaatttgagtactgggtgtcatcgtttctagacccactcaatggacagagctaggaaatacatgtatgtattatatgtaatgtaggtagatacgtgtatatctttctgtacccatccatacttattcaaaaccacgaggtatcaaacagatagttccaaatccatctaacaccacaggatttgtggtttattccaggattccatctttccatatttgtaacccccttcccaaacagtgagagacctggctcctcttctccgcggtgtatttatttgcacaatctgagaatataccataggagtttacaaattcatgactcatatctctgtgaaaaacaaacccagtagctagaattcagtatttatcattccttttgtcttgggcctgaggataatagaatcaaagcactgttcaaaagttacctttctctacgtatcagtgtggttgtgttattatttggaatatattaacccatttatgcctagtgttccattattggaatgctaagcttgtggagttatttctatcctactgctcaaggtcattaccaaggtctgatttttcacaaaacaaatttgcaacctccagcataaatgggttaatagttggttcctttttttttttttttttttttttgagacggagtcttgctctttcgcccaggccggagtgcagtggcactatctcagctcactgcaagctctgcctcccgggttcacgccattctcctgcctcagcctcccgagtagctgggactacaggtgcccgctaccacgcccggctaattttttgtatttttagtagagatggggtttcatggtgttagccaggatggtctcgatctcctgacctcgtgatccgcccgcctcggcctcccaaagtgctgggattacaggtgtgagccaccgcgcccagcctagttggattcatttttattccactttagggattccctctcattcttgctgatttcgtgttttggttttgagcgttttgttattgttgctgttgttttgaatgtttgaaacaacgtggctgggcacagtgtctcatgcctgtaatcctagcactttgggaggccaaggcagatggattgcttgagcccaggagtttgagaccagcctgggcaacatggcgaaacctctgtctacaaggaatacaaaaattagctgggtgtggtagtgcacacctgaagtcccagctacctgggaggctgaggtgggaggatcacctgagccctgggaggtcgaggctgcagtgagctgtgatcacaccactgcactccagcctggcaacagagtgagactctgtctaaaaaaataataataataaaaaaaataaaagacattaatgtagctccaaaagtcagaactatacaatacagtaactctcccttttgccctgttttcttcccctacccccttgtaggtaagcagtctcgttcacttctggttcctccttcctgggtttcgtttagcacaaacaggcagacacaagtatgctatcttcccttctttctcacagcaagaagtagtaccctagactactctgctttccttttgcatttcttcagttaacaatttattaggaaaatgattccacattggtttgtaggatcttcctcatttttaaaaccactgtatcagggctgggcttgtaatcccagcactttgggaggctgaggcggccgaatcacgaggtcaggagttcgagaccagcctggccaacatggtgaaaccccttctccactaaaaatacaaaaattagctgggcgtggtggcacacacctgtaatcccagcactttgggaggccaaagcaggcggatcacttgagaccagagttcaaggccaggccggccaacatggtggaaccccatctctactaaaagtacaaaaattagccaggtatggtggtgggtgcctgtaatcccagctactcgggaggctgaggcacaagaatagcttgaacccgggaggtggaggttgtagtgagccaagatcacgtcactgcactccagcatgggcgacaaagtgagactccatctcaaaaaaattaataaataaataatttaaaaatttttttaaaagcctctgtatcagatcccattatgtggacatagcatggtttattcagccaatcttctatacatgggcatttaggtttccagttttacaattacaaacactactgcaagggctgatcgtgcataaacctatttttgtgttgtgagaggagtgcctgcagggtgaatttaggggtaattgcacatgtggttttgttaggcaccaccagatttccctctgttgggtctgtaccagtatgtgtttccaccagcagcttttcagaacctcttttcccacagccttactaactaaatgtgccattacacgcttgagtttttgccagtccagtagaggagaatgtattgcagtggagttttaatttacatctctcctttctgagtgaggtggaacatttttcagatgcttaagggccatttatttatttgtttatttatcggagtctcactctgtcacccaggctggagtgcagtggcacgatctcggctcactgcaacctccgcctcccaggttcaagcaattctcctgcctcagcctcccaagtagctgggattacaggcgtgagccactgcgcccagcccttcccagtctcgttgagacgtggcttgtaaggatgtgatgcaaggtgtgaaccttccccagaaagaagtgcatacgcacagcacagcctggctgcagcatctgcttcaaacaaaacagttagccgagctccactttctttgacttaatcattcttcatgctccacccatttccggaaagatgtgaggcatccctctgatgctgagcgcaagtctgtgcacctctttgccttcttgtatgttgtgctatgttgcgtccaatttgtggcagttgttttctgttttcctgctacagatctaggcagtactgacctgggatggggaagcaggactctctggcatggtctttatgctaccccagggaaatctgggatagttgaaatctgagcagtaatgtcccttcgccatgtgtcaggcagaagctgcccactaaataagctctgttcagcatgtgtgggcacagaggggacagtgcagacagactgcagctttatgcttacttggacacattccttgacctcttggaggttctattttgttgcccagcatagaagcagcactcctgtgttgaagtgatgaagagaacagtgtctggagccagaccatgtggatgaaattcaggttccagcgtgttggagccatgtaatgcctggtaccgtctgtgtctcagtttctcgaacttcataagtgacttaagatgtgagaactctcagaacagtgcctagcacatagtggacgctcagaaattgttagcttttatcatcaccaaccacataatccatatttgtgggatattgtgaggtttaactcaaatcatacaaagtgttcatcatatgtgctccacacattttaatccattaaaatgttcactaacagatttttaggccgggcacggtggctcacgcctgtaatcccagcactttgggaggctgaggcaggcagatcacctgaggtcaggagttcgagaccagcctgaaaccccgtctctactaaaaatacaaaaattagctgggcgtggtggcatacggaggttgaggcaggagaatcgcttgaacttgggaggtggagattacagtgagcccagatcgtgccgctgcactctagcctgggtgacagagagactccgtctccaaaaaaagaaatagatttttagaaaatctttcacttttcaggaagaaagcttatagtctctgtggctctgtgttgaggaaacagcattaatctcactacaggagactgcttcactatcagttatttctacgtggaaatatcttgattcccagtatcattctgtcctgagcccagcacatcccaggctgcccaaatcttgccatgctctcctttgagccaagctgatcttagcttctctcgaaagtttctgaattgtcccccatatggtctcccagactcttcagttgaaaaaaggagccctccctgacagcccaggggtcggtgcctgctcatgggaaggtggttgctgttgaaagcagttatgagcttactgttcactcaactcagtggccacctgaccctttatggtgcatgcaattttaccatgtacttatggccaagcactacatagtcaacagacctcattaagttgtcaaaaagcattctcaggctgaggacgttaggcaacctggctttagttggcagaggtgcgtggacactgccaaggctcctatttctggttccagtggatgaggtggaggaggattatttgtaataatagcaaacagccaggtgcggtggctcacacctgataatctcaacgctttgggaggtggaggtgggaggatcacgagcccaggagtttgaggccagcctagacaacatggtgagactccatctctatgaaaaaattaaaaatcagctgggtgtggttgcgcgtgcctgtagtcccagctactcaggagactgaggcggaaggaacccttgagcccaggagttcaaggttacagtgagctatgatcgcaccactgtaccccagcctgggcaacagagtgagaccctatttctaaaaagagataataatagcaaacacacattgagttctaaccaggtgccaggcagtatactgagggcttaaatgcagcatcatgtctgtttctcacagcaaccctacaaggtaagtgcttgtgatttctacattgtacagatgagcaagagagattcagtaacatgccgaggtcttgtagagggcacaaatgcagccccacagtctcacagcagagcccgcagcactgcaccacactgacgcctgagcaaagttcactccctgactggagagccacagaggcacgaccgaaggtcaggggacagggtttcctagcatccgcgagccttacagaaaggcaactgtgcagtgctccagctggctttctcatggagagtcaacagagacatttcccctccagtagaacacagaccgtctctcccctcccccttgttggttttacccaggctttgttttctgaaaatgtggctgggcctgcttaacatgcttagcagggcactgggaaatgcacttcagtggccggtgccagctagctttttggagttttaaaaagactttcagaagtcttatttctcccccattgaaaggagggaaaagggtttttatacagttacttcttttgagagaaatgtggaaacagtgggaccagtgaagttccttccgataatgaaagagcgatatctgtgtctgaagcaggaggcttgagatgatttttatggacacaccaagaaataactgcattcagaaacaggtgaaattcccaacgatgatgaaaagaaaggactacagatgggaaaattgtgtgtgattacattagtatctcttcctgaaatgagggatacattgatagagatgattaaagccaacagtaatcgggctagcttgccgagtgctagaagtcagtatttcacagatgggggtccgtttcttttgcatgtcaagaaggtttacttagcatgttaccagcagaactagtccagttgtagctcagtttttcctaagcagtgggaaaggctgcttatcctgtctgaaagcaggggttggagaaggagaattttcttagaatttaacaacacaatctgagactgaaattcttgactggaaatgcggttttgtacatgcttggtgtccctctgatgtcagcatctcctgagtgtgtataatctagccccgctgcctcctattttaaggaattccttcagccaggggtcagctgctttgttgctgcctggaagcagcttatctcagaatgctctttctgtttcaggtctctgttctaggatgtcccgacccagtggtgcatgagatcgcctatcagtacggaaaaaatgtaggaatagcttttcaggttagtatgctttttatttgtaagaatggtggcgtagtgatacagtcagcattctcccctagtgtgtaatcgtcaaaatagtaagaacgatggcagcagtgttggcatggcggtgctccttacatcccatttttccttttgccagctaatagatgatgtattggacttcacctcgtgttctgaccagatgggcaaaccaacatcagctgatctgaagctcgggttagccactggtcctgtcctgtttgcctgtcagcaggtaggttttacaaactccctttgacacatcactgcatagccccacagaactgatgtcccgcggcacagctgatgggaagattgcataaaggaatagatgggaaggcattcagataagagatcacaggtctgcatttgatcctggctgagtgagatgttggggctggtcatttcaccttgctaagactgtttccttatctgtgaaattgagaagatcacctttctcccagggtggttgtgaggattagctaagatcctatttgagatctttgtgtcttgtggtgtgccataggcatttgaggtagcatcgtgattatttccatatattttggccactggcaaagtgaacggtttctaagtcttgattataggactggactttggtggtcctcagagccccttaaaaggcataggaagcatcaagggcctccaagcataagaaattctccggttctagaagtttaatgagactctgctgctctgagagaggctttagaacctcggccattgcctcaaaatgtcaggaagtcagtggagtgcagtagacccacatagttccttctttctccggattgagggactgagtcccccttaatgtgaatgaaaggcttaggaagcttcaaagatgttccctcgactgacaaagcagacattctcacagcctcctccagaccctgccacatggcttgtggctgtactgaatgttacttgaaataagtgagacattagctggtgttggaacatctcgttaatagattttcatcttagtagtatttaatttgttatgttgcaaagcagtaagatgttcatcaccgtgccatgaaattcaacattagctctttggtgtaaaattatagtaacttttggtctttcagagattttgcctctattctgtcttcacgtttacaaaggtcagtcatgtcctccataaaattcagtgattccactgtgatacagaaaccacggcccttgcttttggtgggtttctgattggagagaggaaaggtcatctttcacccactatctagcatagccattggcagcatgattcttcccaggggaggctgacgttctgggtggctggaccaggctactttggcagcttgctaaggctatgaatggagatgttggggtactcggtaggaacacccaccctcattattacaaggcttccatcctctcaaactttggaggctgaggtaagaagtgaaaggtatgctgtaaataggtcctctctcccaatgaggcttacttgccagcccaaaatcaaagagtataatacatgtgcccagttttgacaaaaatttataaaacctccttttgtacattaaggcaagagtgaggaacatttgagccatgtaggtgttatgctggggattagaaaaatgaggcactggctaccagtaacctatataactgcgaacattacttctcagatacttgttagtaaacatgagtgaaggaaagcaagatggactgagtgtgctgaaatccagctagcttggtaaagattcctttacctaggctcagattatcaggataaaaggaaaaagcctttttccctggagaagtctatgagaaagttttggttgctctatttgtaaaaatcttcaaattgttaagtacttgttatgaaccccaggatactaagttaccggttgagtcctacttaaaccttaaggtgactgggtgagaggaggctggcctcttcggactgtgtttcactctgaatatatttcagaagaaactaacttactttcccctacacacacaaaggagtaatggctatctctgctttcatatatagtgggggaaaggggaaatggacctctgcatagtatctgtcagtaatctacaagagactgaaaaatgctggttaggcggtggctcatgcctgtaatcccagcactttgggaggctgaggcagttggattatgaggtcaggagttcaagaccagcctgaccaatatggtggaaaccccgtctctactaaaaatacaaaaattagccgggcctggtggtgcatgcctgtaatcccagctactcgggaggccaaggaaggagaatccttgaacctgggaggcagaggttgcagtgagccgagactgcactccagcctgggtgacagagtgagactccgtctcaaaaaaaaaaaaaaaaaaaaaaaaaaaaaggctggttaaaaaaagcaagcaaaaggaaaaaaaaagattactgtacccgaagccatggttttatgtgtgctttgctgggaaatcccagtcatgaggcacctactcatgctcaccagacagcagtgttctcatctgcccataaggcagtgagttgaaaaggcacattgcagcctcagaaaagggaacacagaatggagtccaagcaggaagtgactctggacaggactcatttcaaaagtagactgatgtttctgtcttgtggcacatgggccagaagttagccaagtatgtatttataagttgccttctaataaaacagcaaggttaggctcttttgtggaatacactgtaaaacaagagattcttagcaagaaatgtgtcaaaagatatatgggactaagattaattcaggtaaaaacaagttccaaaaataacgtaagaatatgcaatatctccacttaatgaaaatgtgtttttagtttacaaaggattctttcatacattatctctaatctcacaactcctctttgtggtagatattatggtgtttattctgcaagtaagaaactgatgcccaaacctcgccaaaattaaacatctggtaaatggcacagcagggaactgaacaagtctaagaccagtattcattttattacatcatacatagtgttattgccactggtaatgctgagaagttagtagctatgataccacacaggccttcccacagagcaggtaactaacccacctgggcactgacgatactcaaagaatcatctctgtgtcatgtctttgctattgtaaacaacatacctacttggtggagtagttctaagacgtctgtaatcctttccctttggtaggtgagttttgtttgctgatgagatggtctttgaacttttccatttgtgaacactggaccaggacaagcattcttgggaaaccaccttttcctttttaatttggtgtggtgggttgtcttggagtttactccagccagcacttgacagaaactccctgtcttttggaattcctttatttttaacatctctcttaaggggtttcctgataacagttggttcagaggatttaaaaagagttttggggatttctggagaagtcccaggggatgacagcgtcctcccatgtacgtatgtgtacatattctctttaagaataaaaacctcatgttaattggattttgaaagcttcagaaacaaaatggaagtgttttactttctctggtgaaacttttttaattttcaaatatcttttttaaaaaaaccaaatctttcctttcttctgcttctcttccttatttgataagtcactagacccaaacgtcagttgtagccacgtttccaaatgccatcaccagcccctgcaccagctgcacaggccttatgctatcgtggtgactagttggtgccttagtgttacccagtttcgtttgggtagactcatactcatcaccttagcagtttagtttatggatgggtttcacagagttacaacccgatttatccacaggtggttttcctactcttaaaaacagcacctgagcaaacagaatttttatttgtcactaaatctgcaggcaactgttcttcctgctgtgtttctcttttcttttccacatacacattaaggggactggggagtgcccggggaagagtttgatattttgcatattaaaattgcacacatgacatgtttggaaggaaggatgtagtcactcaatgcaaatatttttttcaaattttgctttctcaatgctttttatagtaaaagcatcagtgaaaacacccaatcagcatatcttaccacacttgctggtactgtagaaaaagcttatacatcataaacaaggtaatgtcaccagatgcctacgagagaatcacatcagtgtcaacgataaaaccttctagatatccagtattggtatgtggtattaaaaaactaaaacaggctgtgtgtagtggctcacgtccataatcccagcactctgggaggcccaggcgagaggatcacttgaggccaggagtttgacaccagcctaggcaacaaggcaagaccccatctctataaaaaatttaaaaattggccaggcacggtggctcacgcctgtaatcccactttgggaggcactttgggaggccgaggtgggcagatcacgaggttaggagatcaagaccatcctggctacggtaaaactccatctctactaaaaatacaaaaaattagctgggcgtggtggcttgcgcctgtagtcccaagtactcgggaggctgaggcagaggaatcatttgaacccgggaggcggaggttgcagtcagccaagatcgtgccactgcactccagcctggatgacagagcgaaactccatctcaaaaaaaaaaaaaaaaaattaaaaaattagccaggtgcgtgcctgtagtcccagctactcgggaggctgaggcagaggatcacttgaacctataggagtttgaggctgcagtgagctacgattgcaccactgcactccagcctgggcaacagaacaagtctcataacaaaactaaaacctacttgatttggcttttttaccgtagaagttgatttgggctttcctgatttctagtagcttgttttcttcttaaaagacccagtaactaaaggaaattactggttttcataagaactaaccagttgctggctctataaattctgtaaacacattagcagtctccacatgtttagagctttgttctgacacatattttggtctgaaaaaattatttctttgtctgtgatcacttggctgcggcttttctatgtatgccctattttttcttctaggattactaataccatggtcatggttacaggacaacttatttcatccttcaggttcactgccagggaaaaactggcagctgctgtaagcactgacgtggccaaaatcaaacacatcttacctcttccgtggagccatagactgttagagctcaagggcttccagtcatgaagatgagaagcctaagaccccaggggctaaggaagtcactcggctgtggcagctggtagccaaaccaagactagagttcggatctaggaagtgaagtgatttggtgtcctggcttttgtattctgttaatggtgacacttctaaatagttgctaagtattgtagaatatcgattttaccttcagttccttttttacctattttttctctctcttcttgctatcatcttaattcaggtcttttttataacctactctagtaacctgtttgttctgtctacctctgactcttaattccatggttctcaaccttggcggcacattaaaaataccagggtgggcgggaggaggttgaaaatcttggtgcccaggctaaaccccaagccagtataaccaaagtctctgggaacaggatctaggcaactgtatttatacctccccaggccaggcgcggtggctcacacctgtaatcccagcacttggggaggctgaggtggacagatcacctgaggtcaggagtttgagaccagcctggccaatatggcaaaaccctgtctctactaacagtacaaaattagccgggtgtggtggcgcacacctgtagtcccagctactcaggaggctgaggcagagaattgcttgaacccgggaggcagaggttgtggtgagccgaggtcgtgccactgcaccactccagcctgtgtgatggagcaagactccatcacaggagggggggaaaaacaacaaaaaaacaaaaaacactccccagctgatcccagtatgcagtcaatgtcatgcaccgctgctcagatccactctacacactgcttaaggcagagctctgcacataatgccctctgctcagaaacctcagtagctttcagttggtaatcaatttagaacttagagtagaatgcctaattcccatcctcatcctaggccagtgactctcaaaatgttggcagagaccagagatactggtgtcacctgttagatggtggcatctgttagaaatgcatgccaaggctccatccctactcaatcagaaactgggggagaggccccacaagcagtacaggtgatcctgatacgatttaaagtttaacaaccatgttgttttttattttttatttgagacggagtttcactcgttgtccaaggtagagtgcaatggcgcaatctcggctcactgcaacctccacctccccaggttcaagcaattctcttgcctcagcctcccgagtagctgggattacaggcgtgcaccatcatgcccggctaattttttgtatttttagtagaaacggagtttcaccatgttggccaggctagtctcaaactcctgacctcaggtgatccgcccacctcggcctcccagagtgctgggattacaggcgtgtgccaccacgcctggccagaaccatgttgttttaaagatgtactttattcctcctgcctctcttaactcagtgttggactaggataaaacatcagaataaacaaggactaatgtcttctcctcccatacaccaccacagtgcctaggcatagacggtggatgtctcttagctcagcttttgttgccacagtttactgctcccccacatcatctagacacttagtttcatttttgttgtttcttgttatttcctattgttacaaactagtgttagaacacttgtttctcccaagagaaataaatagattttctcagattttctctctttttttgttagttcccagaaatgaatgctatgatcatgcgacggttcagtttgcctggagatgtagacagagctcgacagtatgtactacaggtaagactgtttttttaaaaaaaaggcagcagcaggaacaacgtggcaaaatcctttaatccaaaaatgtaacattaactaaacattaaattatagatacaagactgtttggtcaactcttgatgtgacaaaaactgagaagggaaaactcatttttctgattttttattttcatttctcttctagactacttacgaaatgttttgttttaactggtcttaggtaaggcacagacattaatatcttttaaaaggtacctaagtgattgtggtgaactgttagtgttgaaacccagtggtgtggaaccagccttccctgtgtccatcaacagaatcactgggcccccagtcacccagcctcggctccagcctcatccatgtccccatccatgaccccatccgggctgctgctggactgctgcaatagtctactcataattgggctttcctagtccatcctacctgttataaaagtgtgactaaagaaatgatcattgaaaacaataaaccaacacaggcaaactatacatttatataaatgtttttcttttaaagggagaaccatttaaccccattcaggggctagtggcttgctttaaatatattgccacgtatcttcagaacttttctgtggaagccagatctctctgcatgacttgagttttggtgactgactcctgtgagaatgagccatttccaagttcactgtcatttgcagccaacagatctactggatgagtcggagtgagcaaaaaatcattacaaagcaagtgtggcatgagatctgtacttagtgtagtacctgaaagacttccaaataattaccttccagattcttaaaaaatttaaaaagcaaccccaacccctaaaaggttatttttctctcttaactgactatactgttaagccccattattcactacgggttactgccttttttggagaatggtttaaacgtactattaaaaactatggcagggagctggagctgataaagaagtcaatattccctgggagaggttctggcttcagaaataatggtattattgaaagctagagtgggaagtggaactgaaaagagggaagttaatagtagcacctatggaaaatagcaaagttccagcaatcctagccagaaacacatttagaggaaacaaaaatccacgggaatgttctctgaacaaattctccaaaattctagctccctgttcacccacagagcttctaggcctattccctcattaaatatgaatagacaactcagggttacaaataagttgactaaagcttgctgaacaaaagagtgggaccaaaataacagggggaaaaaaaaacaggaaaaacgtaaataggaggatccaaaaagataccacattcacaaaacagtacaggatcatactttttaaatgagtaagagcaagttctaagaaactgaaaatgactgaagaacaaactccaaagaagggctgcaatgtgaaattgtggaaatcctcccaagtgtaaaacagaaagggggaaatagtgaaaaataacaagagctacaaggaccagtaccatcatgtaacaagtatttcaggaagaaaataaacaaaaaagtggtcacttatgctagaaaatggtgtcaaaactggctcaatgaatagcaaagatactggatactagaaggcagtggaggaaggtcttccaagtgaggatgaaacattttaaacctaggatccattaaatccgaaggcaaaagaaagtcaccacacatcaggactaaaatgttgacttcccataaacactattttattttatttttattttattattttattttattgtatttttcttagactgagtcttgctctgttgccaggctcaagttgcagtggcacaatcttggctcactgcaacctccgcctcccgggttcaagtgattctcctgcctcagcctcccgagtagctgggactacaggcacccgccaccacgcccggctgatttttgtatttttagtggagacggggtttcaccatgttggccattatggtctcgatcttgacgtcgtgatccgcccgcctcggcctcccaaagtgctgggaatacagggcgtgagccaccgcgctcagtccccatgaacactttctgggtaggttatttgcagatgtacttcaggaaaacgtgtggaaaacactgagagaaggcaggcttctgtacaaaaaggaacagcaaactaaaatatgtcatgttttgagcaactggtatagaaaatcagatgtatttcaaccacaatgttaggaatattccatttctaaatgtcagaggggtccgggcgcagtggctcacacctgtaatcgcagcattttgggaggccaaggtgggtggatcacttgaggtcaggagtttgagaccagcctggccaacatggtgaaaccccgtctctactaaaaatacaaacattagccgggcgtggtagtgcacgcctataatcctagctacttaggaggctgaggcacgagaatcccttgagcctgggaggcagaggttgcagtgagccaagatcacgccactgcattccagcctgggcgacagagcaagattccatctcaaaaaaaatttaaaaaaaataaataaatgtcagagggatcatgagccatggagaaggaaatagaattatagtatatgacttgattctgcaataaatatttttacatcatagaaatgatactttattagtatttggcttttagaaagaaccaatattttaaaacatggttatagaataggatgtaaatatctatagtctaacaaacagtatagttaaaggaaaggacaagagctcatagaagataaaatctgaagttgatgctacctaacagaagtaatcaacaaaacaactaaagacagcagtgtgatgatgaggcggcacattgtgggtgggctaaaccctcatcttaacaaaaaggtaacaggtaataactaaaattggtaatcaagaaataaaaactaggctgggcacggtggctcacacctgtaatcccagcactttgggaggccaaggcaggcagatcacttgaggccaggagttcgagaccagcctggccaacatgacaaaaccccatctctactaaaaatacaaaaattagccgggcatggtggcacgcgcctgtagtcccagctacttgggaggctgaggcaggacaatcgcttgagcccgggaggtgaaggttgcagtgagccaagatcatgtcatgcactctagcttgggtgacagagtgagaccctgtctcaaaaaaaaagaaaaaagaaaaaaaaaactattggataaagtgagtgcctttggaagaaaggaagctgattttcatcataaaccctctgtactttcattttgttatgtctttattctttattttttaagtaagttttacttgtgttttttttacatttaaaaatgttgtataaagatactttgtacatagaacttctgagaaattctaataagtaaaaattaggggaaaacgaatgactatgtaatattgatgagctagttgctttgcatgctaatagaataaaaatttgcttcaatatgagaaaaaggcctaaaggaagttagcactatgagtcgggaaaagaacattagagatgtagtttgactgttaactgtaatcctcagctcatctgatctcaaaactatgtgttcatttattatagcaggaagttaaaacgctgattcagtcagtgacaggcatctgttctgttttgttctgtatcttatagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattcaaatggtttgtcttgatttaccgtaggagtaaaggtcagaaaaatgtgaagtctgcattgaagtccacatgagttatattttaacagtatccaaaatttcatataggagaatggtttattataaaagactgtacataaaatttagacaacaggttatatacaaattaagagaacaatccacttgaaaaatggaaagtagaaggtagctagctgatcactaatgatactttgtttgtttaaaattaacaaaggcaaaatgcatatgaaatagtcacattgatttggtagcaataatggtctttaattttcagaaataactgttttgcactagtcttaccattcactatgctgttataagtctgtagcatccagtacataactgtaatttgaattccaaacaaatcctcaataacacagaaacccacacttgagtgctctactttaatatcctaagcaatagagaattatacacaagacaagaagagaaaacatccctcagccctcccttcaattaagaggagacacacaaagtgcatgtgttgcattttgattatgtcaaaagacaatccaagtctgttggttaggtaaatctctgttcactgattaatacatgacccaccttctttcccaattattttattttaaaattctaatgttgctagtgccaggtaatggattaaagagtgcctactcacaaatcaactgtatccacttttacaatatgtaaaaggtacttttaacttcctttcattgaaccagtgtacaacagttcactgtacaactgaaggactgacatggcaatccttaagaattttacctacagaatgaatgcacacaatttgacacattttcttagtttcaaaagattatttaaaaaaggaattcagtagattgacttgtaaataaccattgcagattttgaatctgcaaaaatccgtcacattgctgttgggacagattaagataaggctaaaatttttttccaagttaacatattgagaaaatagaatcataattctgcaataaatcattatcttttattttttttaaagcaaatcagtgaaggaaaggacaaaaacctttggttcacttatgtatttatgaatggaaaaagtttataatgcaaatttcactcattaaaaaacttaggtacaaattacaacattacagataattctctttttgcttgtttcacatggagaccttggagactcaattcacgttaagacacctaagtacgagtcctccaggtaaatattacacaaatgggaagcatcttgaatttttaagtatatttcaatacataaatttttatgcatgctttaaacaaacagtattttttttaaatgagagaatctaacaaaaaaagtctgaccagcaccagcatttaaattttctgattttaatattagtctgacatagcgttagtaaccatgctgcactgaaacatgtaatggtacaatctgaatcatgattcgttaaatattataccccacttcccccagaatatttaggctggtcataaagttaaaaatgtgtaagtaagtacataagcataatcagttatggacagcttcttgtataaattgctattcagcaatacataaactgcctcaaagatttatgcttacaggtagacattcaatttaccaataaaacagcatgttctgaaaatatgggcacattttaaaacatattaagacagttctgttaaccataatagtcccacagtatgactgagtaataagaatctacttcaaaagaaaaaaaaaaattaatcagtatagtgcatgattgattcaacatagttcccagggaacagaccagtcactcgattgcagactccttcataccagccatcatcattcttctttataacataaatgattgcaccctccataaatgacagctcatcatccttgtcttttgtataatcatatattgcaacaactatggaaaaaacagttgaaatatcacatgagtgcactatatccaaaatt

SEQ ID NO: 12740 - DNA, 201529 bp, Human
  misc_feature (1)...(201529): n = A,T,C or G
ctttactaaaaatacaaaaattagctggacgtggtggcatgtgcctgtaatcccagctaccagggaggctgaggcaggaaaattgcttgaactcgggaggtggaggttgcagtgagctgagattgtgctactgcatttcagcctgggtgacagagcgagacttcgtctcaaaaaaaaaaaaagattatatagttcttttactgtaggttttctgtttaggtacaaatacccttgtgttgcaaaattgcctacagtattagtacagtaacacactgtacaggtttgcagcctaggcgcaatagctatataccatatagccaaagcaagtagttggctagactacctaggtttgcgtaagaacacgctatgatgtgcgcaaaacaacaaaaatcgcttaatgacacgttcctcagaacatatccttgtggctaggtaaggcatgactgtattagaatgctgactgggtgcgtaagccgctagaaggagcacagcaaatttagggaggatgcaacatgttaaatccgagggaactggcagaggtgaaaaggggggaaaggagcataggaaagagttctgggaggaaaaatatagctgtagctaacattgtaccaggagaggtactacatacccggtcctatttaaagggcttcatatgtattgtcacatttaaatacgaactatctatcacatgtagtctcctcttgatgcacaggataagtaacatgcccgtggtctcctcaccagttagcaagcggatatccagccttggttatctgactctggcgcccttgcggttaaccaggacacacactaccttcccaggtgcagacatgagattggttttagatgatgactgaaatcaccggcctgggagacatttctcagtcagagaagtgacactgggaagaaaccctagaaataacgttgcaaacgagtaagtttgtgaaaacacactaatagttctatttcgaaatttctttgtcagattatttttggtgccggttactaaacgaagtgttcagtttcattgagcttaactgggttgaagttatctagacaaaagtaatccacatcaaaaccaggacgaattaagacgtaatttctgttttctggcactcttgcctcataaatctaggattcagggcattgttttcaatggttctcatttttggctccaaggattctttttcatgtgactaatattttcggtagaagaggaggtctggccacgccgcgggtcttggcgagcaggtgatcacggatccctggtgtttgctgggcgagacggtgaagcaacctcctccccgccccctcccccgtctagaaaggtgcaagatccgctaaaccgtgcgttgcacagcggcggccggagcagacgcgggatggtcgcgcgtcccctgcacagcacagaggggcagccggagagcctgggaaaggtacgagcggggaatcagagcacagggtgcggaccagaaagagcagacggtcagtcgggcggggaaggaagttgccgagttgcaggtgtggaaggggctgccccaggcccacccttggcagacgagggggcggggagtcgcgccggggacgaggagactgcggaccgggcgcgctccttgcgcagtcgctcgcccgcgtgcccaagccccccgggaatggccctcgcccaggggcccagctcgccgccgctagccccgcagagcctgcagctgctggggcccggcagccgccagggggcgggagctgcgtcgcgaacaatggccgcgcttggtcgcgggccggcgggaggcggagtggaggtagagccggtgccgggcgcgcgcgccggccgggcgtgctggggcgcgggagcggctgcgcaggcgggggcgcgcggcgcgagcgcgggagggcgcggcgggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaaggtaaataccctcatcgggggcgtccgggagaccccgacttccgcgccgccggcgaagaaggcagagggcgctggggagccctgcagttccgcagcacggggaacccggagaaaagcagcccccttcgcggcctcccctcccccgcgccttccctcccacatcgggctctcggggcagcagcggggaggggagaccggcgggggagggaggacagggaggcgaaggaattggggtggggggtgcgtgtgtggtggagggggtgggacgacacaggtgtcctgaggggaggagccgggaggaaggcgaggaggccgggccaagtgggggtgcggaggtcggggagacaggaacgcggctgcgggcgcgggaggctggggttctagggggccggggtggtagcggccggaagagaggacggcgagtgcagccacggtgtggctgcgagggagagggagcgcctagagtagggcaggggagggcggcccggggagggtctgcgggaaatgggcctgggggcgctggaggcggagcggcggggccggggcgcgccggagggtggcggcggcagctatttctgtagaatgggctagtggtaaagacgtaacttgccgaaatggggagggtaggtggggccgaggggacaaaatatatcctatgacaggcaagttctgctgtggctgttacgaactcctaccgtgatggctcggcttaaaggggtagttggcggtagtgaccttgccggggtgaagggagttgggcgaggagacaaagctcagttacggaatccgctgtgtgagagcaggaactctagtctcttcggggtcgagccgggggctgtggcttgggggctgggggtgctccgcagaggccattgagaagcacgccactctgggattcttagggaggcggtgggggtaatggccgtgggattctggaagtctttggaaatgtgtgtagaattttgcatttgtgaataattttctttggtaagggtccatatttgctgtgatgtccccttacccccatccccactccaaagggttaagaactgcttgagcagatagagagggaccattcaattagggtagacctgggaatttaccaaaggattttaaagtgggtggatcctgcagaaagaaaggctagagatgatcctttaaagatattttactgttaattgaaaacgttttttatttaatgtttgctttcacaattttggtgaacttttgctgagcattacttggcttctgatgcatcctgtgtttcagaccagcatcgtgaatacttgaaatcaaaattgtgatggacaggcagggtgatagtaaccttggaggagaaaagatttcaacatttctccaggatatttcttccccgtccttgctttctttagatgattcaagtacactgttgtgaactgagctgcggtggaaaaatcttatttaataaaactaccaaaaccaagacttactctccatctctgttttgtagtatggccagattttcattgttcagtttgtatcttactgcaaacaagagatatcacataacactttaattgtagattgctgcattttgcagcaggcctatattaaatttgcgaagcagttatgccaaactatctggtgtgtttgtgttttcctgctatggtttcaagtcaagtcactattgccatattttattatatggtaggctagtctgaaatttattcctaagtgatgataagttggtaggatatggtacatacttgctcacaaattactgcatttttccccataaaaaccagtgttttgtatttgtaagaatgttgctgtgtaatccaagtatgtattgttaatttcaaataaaatgctgtgtaatttttaaattttaactttatttggaaataatttcaagcttacagacaaatggcaagaataagaataatacaaagaaaatctttgtaacctttattcagattcacctgttaacattttatgtatttattatttgctctctatcacacacaaaatatttttcccctggaccatttaagggtaagttacatacattgtgatccttaactcctaaatacttgagcttggaaaaccatgcaaattttacattttagcttacttggcttgtctggaatgaagtgctaggaagagtggcttggtttgcttttcaacaaatagtatgaatataaaaaaaatctaagatagtcatcaagcttttaaatatacaaacaatccagaaatcgaggcagagcggttttcctgtttaggttctagaagatatggtaggttttttttttttttttcctttgtgcctacccttctctttattcctattattatcttgttttgtgcacgttcagtgctgggaatctgatcatttataggtacagatcataataaagagggaaaactctagatactgcaaaattgaattctcttagactgcatagtttgagacacgcacagtatgattattcacatatagatatatttgtgcctcttataggtacacaaaatactagatgtctagaatcagtaataattatcatttttatttatgtgtgcatcgtttgattttaaataatcctccccaagttctatataggagctttgccattatgttgtcctagaggtcaagcccttgactttgttccaggaaaaattataagaaggcaaatcttttatttttcaccaagctgatcatagaaaataaaaaaaattggccaggtggggtggctcatgcctgtaatcccagcactttgggaggccgaggcaggtggatcaggaggtcaggagttcgagaccagcctggccaacatggtgaaaccccgtctctactaaaaatacaaaaattagctgggtgtggtggtgcgcgcctgtaatcccagctactcgggaggctgaggcaggagaatcgcttgaacccgggaggcagaggttgcagtgagctgagatggcgccattgcactccagcctgggtgacagagtgagactcagtctcaaaaaaaaaaaaaaatgtccgggcatggtggctcatgcttgtaatcccagcactttgggaggccgaggtgggtgaatcacctgagggttgggggttcgagaccagcctgacgaacatggagaaaccccgtctctactaaaaatgtaaaattagccggccgtggtggcgcatgcctgtaatcgcagctactcaggaggctgaggcaggagaatcatttgaaaccaggaggcggatcttgcggtgagccgacatggtgcccattgcactccagcctgggcagcaagagtggaactccgtctcaaaaaaaaaaaaaaaaaaaaaaattaaaaagaaggcaagtcttttttaatttggtgtatagtgaagaaaagacgactttgggccagaatgaaccgttctaaacctagcaatgtgactgtaggcaaataacccaacctctagaaaaatggagataatgcctacatcccaagatgatgaggattaaatgagttgatgtaaaaatggcaaaatgtggcacctagcgtatacaattggtgtctgaaaaatgttagtttccttttttttttttctggcctgtgttatttagagttttccactagaatagtttgtggcgtaagacttctgttttccttacataaaagcagtgtttttgggtacccactttgaaaaatcaaaatgaaaaacattttaaaaagctctttaaaggaccgtatatcttttttagagtaataagcattgaattgatagttttgtagcagtttgtagtctaagagtagagatagtaaattttttttgcttttcatgttgtcaaataagacatttaagtgagaattgcctatcaactgtaggatgggtgctgatataaaaaatttatacatatttagtaacagtgccgttttataaagcagtttaattattggggattatatagatttctgtgcagcttttaatttctcagatgggcaaaatgtaattcataattaaagtacgacttatatcagcagtacattgcagttacaggttgggccattcttcatgagcatcacgtcttccccagccgtctccctataatcctgcttgttttcatttagtagtttggaatctagaattgcctgtcttcatatgcctgaccagatagggcatttttgggacgcatggatacatttctctaaaagcgcttagttgtaattggaatcaactgtagctggaaacttttgtgatagaggaggtggattttttttttaattatttttattttttgagatggagtcttactctgtcacccaggctagagtgcagtggcgcaatctccactcactgcagcctccgcctcctgggttcaagcgattcacctgcctcagcctcctgagtacctggactacaggtgcgtgcctccatgcctggctaatttttgtatttttagtagagacgattttgccgtgttcgccaggctagtctcgaactcctgacctcaggtgatccgtccgcctcagactccaaaagtgctgggattacaggcgtgagccaccacacccagctgaggaggtggattttatgaaaccaaaggtagtataaaactgctctgcattttattgatatgtcttgatattttagcaaattgtttaaaatatgtgacagtagactgggcgtgtctttaaagtagaaacagagtcttaaagacgtgccactgtgaacattctgaattgtccatggtataattacaaactacaatttttaaattgatgtaaatctaaaataactggtttgcttaaaaaagtataattttcagaatgttagccaattacagagtgctgttatagacattagtttcatgtgttttaatttctacagctctttatattgtaaagaaaaggcttacagaatatttaaatcgtatggttaattttatgttcataaagttttattttttgttacttcatggaatatcttttccgtgtcagaagactagaagtttcgggccgggcgtggtggctcacgcctgtaatcttggcactttgggaggccgaggcagatggatcacccgaggccaggagttcgagaccagcctggccaacatggtgaaaccccgtctctacaaaaaatacaaaaattagccaggcatggtggtgtgtacctgtatccccagctactggggagtactgaggcaggagaatcacttgagtcctggtaggtggaggttgcagtgagctgannnnnnnnnnnnnnnnnnnntaggtggaaggttgcagtgagctgagattgagctgttgcactccagtctgggtgacagggcaagactccgtctcaaaaaaaaagaaaaaaaaaaaggttagaactttcaaaaaggtaccccaatatcttactctgcttgcttcttggaatcagccaccagtgttatcagcctctaatattgaagaaatacatagagatctgtagataagcatttgtaactttagcaacgtatactaataaagacaaagtggagtttttcaaagttggtgaatgcttaataatgttaatttttttttttttgagacggagtcttgctctgtcgcccaggctggagtgcagtggcgcgatcttggctcactgcaagctccgcctcccgggttcacgccattctcctgcctcagcctcccgagtagctgggactacaggcgcctgccaccacgcccggctaatattttgtatttttagtagaggcggggtttcactgtgttagccaggatggtctcgatctcctgacctcatgatccgcccgcctctgcctcccaaagtgctgggattacaggcgtgagccactgcgcctggcctttttttttttttttttctgagatgaagtcttgctctgtcacctggactggagtgcagtggcatgatcttggctcactgcaaccttggcctcctgggttcaagcatttatttcttctgcctcagcctcccgagtagctgggattacaggcatgtgttactatgcccagctaatttttgtatttttagtagagacagggtttcaccatgttggccaggctggtcttgaactcctgacctcaggtgatccccccacctcggcctcccggagtgctgagttacaagcgtgagccactacacccgaccagtaatgataaattctagaaagcaagggacactaagtcactgagatgctttagtggttattcacactttactttttaaatgaactgttttcagttaaaaaaaaagatgattggttgtgtttgtattttaagttatagctagtgtatttttttaatgagatactccattcctattgaaagcgggtgtattttaacaccatgtgactaatgctacacttgtgaataatctcattttttgaattgaaaatataaatgtttaagttttataatttgccactttgaagttctaatgttactcatttgctcatgttgaacagggattttattttatttttttgcctatccaaatattaattaatacctaaagcaccatgggaatattgaattatagagttggacaggatagtcttatttattgttgcatagcacattgcaccagaatttaaggacttaagacaacaaacattatcttacagtttctgtgggttagaaatctgggtgcagcttagctgggtgcctgtggctcataaaagaggtggtagtcaagctgtcagttggggttgcagtcacatctggaagctctactggtggaagatctgtttctgaactcattcatgtggctcttgcagggttcagtttcctggggctcttggactgaagaaatcaattgttgctggctgttggccagaggcttttctcagttctttgccatatgggcctctccaaagggcaccacagtttggcatctgcctccctctgagcaaatgagtgagagaaggtgacacctaagaatttttataacctaatcttggaagtggtatctcattatttctgctatattctatttgttagaggctgcctaccacaaggactttagcttactttttaaagattgaagaaaaaaaagaagacagaaaaagaagaactcaaagatacacaaagtaatttgaaccaaggctcagaaggtaatctgaagaactttgactaaaactcaaattcaccaatatccaggccgtgtgctctttatacagcatcccgttctcataggaaatgtgacagtaattagaaaataaataaaaattgatgcagatgctgaggacactattgtaagaaaaatattaaagttttcaaagtcattttgaatggactctagtttgtcatcttgaaaaaatggtagccaaatatgggtgtgtgtttgtgtatgtatgtgtgtacttacaaaacgtttgcttccaggggaaagttcaatattaaaatttagcagcataacagtttctatacaggtgattagatataggccttttgctgtgtatcacaattgtgttgttgctttagataatttttaggggagaggtctgtatataatttatattttatataaactttttttcattacaagatcccatgatttatttatttgtaatttggactttcctgcccttcattggcatctgttttcaaattaaaattttttttttttttttttttgagatggagtctcgctctgtcgcctaggctggagtgcaatggcgcaatctcggctcactgcaacctctgcctcctgggttcaagcaattctcctgcctcagcctcctgagtagctgagattacaggcacgcgccaccatgcctggctaatttttgtatttttggtagaggcagggttttcaccatgttggccaggctggtcccgaactcctgaactcaaatgatccacccaccttggcctcccaaaatgctgggattaccacgcccagcctgaaattttaatatacatactatttttatactgatgataacagacaaaatgacagagaaaaagaaactattcagcaagataattgtactatatgctcttttccataccatctaagagaatacttgtggtgttgcatcttctttaggattaatttatcgtatagaagatgggaacaaagctgtttaaaacaggactgcaaaaagggaagtatacattaaatattaacctgaaactctcagatttatttttaacagcttcacttttgttgggattgtcttagaagtctagaagcagaaggagctttgttcagatctgtactgtccagtatggtggctactagtgacgtagttattcaagtgaacatgaaagaaaattaaatattattttcttgattgctctagccacatttcaagtgctcagtagccacatgtggctaatgacttccagattggacagtgcaagtacagaacatttttatcatcatagaaagttctatggagatctggataaattacattttatatttgattttgatcaagggcatgtgtttaaaataccagtcattgaggttatcagctaagttgaactttatttcttcattttcgttttccagtttttggagccgtgagggatacagcagtttggtcaatattgtcttaacatgcttcaaataaatcaggtgagtttgtgttaaggcatttttcatgcttacatggtgctttggctgtaaattgtggaacattttaactcagcttttcttttctataactgtaacctgactcatcactttttaaagcagttacctactgtatagtcatcattggaggctgtgtagggcaggttgtttaaggattagaatgatcttctgaaagttgataacttctggttgtgcaaggcagaaggtttgtctgttcttcttgatgtcacatccctttaggacttgttaatgtgttcagaatgcttatgatcatgatacagcttcagtaggtggcagttctgcagactcaaagcatttttagtgacaaatcttgtgaagtagttgtatctgttttttttttttttttaaagttcactttccagggcactgaaaaacactagaaggaagtgccctgataaactacagcatttaatactttagactcactgaaagaagtgcttttcttagttcttgacgtttctccaagaactttatacatttaattttacctttcccgatcaaatagaacattgtatcataactatagtgttagaaaatacttttggccaggctgggtggctcaaacctgtagtcccagcactttctgaggtgaggtgggaggatctcttgagcccaggagtttgagccagactgggtaacgtagtaagaccctgtctcttaaaaacaaaaaaaaaaaaaaggaaagaaacaaaatacttttatttcttttgattgcaaatcaacagagaagtaattaaactttttttcttttcccctgtgattaagaaagtaatcgactgggcacggtggctcacacctgtaatcccagcactttgggaggccaaggcgggcagatcacctgaggtcgggagtccgagaccagcctggccaacatggggaaaccccgtctctactaaaaaatacaaaattagccaggcatggtggtgcgtgcctgtaatcccagctactcgggaggctgaggcaggagaatcacttgaacccgggaggcggaggttgcggtgagccaagatcgtgccattgcactccaccctgggcaaaaagagtgagactgtctcaaaaaaaaaacaaaagtaatcttggccaggcgtggtcgctcacgcctgtaatcccagcactttgggagacgaaggcaggtagatcacctgagatcaggagatcaagaccagcatggccaacatggtgaaaccccatctttactaaaaatacaaaaaaatcagccagtcatggtggtgcacacctgtagtcccagctacttgggaggctgaggcagaagagttgcttgaacccagcagacggaggttgcagtgagctgagatcacaccactgcactccagcctgggctacagagcgagatgcgttccaaaaaaagaaagtaatcttgaccccctgccttccgacatatagtcctgctcaccttgccaaagaaatttccagttcctgtgcatcccatgccatctctaagctaatgacttctaagtttatacctggtctagaccttttttttctgagctccaaactcatgtagcatttaccaccttgatctcttggatgtctttatacatcttagacttaatgtgtgccctagaaataatctcagtgcttcagttttactggaccgtttcagttcctagattgggtaaggttgttctggctacagggatttgcacagatttcctctgctggacctctcttccccacccctgggtttggcttgcttgactgcagtcctgctatatgctgttatagcaccttgctctttagtttaataacatgacatttgtagttatagtcaaatatgtaattatttgttgtaacatctgtctcccttgttagacagtttgtttcatgaagacagtgacttttcttgtttactcttatatttccaggtcctagaataaacaatgtaaatagttttcatacatttatttgttgggtgtatgaatatatgaatggtgctagagttgtcactaaagcaaggagatatttatttttcaacaataaccacgtaattatgttgtcagttttggtgttatatgctgcttgtgttacacaaatgcaactaactctccctcatgtaaagttattatttagttttctcctgtactagaaacttccctagtgcaacaaaaattactttaatcaaaaacattactaataatttaaagaaatcgtagtgctgtcctgtgcttagtgcttcctgtttcctcacagctgctctcaaatcccagtggaagcattatgagaccttatttgcaaactgttatagctgtgaagttgccactaaataactttctatggatacctgccattaattatttggttacaattaaaataatttttcatcttctgccacagacatttggaaatgaccattttatgctagccaacttcattgaaaattatagtttatggattagtcctaatgaggatttactgactggctatgttgcaggtcatgttgaatcaggcattgcaaacagttcctaggcaattctctacatggccacaagcaattccctggatgttggctagaaatcgtacacagtgcctggagatatacatacttaaattgtacaggttgagtattccttatccaaaatgcttggcactggaagtgttttggatttcagatttttttagattttggaattttgcctacaggttgagcatccctaatccaaaaatcgaaaatccaaaatgctccaatgagcatttcctttgagcattatgttggtacaaaagaagtttgaaatcttggagattttggatttcagatttttggatttaggatgctcaatcttaacagaagtgtattcctagaacaatttaagagacccccccttcttgttactgactataactgtcatcccccaaactgttcaagtctgagatgaagactctcttcagctaaacatagagttgaattcttaaattcatgagtgatttttgaatcttactttctgggcaaccactttctcataacagtgagggttctcaaggtaaatgtgtaaaggggcccagtgtggtggcccatgcctgtaatcccagcactttgggaggctgaagcaggaggattgcttgagcccaggattttgagaccagcttgggcaacatagtaggaccctgtctctacaaaaaataaaaaaagttagatatggtgacacatgcctgtagtctcagctacttgggaggctggggtggaggatctcttgagcctgggaggttgaggctgcagtgaactgtgatcataccactgcactccagcctgggtaacagaatgagaccctaggcatgcaaaggggatttaagttgattctcagcttgaaagagttgagatttttactacgtgattttcaacgttgtctctaggattagtactacatttttatttgggaaggcttttgttttcttaaaatacctgaattagatgcttttttattttttattttttgagatggagtctcactctgttgcccatgctggagtgcagtggcatgatcttggctcactgcatcctccgccttccgaattcaagcaattcttctgtttcagcctcctgagtagctgggatcacaagcgcatgccaccacgcccggctaatttttgtattcttagtagagatggagtttcaccatgttggtcaggctggtctcgaacttctgacctcgtggtctgcctgccttggcctttcaaagtgctgggattacaggcgtgagccaccgtgcccggcctacatggttttttattcataacagattcttccatatgtgttactaaaactaattaaaaactaggctattgaatatcaggttatttgatattaactttgcctaactttattattatcatagaacatggatgttccatgttctgttaagataatagcacttttctgcctttaaattgtgatcatagttgttgtttttgccttttaagaatgtgtgttattatccatgtgcaacttatgcttactgtagaaaattaggtgtgataagcaaaaaaaaaaaaaaaacaaaccctgaaaaacaaacaaaaaaaatcacaaaaaattccacttctattacagagataatcactggtaacattttggggtgtatacttctagattttttttctatgcaggtatgtttttatgtgaatatatgttactttttaaaaactgggattatacaatatgtaatgttttgaagtgatttaataataattcttagtttggatgtactaaaatttaaccaagcccttattgttggacagatttttatattgtagttagtgccatagtaaattttttaaatgtatatctctttgtccaattattttcttagaattaattattagaaatggaaatactagtcaaagatgtatgtggattttaaagatatttggtgtatagctcccaaaaagacaaaattatatctgccagaagtgtatctacctgtttccttacttccttgacaaaatttcagtctttgcttatctgtctgacaaaaggtggtattttattttgtgtttctataatatttaaatattttttgttctttcgtgttttgccttttgtggattgcttatatgtgtctactgtcatctatttctttttatttgtaaataacattctttggattatgccctctgataattttctgagttagtatttataatcattactttatacttttcagtcattattcaacagataaccaacgggagtatactggtttctggggtaccataatatttaccagtatggtatattttggccctttctccctgatcattaattataggtcccccgggaaaaggaactcattttagcagtaagctacagcaaatataaattacgaagatacatgctgtgaataatatttttaaatgagtagctgaagtagggccaagttttggagattagctggtgaggtaggcttgacaggtcagtgtgtcctaaggaattggaaaagtctatattaggcggttgtagtattgggagagcctagcaactgggaatttacagggatcaaaataatctggtgattctttttagtgaggtttgatagtagatattgggaacatggtagctaagaggaagctttaaggcctaactgaagtggaagagatgacaggcaggacaagacagaatttttccgtgtcgaaggagtagcagaaccgtgtagggcaagagggagccaggtgttattaaaaaaaaaaaaaaagtttttattacactggatagtgtaagaccagagtatgactaccaagaaacaaagtctagagtgtaaggaataatgacagctatctcagaggtttgttgtgaggagtaattgagataacaaaggcaaaatgcttagcattggtgctggtactactgctattaattttactattaatattgctgttggctattgctgcctgactggaaattggtgggaaaggagggcagacggcagacatttaggtagatcattgagtgaagtatttgggggaatgaaccactttctcaagcccagattggcttcaaggtcctcctgcttcttgccacaagcaccaggaactctattcttttctcttaaaagttgctgctacttagtagtagttacttttctttccaagactgggtgtggagctctgtaatctgctcatgtctcttgtagccatagaatatagcctacagttaggggataagaaaaatagtaaacataaggaggttaaaaatgtgtaagaaagacttctactttcccctatgctggtataatgggaactggatttattttatatgtagccagcttccaagatggcccccaatgatcccggcatcccgatatttacaccatggtgtaatccccatacacactgtattgaggtttatctgtggaaccaatagaatgtaacagaagtgatggatcatttcttaggataggttatttataatacaaatgtggctccgcctccttcccctcactacccccaaccttggattactcactctgagaatagttagctgccatgttgtgaatggcccgatggggaggcccatgctgtgggaaactgaggcctcctgccaacagccaacaaggaactgaggcctctctagccaacagcatgtgaacgagccttcttggaagcagatgtctcagctttagtcaagcttccagtcctaaacatctgtcctgctgacatcttgactgcaacctcatgagagatcctgagccagaactacccatctaagctgttccctgattgccaaccctcagaaactgtgtgaaaaaaagaaatgcttgttttgtttgtttttaaattttttttagctttttttgagttgaagtcttggtctgtcacccaggctagagtgcagtggtacgatctcagctcactgcaacctctgtctcccaggttcaggtgattctcctgcctcagcctcctgagtagctgggactacagacgtgcaccaccgcacctggctaattttttgtatttttagtagagatggggtttcatcatgttgggcaggctggtctcaaattcctgacctcaggtgatcctcctgccttggcctcccaaagtgctggaattacaggcgtgagtcaccgtgcctggccaatgcttgatttttaaagccacaaaattggaggtaatttgttatgtagcaaaaatctactcttcctctttaaataacttgagaatttataaaatatataaacaatagcttttagacattgatgacaggcagcaccagactgtgatccctgagagaataggaacaagtgaaggtaaagcccttcaattgtaacagcttactgcagagcctagaggcagtttattggctgcagtgcaaggtgtggaggaaccaaaacagagcccagcagtcctactgagataaaaagacaaagataaaaatttgggaagatcaaggcgattagaattacagggcagagtaccagagaaaaaagagctaagggggttgggattggcgttggggaggcataaactaaaaagcaagagagcatgaacaagtgagcatgcattttggagatctccagagggttctcctggagtcttttgctgagttctgatttcgtagatgcttgacaggccctacctgaggccagagaagaaaacacttggaaagcactaagaaaaacaatttccagagttcacaataaggcttcaaatagtcgtgttcctactatgcagagtaaagtatgttgtagaatacatggggcactgggaagagtcctcagaaggctccaaatgattccaagtaacttaactgcaccagaacactatttagaggaatacaacaaaattcagaacccaacaatgtaaaatttagtttttgtcattcagtcaaaaaatgcttgctttgacgttagcaatggatagaacatctagacagaatatcagtaagggactagaggacctcaacaacagtattaatcaactagacctaacagacatatacagaacattcagcaacagcaaaatatgtattcttttttttttgtcttttttttttttttttttttgaaagacgtagtcttgctctgttacccagcccagagtgcaatgtctccatcttggctcaccgcaacctctgcctccggggttcaagtgattctcctgcctcagcctcctgagtagctaggattacaggtgtccaccaccacacccagctaatttttgtatttttagtagagacggggttttgccatgttggccagactggtctcagactcctgacctcaggtgatccaccctcctcggcctcccaaagtgcagggattataggcgtgagccactgcaccctgccaaaatatatattcttttaaagtatacatgaaacattctccaggctgtattaggccacaaaacaagtttcagtaaatttaaaaagattgaaatcatgctatgtatcttctccagtcacagtggaatgaagttagtaatcattaacagaaggaatactggaaaatttacaaatatatggaaatttacaaatatgtgggaattagagaatacttagaaataaattaaaatggaaacaatatatgtgacttaaatgatgcagtgaaaacagtcctgagagggaaattattagcaataaacatctacattaaagaataagaaaggcctcaaataaataatcttactttacattttaaagaaactagaaaatgcaaagctaccagaaaaaaggaagtaaataaagattagagtggagataaatgaaatagagaataggaaaataatatagagaattagtgaaaccaaaagtttgattctttgaaaagatcaatgaaattgacaaaccttttgctagactgacaaagaaaaaacacagataggtataactaaaactagacgtgagtgtggggacattactactgaccttaaacaaaaaggattaaagagaatactgtgagcaattttatgcacagattagataacctacatgaaatggacacagttttagaaatacgcattactaaaactgactcagaagaaacagaaaatataacagacttacaagtgaacagattgaattagttaaaaaacctcccaaactaagattacttgagcctgggaggttgagactgcagtgatccatgattatgccattgcactccaacctgggtgatagagtgagaccctatctcaaaacaaaacaaaaactcccaatcagaagtccagtaccatattgcttctctggtggattctaccaaatatttaaagaagaataccaaatatttaaatatttaaagagtatgagaatcgctctcaaactcttccaaaaaattggagaggagagagtaagaatacttcctaactcactctttgaggccagtattattaccctgataccaaagccaaacaaagacgtaatgcgaaaattacagaccaatattccttattaataaagatgcaaaaatcttcaacaaaatactagcaaactgaatctagcagcatatttaaaggaatatgcaccatggccaagtgggacttattcccaggattgcaagggtggtgtagtacaacacattaatagaatgaagcggggaaaacccccacgtgattgtttcaattgatacagtaggcagttgacaaaattcaacagctgttcttgatagaaaggctcaaaatcaggaatagtagggaactttttttttaaacatttcctcaacattcagcgtttatgaaaaaacccacagctaacatccaactcaatagtaaaagactgaaatccttgcccttatgatcaggaacaaggcacggatacccattctcaccagttattcaagttgtagtggaagttatagccagagcagtgtgacaagaaaaagaaacaaagacatacagatttggaaggaagaaataaaactgtctctgtttgcagatgacatggtcctatatatagaaaatcccaaagaatccagaaaaacctccactaaagctaataaataacttgagcaaagttgtaggtacaaggtaacacacaaaaagcatttgtgtttctgtgtactcggaatgaacaatacaaaaagaaattttaaaagattgcatttataatagcatccaaaagcctaaaggagttgacttgcttatgaaagacttgtgcactgtaaactataaaacatgttgaaataaagaagacctaaataagtggaaagacattttgtgttcatgaattggaagactttacattgccgttaggatggcaatactgtccaaagcaatctccagattcaatgcaatctctatcaaaattccattggcctttttttttttttttttgcaaaagttggaaagctgatcctcatattcatatggaattgcaacagatccaaatagccaaaaccatcttgaaaaaggaagaataaagccagaggactcatatttcccaattaagaaacttactgcaaagctacaatgatcaaaatagtgtggtactggcataaggatagatgtatagactaatagaattgagagtccagaattaatatatatgtaggcaattgatttttaacaaacatgccaggatgattcagtggggaaagaataatctcttcaaatggtttggggacccctggagatgcacatgcaaaacaataaagttggacccctacttcatgccatgtataaaaattaactcataatggaccaatggccaaaatacaagaacgaaaacttacaactcaacagcaaaaaaaagctcaactaaaaaatgggcaaaggacttggaatagacagttactctgagaagataaacacatcattaatactcaacatcattagtgatcagggagatgcaaatgaaaaccacagtaagataccacttctcacctactaggatggccagaatcaaaagacgggcagtaactggttttgaggacgatgtggagaaactggaaccctcgtatgttgctggtgggaatgttaaatggttcagcctctgtggaaaaaagagtttgacaattcctcaaaggaacacatagacttgtcatatgacccagcaattccactcctaggtatataccctgaagaattgaaagcaggtactcaaacaaatatatgaccacacatgttcatagcagcactatttgcaatagctaaatggtggaaacaacccaaatgtccatcagtggatgaatgagtaaacaaattgcagtagtctgtattccataaattgtctagcagtaaagaaatgaagtacagatacatgctacgatgcagatgaacctagaaaacatattaagtgaaagaagacacacacaaatggtcacatattgtatgattccatttatgtgaaatatccacaataggtaatctatgagacagaatgtagattgttgcttgccagggcctgggattaagggtgaatgagaagcaactgcctaatgggtgttgaattcccttttggggtcataacagtgttttggaactaggtataggtggtagttgtacaacactgtgagtggactaaataccactggaatattcagtttattttttatttatttatttttttgagatgtagtctccctctgtcgctcagtctggagtgcagtggtgtgatctcagctcactgcaacctctgcctcccgggttcaagggattctcctgcctcagcctcctcagtagctgggattacaggcacctgccgccacgcccagctaaattttgtatttttagtagagacggggtttcaccatgttggccaggctggtcttgaactcctgacctcaagtgatccacctgcctcggcctcccaaagtgctgggattacaggagtgagccaccgtgcccagccgaacgttcactttgaatggattaattagatattatgtcaattctacctcaataaaatattaaaatgcttacaaagaagaatgaaaatatgacccatagccaggatttaaacattttctgaaaagaaagagacccagaaatgataaagatggtttagcagacaaagatatagaaacagttcttactaatatgctctaaatgttcaagacacgaggggaaaacagaaagatgatgtggaaatacatagaaaatataaaaatagagatgaagaatgcagtatctgaaataaaatatatattggatgggattaatagcagataagacacacatcagtgggcttgaatagataacaatagtgactatccaaaatgaagcacagggtggaaggactaaagaaaaaaacagcatcagtgagctgtgggaaatatcgagtggcctaagacgtgtaattagaatcctaggagaagggaggggcaacagaaaatattataagaaataatgacttttatttattttttatttcaacagtttttgggaaacaggtggtgtttggttacatgaataagttctttagtggtgatttctgagactttggtgcacccatcacccaagcagtgtacactgtactcaatgtgtagtcttttatacctcataccactttcaccctttccccaagtccccaaagtccattgtatcattcttacacctttacatcctcacaaatttagctcccacttatgagtgagaatatatgacgtttggttttccattccagagttatttcagttagaataagtctccagttccatccaggttgctgcgaatgacattaagaaataatgactttaaacctctgttctctgtttagtagaaactataaacctgtagatgatggtaagaagtcaacctaaagtagaagaaatattaaaaaaaaaaaaaacctaaccacgcacatcataatcaaatagctgaaaattggtggtattgaaataaaaattttgttgttgttgttgttgagacaggtcttgagacaggtttcccaggctggagtgcagtggcacgatgatggctcactgcagcctcgacctcccaggctgaagcagtcctcccacctcagcctctcaagtagctgggattacaggcatgcaccactatatccggctaatttttatatattttgttgagaaggtgttttgccatgttgctcaggttggtctcccaactcctggactcaagtgattcacctgcctcggcctcccaaagggctgggattacaggcatgagccactatgctcagttaatttttttatttttagtagagatggggttttgccatgttggccaggctggtcttgaactcctgacctccagtgatccgcccaccttggcctcccaaagtgttgggattacaggtgtgagccaccatgcctggcccatttttaacttttaaaaagataattgactaaaacaaaaatactaacagtgccttgagggcttatacatagaaattaattgatgtcagtagcataaagaaagggataagggaaagggaagtatagaatttttaggtgctgatatcaaacatgaagtggaatgatatttgaaggtaggctgtgtatgttttagaacaattcctatacgacaaaataaaaatagtaagcctatgtaggatataaaatgggtactaaaaataatcagtctaaaagaagataaagttgaagaaaggaacaaataaaaggacaaaaacataacaaaacagtagatataaatctagtaatattgacaactatactaaatgtaaatgacttaaatgctcaatttaaatggcaaagattgtcagattgtatagaagagcaagactcaagtacagatgctccttgacttatgatggtgttaggtcctgataaacccattgtaagatgaaaatattgaaagtcaaaaatgtatttcatacacataattaactgggcatggtggctcatgcctgtatcccagcactttgggaggccaaggctggcagataatttgaacctaggagttcaagaccagcctggacaacatggtgaaaacccatctctacaaaaaatacaaaaattagctggatgtggtggtgtgcacctgtagtcctagctacttgggaggctgaagtgtgagggttgcttgagcccaggaggtcaaggctgcagtgagttatagtcttcattgcattctagtctgggtgacagagtgggaccttgactcagaaaaaaaaaaaatatatatatatatatatacacacacacacacacacacacacaacctactgaacatcatagcttagcctagcctaccttaaatgtgctcagaacacttaagttagactacagttgggcaaaatcatctaaatacaccctattttataataaagtgttaaatatctcattataatttattgaatgtgatactgaaagtgaaaaatagaatgcttatataggtacttcagtatggtttctactgagtgcatatcactttgtcactatggtaaagttgaatcataaggtgaaccatcgtaagtcagggacggtatatttatgatgtttacaagaaactcaaatagatacagatagattaaataagaaggacggatgcggacttttgcctctggtccatgtggtgtaacaaggatcgtgtttactgtcctcttgaaacaatcctacccctcttctccaaaaaaacaaaatatgtagaaacaacaatgattaagacattcaggtcttaatctcaagaatcaagtgattcttgagagagaagaaacaaacaaggtgagtcctacaattgccccaggcctactgcactgagagattttccaggatgtgacatagagagtagaaactgagatgtggagtctggcagactctgagttgagaagatgttgctgctctggagcgaactagtaaattataaaaacaagacttgaaaggaacaaactatttccaaattactcaactgtatgcctggacaaagtccaaaaagatttataggagtcatatagcaaggtaaaattaacaaggtatgtcattcagttaaagattaccatgtatgcaaagaagcatgaaatatgacccataattatgagaatcttccgtcaaaattgacacagaactgacacagatgatagaattagcagagggcattaaaacattataactgtattccatgtattcaaaaagttagagatacagaagagacaaaaagacccatatcagacttacagtgatgaaaactacaactgagatgaaaaatatacggtatgagattaatggtaaattagacattgcagaaaaaattatgaatgaacttgaaggcagagcaatagaaaccatccagaatgaagcatagagaaagaagaaaaaaaagtcagtgagctgtgggacacactcaagcagccaaatagatgaataattgtagttctcaagggacataatatacagaagaatatattttaagaaataatggccaaaaatgttttagacttaagccataaatctacagataaagaagttgaatgagttttaagtataagaaacataaaactacaccaaggtatagcaggtcctcaaataatgtttctttcaacatcattttgtcataatgttgatgagagaaaaagaattgattcctggctggggccagtattggtgtgatgttttcatgttcttcccatgtctgcatgggttttctttgggacttcagtttcctcccacattagggagatgtgagcattaggttaattggcttctctagattgttccagtatgagttagtctgttgtgtgtgtgtgtgtatgtgtgtgtgtgtgtgtgggtgtgtgggcacgcacgcactctagtgtggaatagcattctgtctaaggctggtttctgccttgtgccctgagcggctaggatacgctctgaccacctgtgaccctgaactagaaaaattgggtgaataattatcttacttgtttttattaatctttcttaagtgtatgtgtagctcacattcatttcattgtttaatattagaagtgttttggtattagaagttcggtgatgtttttgtaactagaaatacactgtaggaacttaacacttgtttatgtcgattggaccatggtaaattgggttctgttctactttgtttcacttgaagttgcagcttccaaggacctattgatgatgttaagtgaggacttactgtacattataatcaaattgttgaaagcaaatgataaagagaaaatctgaaaagcagtcagagaaagagatatggtcattttgtgtgtagaggaagaaagataaagatgattatcttaatagatttatcagaaacgatataagcaagcaaactggggaagcatctttaaagtactgaaagatgaaaaatgtcaatctataattctgtatctgacaaaaatatgtttctaaaataaagatgagataaagatgtttacaacacagaagcagaaagaatttattgctaacatttcccctctggaagaaaatttaaaagcaattcttcagacagcaggaaaatgataccagatgcaaatatggagttacatgaaagaaagaacactagaaatggtaactacttgggtaaatacatgagattttttttcttatcagttaaatctccttaaaagataagtgactgcttaaagcaaaaatattaacaagctgttgtggggtttataacttatctaaaagtaaaatgcatgataacaatagctaaaaggcagggagggagaaatggaggtatactgttataagattcttttgctctgtgtgaggtgataatatcactggaagatagactgtggtaagttaaaaatgtatactgtaaactctagcccctaaaatagcaaaatagagagttacaactaataagccaataaaaaggagataaaatggagtcacacaaaataattcaacagaagtccaaaaagaagaaaaaaggaacaaacaccaaatgggaaaaatataaaataaatagcaagatgatagaatcaaacctaaccatatgaatagtcacactaaatgtaaattgtctaaacactccagtttaaaggctgaatttgtcagattggatataaaagcaagatccaactatatgcttgcctacaagaaatagtttgtaaacaaacaggttaaaagtgaaagaatgggaaaagatataatatggtaacctagtcaaaagcaacttggagtggctatattaatattaaagtatatttgagagcaaggaatatttccagggataaagaaggtcatttcatttataatggtaaagaggtcagttaagaggacataatgatgttacatgtttatgcacctaataacagagcttcaaaacacatgaaacaaaacctgatagaaatgcaaggagaaattgagaaatccagtcataattggagattttagtaacccctgtcaataattgatagaagtggacagaaaatcatcaaagatatagtagacttgagtaactgttaagcaacttgacctaattgcatttatagaacactctacctaaaaagagtagaatacgtatttgttcacaagtttatccaaaacatttgcaacgataaactgtattttgggccataaagtacttttttttttttttttttttttttttttggaggtggggttttgctttgttcacgctgtagtgaagtggtaccaccatggctgactgcagccttgacctcctgggctcaaacaatcctcccatttctgctccccgagtatctaggactataaatgtgtgccgccacacccagctaatattctttttttttttttttttttgtagtgttgggatcttactgtgttgcccaggttggtctagaactcctgggttcaggtgatcctcctgcctctgcctcccaaactcctaggattgcatgcgtgagccatggtgcctggccatgaaacaagtcttaaatgaattcaaaaggattcaagtcattaaaaaattgtatctgattacagtggaattaggaatcattaacagaaagattcttgggaaatctctaaatatttggaaattaaaaaatataagtaatctatggtttaaaaagaaggaaaggtaaattagaaagtattttaaactaggccgggcgcggtggctcacgcctgtaatcccagcactttgggaggccgaggcgggtggatcatgaggtcaggagatcgagaccatcctggttaacaaggtgaaaccctgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcttgggcgacaaaacaaaactccgtttcaaaaaaaaaaaaaaaaaaaaaaaagaaagtattttaaactaaatgacaacagcaatacaacattaggagatattgctaaaacagtatttagggagaaatttatagctccaaatgtatatattttgaaagaagaatgaactcaaatagctcaaatatttgacttcagcttccatcttaaaagactagaaaaagaagaacaaattaatcccaaaggaagaagaagaaaatggataacctgaatagctttttttttgagacagggtctcactctgtcgcccaggctggagagcagtggtccgatgatagctcactgtggccttgacctcaagtgatcttcccacttcagcctcctagctgggacttcaggcacatgctaccatgcctggctaatttttttatttttaatgtttgtagagataaggtttcaccatgttgtactgactggtctccaactcctgggctcaagtgatcctcttgctttggcctgaagtggtagggttacagacatgagctatcatgcctagccctgagtagctttttatatgctaaagaaataaaaattgtagtaaaagtctacttaaaaagaaaactctaggtccggatagtttcactggtgaattatacaagttaaggaaaaaataatatcaattttatatgcttttaaaaatattgaagtggaaggaattttttacaaggctcatgatgccagcattactgggataccagaatcagacaaatacattttaaggaaattacagaccagtatgtctcataaatataattgcaaaaatctaaacaaagtttcagcaaatctaattcaacagtttattaaaaggataatatgtcataaccatgtggggtttatcccaggaatgtggggttggtttagtgttccaaaaaatcagtagtgtaatttaacatattaatgaactaaaaagcaaaaatcacatgatcatctcaatagatgcagaaaaatcatttgataaaatctaatattcagtatcataaagactctcagcaaactagaagtggaagtgaactttcccagcctgctaatgtgcttctatgaaaaaccttattagctgaccttgtacttattggtgaaaaactggacacctttttttttgagacagtctcgctctgttgcccaggctgaagtggcacgatctcggctcactgaaagctcccccttgtgagttcgtgccattctcctgcctcagcctctgtagtagctgggactacagacacccgccactatgtctggctaatttttttgtattttttagtagagacggggtttcaccaggttggccaagatggtctcgatctcctgaccttgtgatccacctgcctcggcctcccaaagtgctgggattacaggcgtgagccaccacacctggccaaaactggacacttattttaaaaaaagaagacgggatgtccactttaaccagttccgtttgacgttgccgtggaggttctagcccatgccatcatgcaagagaaggaaatgcatggtgttcagattggaaagaaatgaataaaactgtccttattcacagatgacctgattgtctatgtagaaaatctgatggaatcctactagaactaataaattactatagcagagttgcaggatagaagagcagtatgcaaaaaccaattgtgtttctatacattagcagagaacaatcataaatgaaaataaaagagtagcattttcaaaagcatcaaaaatatgaactacttagagataagtctaacaaaatatgttaaagaaaatgagaactacaaaatactgctgcaagaaattaaaggatacctgaataagatacagttgattctcattattcatggattctttacctaggaattggcttactcactaatttttatttgtaaccccaaaaccaatacttgcagtgcttttgtggtcattctcagacacttgcaggggcaaaacattttgaatcacccagtgcacatgtatatacccagctgggatcaaacaagacaatgctctgctttcttattttgggtttcatactgtaagcaagtagccctttcttggtttatttagtgctgcattttttgcatgtttgtgctttttgttggttattttgatgtttacaaagatggttattttgatgtttaaaatgtttaaagtgtaatgtttaagtgccatatagtgtttctaagtaccaggaggctctgatatgccttacggagaatatatgtgcattagataagctttattcaggcaggagttaaacagtactattggacatgagttcaatgttaatgaatcagtaacatatattagtaatacatactaaacaagaagtctctaaacagaaacacataaaacatgacatatgatcagttcacaaaaatgtcagcagaagcttgcaagaacctaatacgttagttcccctgggagcaatggctctataattgctgattcacataacagtcattgacatattattatctcaataatgagaagtgactgtgtatccttttcatgggttggaatactcaactttgttaaaatgttgattttcaccaaattatagatttaagagacttatatttcaatctttgcaggcttttttatagaactgcacagggtgattctaaaattcatgtggaaatttaaagaactttaaacaactgtgaaaaagaacagtgtgggagccaacactacctgatttcaagaattaaaagctgtaaaatagtttggcgtaaaaataggtaaataggcggcagaatcgcttgaacccaggaggtggaggttgcagtgagctgagatcgcgccactgcactccagcctgggcgacagagcgagactccgtctcaaaacaacaacaacaacaacaacaacaacaacaacaacaacaaaagacaaatagatcagtggaaacagaattggtagtccagaaataaactccttatatgtagataactaataattttgacaaagacataaaggcaatgtagtgggagaaatgtagccttttccacagttggaaacaattggatattgatatacaaaaaatggattcataccttgcgctgtataggaaaactaactcaaaatggcttctggacttaaatgtaaaacctaaaactataatgttcgtggaagaaaacaggagaaaaaaatttttagacctcagttaggtaataatttcttagatatacattaaaagtacaaactataaaaattgataaattagactattaaaatctgctctttaaaagacactggtaagagaataaagagaaaagccacagtttgggaaaaaaaattttatttttttcgtagtgattcctctttattattttctaagatgactgtccatttgctccaactttgttagcaattcatctttttcctactactttatttattttttttggagacagagtcttgctctgttccccaggctggagtgcagtggtaccttcttggctcactgcagcccctcacctcttgggctcaagtgattcttgtgcctcagcctcctgagtaggtgggatcacaggcgcacactaccgtgcccagctactttttgtatttttaatagaggcggggtaccatgttgcccagactggttttgaactcctgacctaaaacgatccacctgccttggcctcccaaagtactgggattacaggcgtgagccaccgcgcctggcctagaagaaaatctttaccaagcatatgtctaatcagtaacttgtatgtaggatgtgtaaagaactcttcaaattcagcaataagaaaaaaaaatcaaaagtaaaatattcagacacttcaccacaggagatacagatgacatataagcaaatgaaaaaagttaattaacagtattcattagggagatgcaaattaaaatcacgaggtatcattatacacatatttagaatgactgaagttaagaagactgaccaaactaaatactggtaaggacacactgtgtttttgtcctgtttaaatctctagatagcttcactggaaaagttggagatggaggcacaacatggcctgctttaaatcagatccttgagcattatttttctgtttttcaggaccatggtggcactgtcaagactagaaagaacttactctggccgggcgcagtggctcacgcctgtaatcccagcactttgggaggccgaggcgggtggatcacctggggtcaggagttcgagactggcctgtccaacatggagaaaacccgtctctactaaaaatacaaaaaattagctgggcggtggtggcgggccgcctgtagtccccagctcccttgggagggctgagcaggagaatggcgtgaacccggggagccggagcttgcagtgagccaagatcacaccactgcactcaagcctgggtgacagagcgagactcttgtctcaaaaaaaaaaaaaagaaaaaaaaattagctgggcatggtggcgcatgcctgtaatcccagctactcaggaggctgaggcagaagaatcgcttgagcttgggaggcggagcttgcagtgagccgagattgcgccactgcactgtagcctgggtgacagagtgagactccgtctcaaaaaaaaaagaagataaatatacgatcacacagtaagctgctgtaacttttgtcattcaccagtttgcaaagttttcccatgttgattcataagctctgtacctctttctcttttcaaagctgcatgattcatgtagtttaaccaatttttggtaaataataatatttatctcatttatagtttttgctattatagtcttgttttccagattatcattgcaaatgtcttcctgtagtatgaatcctcagattaataattgctgttttaaagataggtacaattgaaactttaatcaatgttgcccatcagaaattttgtactaatttgtatttgcaccaacagaattctcacccattttccccacatacttgttaatacttaaatgattattaaaaaaaatctttatcagtctaataggggaaaattatatatcactggaatttgaatttttctttctttctttcttttttttttttttttgacagtctcactctgttgcccaggctagagtgtagtggtgccatctcggttcactgcaacttccacctcccaggttcaagcgattctggtgcctcagcctcccgaatagctcggactacaggcatgtgccaccatgcctggctgatttttgtatttttaatagagacagggtttcaccatgttggccaggctttcaccatgttggccaggctctttaacattcttttgaacaggtatatttactcaagaaattatgtgaattgtgtgtaactttgcccttttttcctattggctttaaaaaaattgatttatagtatctttttattttatgaatgttaacagtttgtcttcacttttttttttttttttgagacggagtctcgctctgttgcttagggtggagtgcagtggtgcgatcttggttccacttgcaaccaccacctcccgggttcaagtgattctctcgcctcagcctcctgagtagctgggattacaggcacccgccatcatgcctggctaatttgtatatttttgtagagacggggtttcaccatgttggccaggctggtctggaactcctgacctcaggtgatctgcccgccttgacctcccaaagtgctgggattccagacgtgagccaccacgcctggcctttcttcacatattgcaagtatttcttctgtatacaaaaagtaactcaaaatggcttagactttagtgtcatatgtggtatgttttgctttagagaagttttattatttttatgttgttaactatcagtttttgcctttatggcttctaggttccttttcatatctaggaaggccttctgtgttacaggagtatgacagatatttagctaatttccgttagtttttgtgaaatttttgtattttgcattttaatatttctgaaatttatctttgtgtttatgtgagagaggaacttaaattttttcctaatggacagactgttaaaaatggagcagtttgatgcctgggtagtttgtcgataattttgcttggacagccttatgttagggtctaatttgaaaatagagggtttgttttagttaatagctggggacatatctgtcagattgctcctagaaggcaagagcccatgaaagggtcctttgctcttttgacttttttctttcttattttacttgggaattaggatgagttccctccaatagcagagaatagagaaaggggaaccagtaaagagacatagaaactgtgtttaaggccgggcgtggtggctcacgcctgtaatcccaccacttcgggaggctgaggtgggcggatcacctgaggtcgggagttcgagaccagcgtgaccaatatggagaaaccccgtctctactaaaaaaacaaaattagctgggcgtggtggtgcatgcctgtaattccagctactcgggaggctgaggcaggagaatcacctgaatccaggaggtggaggttgcagtgagccgagatcgcgcccttgcactacagcctgggcaacaagagtgaaactctgtctcaaaaaaaaaaggaaagaaaccgtgtttaagtcatttctgggaccaaggatggaaaggattctttggaatgatttgccttgcgaagcgaggtagtctgtgaccttagtagcaacagttctggctggaatatagctactttaaaaaatgctactttaagttctggtttaggaaacttttggtgttctagtgaattctggtcacatagttttattctgctgttttttctcatgcgttctgtattctgccagttttctgcttgcatttgccagaaagttatgttgttttatgtgctttctcctgtgtctatactccttgaaaagcttggactgtctctcacgttcccttgttacctaagtgaatttttgctttccttatctaatcaccacctcttaaaacttgcctttccatacaccctttgtctaaggagtttttgtaacagccttattatagtacttatattgtgatttattgtgtttgtctattgtctgtgtctgtttcttctatcagactgtgaactcctttggggacagatcattttgcctgtgagctacattattttgtagcttgttcagtgacttgaacacagttgctgtgtttcttcactggttcctacacatacaaatgaacaggcaaaatgaagattcaaattccagagtccaggacattttgtgaagacataaaaatagagtgaatctaaaaatagagtatatttatgtttttgttggatatgcaaatactgttattataaatatgtattttaccagtgtttcttatcaaagttgtaagttatatctaaccaagtttcgtatcagtgaaggtagaatatttcctagcacatgtaaacctttaatataatttatatcatatttgagaatttttcagtggaaacgaacttatgggtttataagtcagtggaaaaaataataacaaatacatgcttttcacagactactacagaaatatacttgttttttgttttgttttgttttgagagaggatctcactctgtcacccaggctggattgcagtctggaactcctgggctcaagcaatccttctatctcagccttctgagtgtcaaggagtacaggcatgtgccatgacatatggctaatatttttatttttttgtagagatgaggtctcgctatgttgtccaggctgttctcaaacccctggccttaagcgatcctcccgcctctgcctcccaatgtactgggattacagatgtgagccactatgcccagccaagaagtatatttgtatgagtaaaatcaatttatcgtaacagaatattttggctaagaatatttttacttagttttataaacttttttcatgactttttatgtcactgttttaatatttgatgatagtgtaattgttttaacaaatgtttaaatcagaataataatgaatttttaatcattgttaacagtgtttggtattatctcattcaatccatgcaattatctagtgagataagaacaactattatctctattttactttgtgggaaagtgagatttaagtactttctcaaggtcacacagatattagtaagtgacagagatatccaaaacaggctcttaaccatcatgtggcagttgttctttcaaagtggcagagtctgagattgtgaatccatttttattaattttatttacttctaagtaggtctctactattccagccaccaaatggacttgaagactatttcaaactatcttcagtgataacatctataggtctttgaaaatgcatacctgtgtaacattatgtgcatttctcacttttttgcactattgacttctctaaaaaagatttatataacttttttatgtgtctcagattttatagaccagtttgtttttatagatgctctatctaaattttggtgtaatttaaaagttattgctgtattactgagctctctgtcaagtaagaatcctattaagatttctcattaaataaaggaacaactatttgttttaatccctttttaaaataaaacaactatgactaattatttcctaagttatcaactttaaacattttgattttaattttgaagctttatcaaagtgggatcttggacccttctcacactaaaacttcagtcacccattaaaatgtgttattggattcatgttaacttttatgaagcaggaagtcagaattaatggaatataagttttataccatgttatttgttaacattttcctttagaggatttagattaggttttcataccaaacgggttcattataaatgaaccatttaaatcgctgtttaatatgtgtagaacctatgctattagcaattttcatagtataaaattttcacactatgtttgtatgcttctaatatgttttgcattgtaacagatgaatatgcagcattactgaattatgaaaattacacagtggtggtataaatgctatttgtgttatgcaaaattggctgatttttatcagactttaatattttctcattttaaccaattattctgcttttgctttttgatattaaattggctgtgctgtctgttgcacttgaattcatgcaatggtatgcaaaggccaaaactgattatcgtctcaggttaccttgtattttcttataacgactgactttccaaattgaacaggatgttttataaaatttgtgtgacatgcaatggaataggtaaaatgcaggttttctcaaaactgtcttgacttttgtcttttttgtacttttcccaaaagtaataattactagttttttttttttttttttttttttttgcaagccacttacaatggcttaattgtagaatctactgtcagctgtcttggccctacaattggttgcttagattccttctttttacttaggtcttaccaggtgcttacgtagttttcttataaaatagtttcttaatcataattatcacaatcaagccattgtacaaattattgggcctgttaagagtattagaaatgtaaaagaatattatttttaatattaaactttggcctaggaagtttgtagatgaagttcctaaagccagccattttcattcattttaagtattcttgtggctacaattgaactgtatttattgtgactatagtttaaatgagcaggaagtaatccacttgcatgttttatgcttagattttaaaatatattttggcattttttatgggaagtgaaagaaaaaagtaattaaatgtgtctataaatgagagaaaggaaaaatataggttaaaataatgtggtattagaaaaatattctgaagctataatagtaccttgtatttgcgatatagtttagaaaaccatatcatacatttacaactcttaatctcacaacaactttgggacttaagcgggatagatttatttctctcattttatagaaagaatagaaggcttagtgagtttaagtaaaatcattgagatcttgacagttagagaggacttcctaaacaagacgtaaaaagcacagaccataaaaggaaaagttggtaactataatacaaaaaaaaaaaaaaaaggatagaagcctgtaattcagctacttgggaggctgagtagggaaaatagcttgaacccagggttagagtccagcctgggcaacatagtgagactgtctctgaacaagaaaaaacccaaacaaacataaaatagtagtggagaaaaatatgcaaagaacaataatgggatactgtttgtcaaatatcaaattatcagaaattaaaatatttgattatattccatgtttttgagcttgaggagaaacggtaggggaaggtaatttggtacagtcattttgagagctatttgacagcatgctctctttaagagtgaagaattggaaacaacccagtgtctcagtagaggagtggataaaaaaactggtgcaatattgtaaaagaaattctatggtagttaaaattaatgtgctagatttatataagtaaaagtcttgagaacacaatgaagagtgaagaaagtaaactgtgagaatgtttattataatgctataataccatttatgtgagtctagaaccacatacatcaatactctgtaaaagataataaggaacttaacaggaatggaataccacttattttttttttaataagagttaaacatggaacatggttaataagcactgggtgttaggtacatgggcacttgttaaattattctttttacaactttgaaaatttatttaaaaaaacagaaaggggagttaatttgtttagagttaccgaaaaattgtagttggaagagctagtacttaaacttaggacctgattcccaagactagagctttttctaacacactgcctcataatgagaaggaaaaaaattgagatgaaacgatcaagaaggtagacaaaatttagtttcatagtaataagaaccaggaaacgtatgtgtttctagtaaattttttgaggggaaaggaaagtttttaagataaaaaattattataattttactttaaaatctttaagcatgctgttatatacatagaacaacttaggtacttaggaaaaattttaccttaatttattgtttaaaatgtgatacatatttctgttgcatgtaatggaagacattaggtaatttgaatttttaaaatacaaaattcatgaaaataatttaaatatacaatctaccttcaaagtcaaaactagtttttcttccattttgtaaagtcattcttcacaaaaactttatagcctttttatttacagcttctctccaagataaaatggcaaacccaaaagagaaaactgcaatgtgtctggtaaatgagttagcccgtttcaatagagtccaaccccagtataaacttctgaatgaaagagggcctgctcattcaaaggtaaggttatgaagagaggtggtgagacatacttatcagactaacagatttatcatctcagattttaatcgtgctttattttggggagtgggggttcagcagatggcttgaaggcttttagttctacattaataatatttcaaagtatgtaactaaactattttgtagctcactgtggtttacaaagctcttttagatatagtacttcatataaatcttaataaaaccacatgatatatggatttttgatttccattttgtaatttaaactcaggcacaggaaagttaagtgacttgcttaatagttcataagtgccagtgccagtacttgaatatattttctttggctcccaaatatggtgtgctttccattaaatcacagctgctaaagtagaaatggagacagagtaaatataccaacagttacctagtgagacatcttttccaatgtgatatttaattctaacattaatcatttataaaagttgtatataccactgttcttattatctctgcattcacttatattgtttttttaaatggaaagcaatttttatttatatatagctgtatacatttatgtttgcatatatacatgttacaaatctacaactaatgcatttatgtttgagctctattcagttgcttacaatatcttagttgtgcataattttctatggcacatttatatcttggctattggagattatcataatgatcataaaatttgtatataatgtggcagcatttgttctctaagggttgattaatcttcttaaagcaactggctattaggttatttgcatcctggcatctcctacaaactaaggaaaataagaggaaactacaatttgtcaattttgttttctattaatggtttttatgaaggatttaggggcaacaatttaatttgttcatatcttttgttcttgctttaacagaaaaaatagttgtagccttggtctacctttccagctatatgtcctgactctctttctgactcattctgcccttaatcatgttgaactgtttgcatttctcagaacgctttatgttcttttcacatctctctgcctttgcctaagttgtagtgtctttctgccttgaaggtgcttttgcccttactcattgttgagcactcagctccatgttacatcttccacacgtttgtgaaacctctgattcctctactgggcctccagtgggacctatagttctctgtggtagccgttactgtgttatagtacagtaatatatgttggtcattagttttgtgctagactgagcttgtttttgggtgtgtattttactcgtttacatttcttggtccctgtagtatatactctttgctcctcattgccaattccaggtattcttccttgagacaatcccccagttttgagtttcatattagcagacacacttcccacattccctcatgattgtcatttacatctgggtgatttcatcacatttcttatggctcactttcactctctttagcattccccattttaatttttggtgatttcaacacttaaatagatgattgttccagcatgttgaccttttagtttctttaacatctccggtgatcttgttctctactgtccttcagccactcatgcctataatcacattcttgaccttatcattaccaataactgcataatgttaatttcagtctttcatctttctgtgacacttgcctcttaactttctagttcattccgtctagtaatttgacttccacagtcctttcatactgcagatccattgattctgccaccattttactattcctttctttccccaatcctcacatagctctttaacctgcttaaatgttgtgtgccttttatgtaggtaccctcagctgacttgcccagctcctccattgtgtcctggatcccaacctgtttcacctcttcaaggccatttctccagttttgcttcttctgccttcttctcccaagagtgaagagctagactgcctttaacagttagtgacatcatccctatcctctatatatggtaaaggaaggtcagcctacctgggaagtttctggaggactcttaggaggatttggttttcattaagattctttaggaatccattgtaatttttggaagggtttatgaactgaccttttatctatctccttgtctcactgctggggttttaaaggctaaacaggttggttgtgatgaaagtagatgacagtgggtctcttcttatttctcaatagtcccaggattcccttggttttaaggagatttggagatcccttttgccaacctgtgccagttgctgtaggtgctttggtgatacaccaccccccttagcctgtagcttgcttatttttaaaaagagtactagaataattggcatgttgttgagtgaaacatgatattgataagttcacataataatatagttaatattaatcctaattggctaagtctggatcctttttgtgaaaagcaaaatcattttcattcatgtatgtctatcagtggcctttaggtgagacataaaatgtattttaatgaaattaatgataatctctggtaagaaaaatttaaacctagtttcaactcattaattttcttggggctgggcatggtgactcatgcctgtaatcccagaacttcaggaggccgaggcgggaggatcacttgaggtcaggagtttgagaacagcctggccaacatggtgaaacccttctctactaaaaatacaaaaattagccggggtgtggtggtgcgtgactataatcccacctactcgggaggctgaggcaggagaattgcttgaacctgggaggtagaggttgcagtgagccaagattgcaccactgcactccagtttgggctacagagtgagactcggtctcaaaaaaaaaattttttttcttggtacattaattatatggcaattcacacacatactacacatatgctgacataggtgagaagtggttctcaactttggctgttaattggaatcatttcaggagctttaaaaaatacttatgcctgagtctcatcccgttaatttaatcggtcttgggtgaagcacacacatcaggaattttttaaagctctgaaatgactcaaaagtacagccagagtttggaaacacaggacagaggttaatgtcttcagtatggtatggaattgtcttctcttatatcatgctgacaggtagtgacctatcttacgtttacatgatttcctccttcccccatgagtatcacaaattctgaacaacttgtaatatgtgactattaaaataataattattttagtctttgccttgtcttcttttatttttctgctcagtttttaattgaactctgaaacaagttagtataccttataataatgggagttattgtaatattagtttatttcctaggtacctgtatacagttattttttctacagattattgttttggtttgctcaaatctcgaaagaaggctgttttaattagaatatgaggaagagagccatgaataacataaaatggtattttcttcttttccattattttcctattctgataatttgttggtaagcctggctaagtttcaagtaaattgtactagtgctgatactttgagatggtttactttggaatgggtatcactgagggaggcaatgtcatccactggcccttaagccaagtagtctttaaaaaaaaatcttcgctagagttgcccagcttgatctttgcccttcattgccgagcttatgtgaccttgaacaactaatttaaagtctcagttttcttatctgtaaatggagtaatataatacctcataaagtggtataatggagtgacgatttataagttcttaagcattgtgttgatgatggaggtacccaaataattatatcattgcttattagtcatatataggactaaaacaaccccttagtaaaaggtctgttgagtatttactatgtggcaggcactgttcctgcactgaaaataaataaggtgcatatcatgctgttaggagttttgtctcataacattcattatgaaacccacaacatcttaagatcttacttttgcctgtaatcccagcactttgggaggccaaggtgggcagattatgagatcaggagattgagatcatcctggtcaaaatggcgaaaccctgtctctactaaaactacaaaaattagccaggcgtggtggcacgagcctttagtcccagctgctcgggaggctgaggcaggagaattgcttgaacctgggaggcggaggttgccgtgagctgagatcgcgccactgcactccagcctggcgacagagggagactccatctcaaaaaacaaacaaaaatcttacttttaatttattatgaaaaatttgaaatagataccaacgttgaatattttgccaagataaatttatttaccatcccctacccacttttttgaactaaagtttttaaaagaactatgtctgttcattcataagtgctttggtatgcatctgtaactgataaggacctttaaaaaaatagcgcactacaccgtcattatgactagattaagaagcccaaatattatgtaatacatggtctgtatccatcttttttttaattagacttagagatgtctttttacatttggtttgttcaaatagggtccaaacaaggatcatgtattacatttggtggctatgtctctttggtctcttttatttattaatactaacactccttttatccccatcccctcttttcctatgacattgatttgttggagaaatagagtaatttgtcctataaaatgttctacatcttgaatttggctgattgtatgtagtgattgttatatgaggggatttcatcagttgatgagtattgggctagagcagagattttgagctgtaggatgtgcctcttgaatacataattttcaggcatgatgaaatcatcattttctttctatgtacatttgcagtggaagtataggataagagagtgaggatagtggaagggaaatgtagtaaagagtcatgagagagaaaatactaaaaagatgggagaacattttttgaagcaatgcaaactgacttctttcataatttaacccatgccaaaagtattgtttctgctttatatctgtgtgggaaaaaaagaacaaacatttccagtgtcctacaacattttttcgttccttgtcgtaatcatctctctttgtacctgggaccccacacagctactaatctgctttctgtgactatagatgagtttgcagtttctaaaactatataaatgtaatcatatagtggtatgtactcctaccagactattttcacttagcatagttattttgagtttgctcatgttttgtgtgtgtcagtatttcttcctttttattattgaggagtagtccattatgtgtatatagcacactttgttttttggacattcatctgttgatggatattttggttgtttttagctttttgctattataataaagctaatttgaacatctatatacaagtcttcatatagacattgtattagtccattcttgtattgctataaatagttgagactggctaatttataagaaaagaggtttagttagctcatggttctgcaggctctacaggaagcatagcagcatctgcttttgggggggcctcaggatgcttccaatcatggtggaagtaaaaggcatgtcatatggtaaaagcaggagcaatgtggggattgggggggtcccacacacttttatatgaccagatctcatgataactcactattgtgaggacagtaccaagggatggcgctaaaccattcatgagaaatccacccccatgatccagtccccagaccccacctccaacattggggattacaatccaacatgaaatttgggtggggacacggatccaaaccatatcagacatatattaccttttctctttctctattttattttctctatttctttggtaataagagtgtcaggaatgtatagcaggtgcatgtttaactttttaagacattgccaaatttttttgcaaaatatagttgtaccattttacattcccctcagcggtgtatgagagttctagtttttctgcccccttgcctacaggttatatagtcagcctttctaattttagccattctaataggtatgtggtggaatctcattgtggtttcagtttgcacttccgtagtgactgataatgctggctatctttttgtgtgtttgtcatcagtgtatacctttagtgaagtgtctgttcagatctttgcccattattttttattgggtttgttttattgttcagttttgagaagttctttattctgttgtttggtgcatatgtttataattgttttatcttcttgatgaattaacccttttatcaataataatattctttgtctcttttttaattaaaaaattatttttaatttttgtgggtacatagtaggtatatatatttatgaggtatatatatttatgaagtacatgagatattttggtatacccaatgcatacaacgtatttggtatgttgcatgtaccaaaatatctatgtgaagaaaaagaacaaacatttccattgtcccacaaaattttctcattccttgttgtaatcatctctctttgtacctgagaccccaggcagctactaatctttttttcacatagattagacacgcaatgcataataatcacataatggaaattgggtatccaaagcctcaagcatttatcctttgtgttacgaacaatctacttatactcttttagttattttaaagtgtaaaattaaattattattgactgtagtccccctatgtgctgtcaaatactaggtcttatccattctttctaactaatttttttttggtacccattaaccatcttcccatcccctcaaccttcctgctacctttcccaatctctagtaaccatccttctattctctatctctgtgaattcaattgttttgatttttagacctcacaaataagtgacaacatgtgatgtttgtctctctgtacctggcttatttcacttaacatagtgacgtccagttctatccatgttattgcaaatgacaggatctcattcttttttatggctgaatagtactccattgtgtataaataccactctttatccattcatctattgatggacacttaggttgattcgaaatcttagctattgtaagcactcctaaaaaacatgggagtgtagatatcttttcaacatactgatttcttttcttttgggaatatacccagcagcgggattgctggattgcatggtagttctatttttagttttttgaggaacctccaaactgttctccatagtggttgtactaatttacattcttgctaacaacgtatgagggtacccttttctccacaaccttgccagcatttattattgcctgacttttggataaaagccattttaacttgagcaagatgatatctcagtgtagttttgatttgcatttctctgatgatcagtgatgttgagcaccttttcatatacctgtttgttgtttaaattggattattagatttttttcctatagagttatttgagcttcttatatattttgattattaataccttgtcagatggatagtttgcacatatttctctcccattctgtgggttgtttcttcactttgttgactgtttcctttgctgtgcagaaggtttttaacttgatgtgatcccatttgtccattgttgctttggttgcctctgcctgtggggtattactcaagaaatgtttgcccactccagcatcctgaaaattttccttaatgtcgtcttgtaatagtttcatagtttgaggtcttagatttaagcctttaatccattttgatttgattttttttgtgtatggcaagagataggggtctagtttcatttttctgcatatggatatctagctttcccagtaccatttattgaagagactgtcttttccccagtgtatgttcttgacactattgtcaaaaatgagttcatcgtaggtgtgtggatttgtttctggattctctcttctgttccattggtctgtgtgtttatttttatgtagtaccctgttgttttggtttctatagctctgtagtataatttgaagtcagataatgtggtccctccagttatgttctttttgctcaggatagctttggctattctggttcttttgtgattccatataaattttagaattgtttttcctatttctctgaagaatgtcattgatattttgatagggaatgcgttgagtctgtaggttgctttgattcttccaatttattttttcatgtcctcttcagtttctttcatcagtgttttatagttttcattgtagagatcgttcacttccttggttgagttaattcctaggtattaaattttatttaaggctattataaatgggattacttttttgatttctttttcagattgtttactgttggcatatagaaatgctactgatttagtatatttattttgtatcctgcaactttactaaatttgtttatctgttctaatagttttttgttggagtctttaggtttttttaaatataagatcatatcatctgcaaacaatgataatttgacttcttcttttccaatttggatgccctttctttctttctcttgcctgattgctctagctagtactttcagtattatgttgaataacagtggtgaaagtgggcatctttgttgtgttacagacctaagaggaaaggctttcagtttttccccattcattatgatactagttgtggatctgtcatatatggcttttattatgttcaggcatgttccttttatgcccagttatttgagggtttttatcacaaagtgatgttgaactttatcagatgcttttttggcaccaattgaaatgtatggtttttgtccttcattttgttgatgtgatgtatcacattgattggtttgtgtgtgttgagccatccttgcatcactgtgataaatcccacttggtcatgatgaatgatcttttaaatgtattgttggattaggtttgctagtattttgttgagggtttttgcatcaatattcatcagaggtattggtctgtaggtttttttttttttttttttgatgtgtgtttggtttttggtatcagggtaatactggcctcacagaatgagtttggaagcattccgtcctcctctatttttcagaatagtttgagtaggattggtattagttccactttaaatatttggtagaattcagcagtaaagctgttgggtcctggccttttctttactgggaagcttttcattactgctttgatctcctcacttgttattggtctgctcaggttttggatttcttccgggttcaatctttgtagggtgtatgtgtctaggaatttgtctgtttcttcaagatttttcaattttttggcatatagttgctcacggtagtcactaacgatcctttgaatttctgttgtatccattgtaatgtctcctttttcatctctggttttatttacttgggccttctttctttttttcttagtctggctaaatcgtttgtcaattttgtttatcttctcaaacaccaactttttgttctagtgatctcgtataattttttcatttcaaattcatttatttctgctctgatctttattatttcttttcttctactaattttgagtttagtttgctcttatttttctagttctttaaggtgcattgttagattgtttgtttgaaatttttccacttttttgatgtaggtgtgtgtagctataagcctccctctgagtactgcttttgctgtatcccataggctttggtttaccattcgtttcaaggaatttttcaattcccttcttaatttcttcattgaaatggtcattcaggagcatattgtttaattctcatgtgtttgtgtagtttccaaaattcctcttgttattgatttgtagttttattccattgtggtcagtgaagatgcttgatattattttaggttttctttcttttttctttttctctctctctctcttttttttttttttaatgttttaagactcgttttgtgacctaacatggtttatccttgagaatgatccatgtgtcgaggagaaaaatgtgtattctgcagccattggatgaaatgtgtaaatatctactagatccattttgtctatagtgcagaataactctgatgtttctttgttgattttctttctgggagatctgtgcaatgctgaaagcggggtgttgaagtctccagctgttattgtattggggtctgtctttctctttaggtctaataatatttgctttatgtatctgagtgctccagtgttggttgcatatatatttacaattattatatcctcttgctgaattgacccctttatcattatataatgaccttttttgtctctccttacagtttttgtcttgaaatctatactactttttctgatatgagtatagctgtgtctgctcttttttggtttccgttgccatggaatatgtttctccatccctctcttttctgtctgtgtgtgtcttcataggtggggtgtgtttagatcattggatcttgtttgtttctccattcagccactctatgtcttttgactggggaatttagttcatttacattcagtgttattattgctaaataggaactttctcctgccattttgttatttgttttctggtggttttcagtcttttcttccttctttcctttcttcctgtcttccttttagtgaaagtgattttctgtggtggtatgctttaatttcttgcattttatttttttgtgtatctgttgtatgttttttgatttgaggttactatgaggcttgcaaatactatcttttttaaattaattttcttttttttgagacagagtattgctctgtctctcaggctggagtacagtggcgtgatcttggctcactgcaatctctgcctcccaggttcaagcgattctcatgcctcagcctcccaagtagctgggattacatgtgtgcaccaccacacctggctaatttttgtatttttagtagagatggggtttcaccgtgatggcaaggctggtctcaaacttctgacctcaagcagtctacctgccttggcctcccaaagtactgggattacaagtgtgagccactgcgccggtgcaaatactaatacttataacgcattattttaaactgatgacagcttaacacaattgcagaaacaaacttgcaaaaagaaagttaattaaaactctacactttaactttgtccccgctgccagctttttaactttttgttgtttctctttatgtcttattacactatttcttgaaaagttgttgtagctattatttttgattggttcattatttagtctttctacttcagttaagagtagtttatacaccacaggtacagtgttatactcttctgtatttttctgtatgcttaccgttaccagtgcattttgtaccttcagatgatttcttctttcattaatatccttttctttcagattgaagaactcccttcaggatttcttgtagaacaagtctggtgttgatgaaatccttcggcttttgtttgtctgggaaagactttatctctccttcataattaaaggatattttcaccagatatactattctaggtgaaagtttttttccttcagcacttaaaatatgtcttgccacactctcctcacctttaaagtttccactgaaaagtctgctgccaattagctgggtatggtggtgcacgcctgtaatctcagctactcaggaggctgaggcaggataattgcctgaacctgggaggtggaggttgcagtgaggcaagatcgcatcactgcattccagcctgggtgacagagtgagactctgtttcaaaacaaaacaaaacaaaacaaaacaacaaaagtctgctgccagttgtattggagctctattgtatgttatttatttctttttttctggctgtttttaggatcctttctttatatttgaccttagggaattagattcttaaatgctttgaggtagtcatcattgggttaaatctgcttggtgttctataaccttcttgtatttgaatgttatctttctcgtttgggaaattctctgttattatccctttgaataaactttctactgttatctctttttctaccttttctttaaggccagtaagtcttacatttgcccctttgaggctattttctagatgtttttggtgtgcctcattgctttttaatttttttcttttgtcttttctaactgtgtaatttcaaatagcctgtcttcaagctcactaattcttcttaatcatttctgttgttaagagactttgatgtagtcctcatcatgtcagttgcatttttaaactctggaatatcagcttgattctttttaattttgatctcttggttaaatttatctgataagaattccaaattccctttctgtgttgtcttgaatttctttgagtttcctcaaaacagctattttgaattctctgcctgaaaggtcatgtatctctgtttttccaggattgatcccttgtgctttatattagttcatttggttaggtcatgttttcctgaatggtgtcgatggttgtagatacttgttggtgtctgggctttaaacagttaggtatttattgtagtcttcagagtctgagtttgtttatgcctgtccttgggaaggctttcccaggaatttgaagggacttgggccccaagcccaacaatgctgtggcttttggagacttgttagaggtacagccttggcagccttggataagatccggaagaattctcaggattaccaggcagagattgttgttctttttctttactttctcccaaacaaatggagtgctaagccacttggaattgggggtgtggtgatgcaggcacctctgtggtcatcatccctgggattgctctgggtcagacctgaagccagcacagcactggccttgcccaaggcccttcccttcagggtggcgggtttttccctgggttccaggtgtgtccagaggtgctgtctgagagccagggattggagtcaaaaaccttagcaatttacctgatgttttcttctattgtggctaagctggcactcaatccataatacaaaatccctcccactcttccctcccctttccacaggcagaggaacctctccttgtgtggccaccaacaccaccactggtccatgggctcattcttcagggcagtgggctccctgaagtagatccggaaatgctgtccagcgtaggtgtggactcagggaccccaagagcctgctttttgctcttcctgctgtggctgagctggtacctagggcacaagacaatgttccctttacttttctgtctgcttttcttaaacaggagtctttcacaatagccaccacagctgggaatgtgctgggtcacccctgaagccagtacatgtcagagcccagggcccactgcatactccttgggtatcagtggtgattattcaggacccattggttctttggtcagcaggtaatgaatcctgccaggattgagtccttaccttcaaggcagtgggttcctttctggcccagggtgtgtctacaaatgttatcttggagctagggcctggaatgggggcctcacggctctgcctggtgccttatcctatggtggcttagctgatatccaaaatgcaagacaaagttctcttttttcttcactctcctctccttaagcagaaggaagtagatactttcgttgctacaagttgcacttcctggggttaggggagggatggcataagcactcccttagccattccagctggtgtctccctaggttgcgtgccatcctagttcactggctctaagcccagcctcacactaggagttgcctaggaagcacagtctcgtgtcctagactgcctttcagatttatctaggaccccggagcacttcagcctgtggtggcaagtcttgccaagaaattcaagttccaactgctatgatgggcaattcccctccagctagtgctggtccaaatcctccctccctgtgcaggtgctggctgagtccagcacattttcattgtctgctgtgacagggcagcactgagtttaatgtactgttttccaatagccgtgctctcctccctcaaagtgtacagattttctctccacgccacatggctgctgctgggagtgtgggagagggttgatgttggtgattcaagactctcctaccctcctcaatgcctcttttggcaatatgaagttaaagccagacactgtgattgttcacctgatttttgtttcttgtaacggtgcttttttgtgtccatagttgttaaaatttggtgttccactgggggtgatgaatgatatataggcttttgttccaccatcttgctctaccctcctctgtaattttactctaccctcttctgtaactttacccaatgaacatactttgtgtgtggtctgaattctttgtatttattgagacttattttatggcccagaatatggtctgtcttggtaaatgtcctgtgaacaattgagagcaagtgtatattctgcttttcttggttggagtattctaacagtgttgataagattgtgttggctgatagtgttgttcaactgtactatattcttggtgattttttttgcttgttatatcagtttttgataaggagtattgaatctgactttaattgtcaattttatagtttaagttttgtcagtttttgcttcatttatttaagctgtgttattaggtgcctaaatgtttaggatatcaatgtcttcttaattgctttctttattcatatgaaatgaccttcgttaccactggtaatagtctttactctggaatccacttagtctgatattaatatagccattctaatttctccttgatttatgtcagtatatgtttttctcattactttaaaactatatgtgcttttatatttgaagtacagtttttgtaggtagcatgtagtttgattttgcatttttatctagtttgacaatctctgactttcaagtgggggtgtttacaccattttgttctaattttcacaactaaccatgtgttcttattagcctcatttcactaaagaggtaagaagctgagagttagaaagaataattaacttcccagtgttgtacatagtaaatggcgaagccaaggcttaaattcataaacagtgtgtctccagcattccgtcttaaaactactacactttttactgtagtaggaatcttaagagagattgtagaaaagcataggattgccttggaaatacttatattttacagaatgttcatgttgatggttttacagaatgttcatgtcgatggtggtaagaatggtagtttgaatgggaaggtcatattaagggaactgctttaagatagtaaaaagaaatttttttctatacttccaacacttttttttttttttttttgagacggagtctcactctttcgcccaggctggactgcagtggcgctgtcttggctcactgcaagctccacctcccgggttcacgccattctcctgcctcagcctcccgagtagctgggactacaggcacccgctaccacgcccggctaattttttttgtatttttagtagagatggggtttcaccgtgttagccaagatggtctcgatctcctgacctcgtgatccgcccgcctcggcctcccaaagtgctgggattacaggcgtgagccaccgcacccagcccacttttttttaaattaaaaaatttgtttccgagatagggtcttgctgtgttgcctaggctggagtgcagttgtgcagtcatagctcactgcagcgttcatctcctgggctcaagggatccccctgcttcagcttcctcagtagctgggactataggtgcgcaccaccatgcctggataattttttacatttgtggtagtgctgaggtctccctgtgttgcccaggctggtctcgaacttctgagctcaagtgatcctcccaccttggcctcccaaagtgctgggattccaggcataagccaccacacctggctgtaacacttcatttctgacactaaatatgtggggtttttttccacgccagcagaattctgcaattgtccccatacattgactggatgtcctacatatttaactaaattctgacactaactgcccacggttagtgcagaccctgcaggttaagggctcagtcccacaacactgctctcacctcacatgacagtcacaaatctgggtcttctaaacttgtgaccaactggctataaaccgggggctctcagcacctgttcaggagggnnnnnnnnnnnnnnnnnnnngctataaaccgggggctctcagcaccctcttctcaggttccataatttgttaaaacagctcacaagactcaggggaacacatactttatatttactagtttattataaaggatattctaaagtatataggtgaacagccagataaagagtacataggagggccggcgtggtggctcacgcctgtaatcccagcactttgggaggctgaggtgggtggatcacgaggtcaagagttcgagaccagcctggccaacatagtgaaaccccgtctctactaaaaatacaaaaattagcccggcatggtggcttgtgcctgtgatgccagctacttggggggctgaggtaggagaatcacttgaacttgggaggcggaggttgcaatgagacgagattgtgccatgcactccaaccttggcgacagagcaagactccatctccggggaaaaaaaaaaaaaagaagtacgtaggatgaagtgtgtgagaagggaaatggagcttccaagccctgtctgggtgtgccaccctgcagcacctcagtgtgttcaccagcctgcaagctttttgtaccctatcttttagggatatttatggaggctctgtcacataggcatgatcgattattaactcagtctccagcccctctttcctccgtggtggataggaatgggatggggctaaaaatgaagtttctaaccatggcttagtttttctggtgactggccctcagactagctctctatccaggggcctgccaagagttggctcattagaataaaaatttcctatcacccaggaaattccaaggaatttaagagctctgtgttagaaattgggatcaaagaccaaatattagaacaaaaatgctcctagttctcctgtccttccggaaattacaaggttttgggagctctgtgttaggaaccagggccggagaccaaatacatatttcttatataccacaggtggtgttgtggtagtttaggggagagatactgatattgtccgcatatcattggtgcatgtatatatcttagtataaagacattggtgcatgtatatatcttagtataaagagaggaggccaggtctgaaaaacatttaagttgagtcagtagttgttaattgcaagcaggagagaagggaagacctctcaaaggtgtctggctcatgagattgggaaaatggtgacatctggatgattaggaggcaggaaagattagagataggagctaaatgaagtatactgagtctgagtttatagaaaccttagaccaaggaggtgacaatataaattacaacgaagagttatgagatgttaaataagccttaggaaggcaaggataaacgaaactaatgaggtttgaacctgaactgttgggagataatggattaaacattttggggtatgaactgatttggagggggtagagtggaggaggcagtgttttgtttgaccttttacctcttgagtttgtggaaataccaagtagacagttagatttatgtgattgttgtttaggagaggtcaggtctggagacatgcagagtaaatttaatatgctttcctgatgcaatcaggaatctcaaggtcatttatgtgggtatttctgttttcaagcatatgagctatatgcaagattatgtatattatatatatcatgtgaaacctttgaactttcttactttgtggcaaagttctttgttaaataccaaaatttgaagaaaaagagctagtcattgaaaaatcattctgaaaccagagagagtattaaagatacattttaggtatatattttaaactgaattagaataaaagaaaatttaatcactttaaacaggtatgtttatgttgtgaatttcaaatgacaaatcccaattctctattttgattaattaaaaatctacagaaaaaatggaaagagtggtgtaatagacactcatgtatggtttagattcaccgatcgttaatttatttgccacattactttatttcttgctccctctatattgacatataatttttccttgaacaatttggaaagtaaatttcagctaccatgacacttcactcttaaatacttacatatctatcttgtaagactaaagacgttcttcataatcacaatactgttaatcacacaagaaatttaatcctggctaaacctattacttaatgtatagttcatagtcacatttccccagttgtcctctgaatgtcctttacagcttttttccccttcccattttagatataatgaaggatcatgcatggtatttatcatgtcttttcatgtctcttttcttttccttttttttttttttttttgagacagagtctcgctctgtcacccaggctggagtgcagtggcgcaatctcggctcactgcaagctccgcttcctgggttcatgccattctcctgcctcagcctcccgagtagctgggactacaggcacccgccaccacgtctggctaaattttttgtatttttagtagggatggggattcactgtgttagccaggatggtctcaatctcctgaccttgtgatccgcccatctcagcctcccaaagtgctgggattacaggcgtgagccactgtgcacggccttcatgtctctttagtgtcctccctgcattcttttttttttttttccttttatgacattgacatttttggagcctaggccatttgttttatagaatgtcccataatctagatctctctggttgtttccctgtgattagattcagattaaacatttttggccaagaattgtacatggttgttgatatatacttctcactggattgtatcagggggcacatgacgtcaatttgtatgattattggtgatgctaacttagtgaaggtattttctatctgatctcctttctacaataatatatatttttttgtaataagtaattttaagttaatacttagtattcctagaaagtaatatgcagtctggagtgaaaccaattatgcgcatatcatgtaacttgattctgaattttaaaggtgaagaataggtttgggggctcatatggaaatacagtgagaatggaattcagagcatgttagtggaaggatgtgtgtgagatgaggatgcacaggtagagcctttgtgccatgctaaaacaggaacagttgaagggttttaacctgatgttgattggggtgatgaagttggatttgtgttttagaaagatagttttagcagtgatcagctggaagaatattatgtccaagctaaagatgatgaaaggctggatccagttggcagagagaggaagaagatttgagaaatatttatgatgttaaaatggacagaatttagtgattggctcaatgtttgttgtggagattcagagttttttggtagtataatatttaatagaattgcctgactcattgcctagattgtgctaaatgtaacattcaaggaattagattttatgaaagtattatagacacatggtcttttggcttctcttacagtttctcttattatttctacttattctgcttttgtgaggaccatttgaatgacattaacattgtgattccatttagaggaaagattgcttcttgatttattctacccagaatgtacacctagatctgctactaagcttttggataggatagaacagaatttggtactctcttaaaatttcttcactaggtagagtaagattttgttgcagatgatctgtaggtaaggtcacctctagctctaaaattctgattctatgatgtttatttttctctcagacagccaattttatttcttggaaaagtcttaatgttttctttgtctatttatgtttttctaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggtatggcagtgactccttctgttatgttgtctgctatgtgtgttctgcttgttgtatgtttcatttatagtaggctagtaacagagtgagcaagtattaatagtacacatatgcccatacctacacacacacacacacacacacacacacacacacacacacggcagcataaaaataactgaaggaggcttggtgcgttggctcacgcctgtaatcccagcactttgggaggccgaggcgggtggatcatgttaggtaattagttcgagaccatcctggccaacatggtgaaaccctgtctctactaaaaatataaaaaattagccaggtgcctataatcccagctacccaggaggctgaggcgggagaattgcttgaatctgggagatggaggttgcagtgagccaagatcgcgccattgcactccagcctgggcaacaagagcgaaactccatctcaaaaaaaaaaaaaaaatgaaggtgagaggatgaagaaagtaattgtaattgtttttaaaatttgctttagtggatactataaaagtgcattgtttacttttttaatgttggcaaaaacatatttgaatacaaagcacagaaaatttgactgagttttttttttttaaagtaaagatagtaggccgggagcggtggctcacgcctgtcatcccagcactttgggaggccgaggcaggtggatcacgaggtcaggagattgagaccatcctggctaacacagtgaaaccctgtctctactaaaaaaatacaaaaaaattagctggacatggtggcgggtgcctgtagtcccagctactcaggaggccgaggcaggagaatggcgtgaacccgggaggcagaggttgcagtgagccaagatcgtgccactgcactccagcctgggcgacagagcgagactctgtctcaaaaaacaaacaaacaaaaatgatagtggcttggtgcagtggctcccacctgtaatcctagcactttgggaggcctgggtaagaggattgcttgaacccaagaatttgagagcagcctgggcaatatagcaagaccttgtttctacccctgcaaaaaaaaaattacaaaaaatgattaatttctctttttaaatatatagtttaaatatatagttatatatataaaaaactatattttatactattatataattatatatattttattttatatattatatatttatatattataaatatatatttatatttaaattaatttaaatataaatatattatttttataaatataaattataaatataaattatatttatattatataaattataaatataatttatatttataaatataaatataaattatatttataaatataaatataaattatatttataaatataaatataaatataaatttttataaatgtaaattaatagaaatataaattaatttatatttaaattaatttatatttaagtttatatttaaattaaaaaatttataatatattgtatatattatataattatacataattatataaatataatttatataaatttatataatatataaaactatatatttatatatagcctggccagcatggtgaaaccccgtctctactaaaaatacaaaaattggctgggcatggtggcgcgtgcctgtagtccccactacttaggaggttgaggcaggagaattgcttgaacctggcaggcggaggtttcagtgagccgagatcacgccactacactccagcctgggcgacagagcaagactctgtctcaaaagaaaaaaaaaaaagaaagaaaccccatcacaaattccgcaaaccacctgcatgtaaaatactgctaagtaaattactgttctaattttaagctcctaagaataattttaaagagttgttctaattgcatacaatacgaacaacattatatgtcattatctttttttttttatttcaatagtttttggggaacaggtggtattcggttacattgataaattcttccgtgatgatttctgagattttgttgcacccatcacccatgcagtgtatgctgtacccaatgtgtagtctttacccctcattcccctcccaaccttctcccagatccccaaaatccattgtttttttttttttttgaggtggagtctcgctctgtcaccaggctggagtgcagtggtgcaatctcggctcactgtaacctctgcctcccgggttcaagcaattcttctccctcagcctcccaagtagctgggactacaggcatgtgccaccacgcctgactaattttttgtatttttagtagagacggggtttcactgtgttagccaggatggtctcgatctcctgacctcatgatctgcccaccccggcctcccaaagtgctgggattacaggtgtgagccactgtgcctggcctaatttttttgtatttttagtagagacagggtttcaccatgttagccaggatggtctccatctcctgacttcgggatccatctgctttggcctcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaaatacaaaaataattagccgggcagtggcgggcccctgtagtcccagctacttgggaggctgaggcaggagaatggtgtgaacccgggaggcggaggttgcagtgagctgagatcgcaccactgcactccagcctggtgacagagcgaggctccatctcaaaaaaaaaaaaaagaaaaaaaaagtgtttcttttcaccacatccacgccaacatcctttatttttttatttttaaattatggccattcttgcaggagtaaggtggtgtgttagtctgttctcacactgctataaagaacttcctgattctgggtaatttatgaaggaaaggaggaagtttaattgactcacagttctatatggcttgagaggcctcaggaaacttacagtcatggttaaaggtgaatgggaggcaggcatcttcttcataaggtggcaagagagaaaaagactgaaggaggaacttgccaaacccttacaaaactatcagatcttgtgagaactcagtcactatcatgggaacagcaagggggaaaccgcccccatgattcaaattacctccactttgtctctcccttgacacatggagattatggggattacaattcaagatgagatttgggtggggacacagccaaaccatatcagttggtattgcattgtggttttgatttgcattactctgataattcatgatgttgaacattttttcatgtttgttggccatttgtatattttcttttgagaattatctattcgtgtccttagctgactttttgatggcattatttttttcttgctgatttgagttccttgtagattctggatattagtcctttgtcagatacatagtttgtgaagattttctcctactctatgggttgtgtgtttactttgctgattatttatttaactgtgcagaagctttttagtttaattaagtcccatctgtttatctttgtttttgttgcatttgcttttgggttcttggtcatgaagcctttgcctaagccaatgtctagaagagtttttccaatgttatcttctagaatttttatggtttcaggccttgatttaagtctttgatccatcttgagttaatttttatatcaagtgagagatgaggatccagtttcattcttctccatgtgacttgccaattatcccagcaccatttgttgaataggatgtcctttccccactttatattttttgtgtgctgtgatgaaaatcagtttgctctaagtattgggctttatttctgggttctctattctgtgccattggtctatgtgcctatttttatagcagtatcgtgctgttttggagactatagccttataatgtagtatgaagtcaggtaatgtgatgcctccagatttgctcattatgcttagtcttgctttagttatgtgggctcttttttggttccatatgaattttagcattgttttttctagtagtgtgaaaaatgatgatggtattttgatgcgaattgcatagaatttgtagattgcttttggcagtatgctatttccacaatattgattctgcccatccaagagtttgggatgtgcttccatttgtttgtatcctctatgatttctttcagcagtgttttgtagtttttgtcgtagagttctttccaccttcttcattaggtacattcctaagtatttcatttttttgcagctattgtgaaagggtttgagttcttgatttgattctcagcttggtcgctgttggtgtatagcagagctactgacttgtgtacgtttattttgtatcttgaaactttactgaattcatttatcagatctaggagctttttggttgagtctttagggttttctaggtatacgatcatatcatcagcaaacagcaacagtttgacttcctctttatcgatttggatgccctttatttctttctcttgtcgattgctccggctaggacttccagtactgtgttgaatagaagtggtgaaagtgggcatctttgtcttgttccagttctcagggggaatgctttcaacttgttccctgttcagtataacgttggctatgggtttgttatagatgcttttattaccttaaggtatgtcccttctatgccgattttgctgagggttttaatcatatagggatgctggattttgtaaaatgctttttctttgttgagatgtcatgtgatttttgtttttaattctgtttctgtggtgtatcacatttattgacttgtggacgttaaactatccctgcatccctggtatgaaacccacttgttcatggtgaattaccttttcgatacgctgttggattcagttagcttatattttgttgaggattttttgcatctatgttcatcagggatattggtctgtggctttctttttttgttatgtacttccctgtttttggtattagggtgataatggcttcattgaatgatttagggaggattccctctttctctgtcttttggaatagtgccaataggattaataccagttctttttttgaaagtctgttagaattcagctgtgaatccgtctggtcctgggctttttttattgttgttgtcagttttaaaattaccatttcagtcttgctgtggtcagttcagagtttctgtttcttcctggtttaacctagaagggttgtatatttccaggaatttatccagctcctctaggttttctagtttgtgtgtgtaaaggtgttcatagtagccttgaatgatattttgtatttctctggtatcagttgttatatctcctgtttgtttctaattgagcttatttggatcttctgtcttctttttttggttaatcttgctaatgttctatcaattttgtttatcttttcaaagaaccaactttttgttttatttatcttttgtatttcttttgtttcaatttcatttagttctgctctcatctttgttatttcttttcttctgctgggtttggtttgttcttgtttctctagttcttgaggtgtgaccctagattgtcttatttgtgctctttcagactttttcatgcaggcattcagtgctgtaaactttgctcttagcaccactttttctgtatcccagaggttttgataagttgtgtcactattatcattcagttcaaattcttaaatttccattttgatttcatcgttgacccaacaatcattcaggagcaggttatttaatttccatgtatttgcatgctttttgagtgttccttttgcagttgatgtccaattttatgccactgtggtctgagagagtagttgatataattttgattttcttaaatatactgtgacttgttttgtggcttatgtggtctgtcttggaatatgttccatgtgttgatgaatacaatgtgcattttgcagttgttgggtagaatgttctgtatatatctgttaaatccatttgttgtagggtatagtttaagtccattgtttttttgttgactttctgtcttaacgacctgtctagtgctgtcagtggaatattgaagtccctcactattattattttgccctctgtctcatttattaaggtctagtagtaattgttttataaattgggaactccagtgttaggtgcatttatatttaggattgtgatattttcctgttggactagtccgtttatcattatgtaatgtccctctttgtcatttttaactgttgttgctttaaagtctgttttatctgatgtaagaatagctactcctgctggcttttggtgtctgtttgcatgaaatatctctttctacccctttaccttcagtttatgtgagtccttatgtgttaggtgagtcccttgaaaacagcagatacttggttggtgaattcttatccattctgccattctgtatcttttaagtggagcatttaggccatttacattcaacattagtattaagatgtgaggtactattctatccattgtgctagttgttgccccaataccttttgtctgttttttctcattgtgttattgttttataggccctgtgagatttatgctttaaggaggttctgttttggtgtattctgaggctttgtttcaagatttaataattcattttattacttctttagtgctgacttgatagtggcaaattctctcagcatttgtttgcctgaaaaagacttttatctttccgtcattaatgaagcttagtttcactggacataaaattcttgactgataattattttatttaaggaggctaaagataggacctcaattccatctggcttgtagattttatgctgagaaatctgctatttatcggataggtttttctttataggttacctggtgcttttgcctcacagatcttaagattatttcctttgacttgactttagataacctgattgactgtgtgcctaggtgatgatctttttgcaatgaattccctgggtgttccttgaccttcttgtatttggatgtctagatctccagcaaggccaggaagttttccttgattattccctctaagttttccaaacttttagatttttcttcttcctcaggaacaccacttattcttaggtttggtcatttaacataatcccaaacttcttggaggctttgttcattttttaaaattctttttcctttgtctgtgtcagattgggttaatttgattaggccttgtctttgagctctgaagttctttcttctgcttgtttgattctattgttgaaactttgcagtatattttgcatgcctctaagtgtgtctttcattttcagaagttgtgactcttttttatttatgattctatttctctggaaattttttcatccatgtcttgtattattttaaaaatttctttaagttgcctttcacctttctctagtgcctccttgagctgcttaataaccgacctactgaattctttttctggtaattcagatatttcttcctggtttggatccatcgctggtgaactagtgtgatcttttgagggtgttatagaaccttgttttgtcatattaccagaattgtttttctggtttcttctcatttggatatactgtgtcagaggcaagatcttgaatctgctgttcagattcttttatcccacgggatgatcccttgatgtggttctctccccgtttccctatgaatggggcttcctgagagctgaactgcagcgatggttatttttcttctgggtctagctacccagtggagctactggactccaggctggtattggggagtgtctgcagaaaaagcatttgccctaggctagaagtcttcctgctaagaaagcaagcagggctttcaggccttgcccttccatgcctgcagtggcttctgttctcatatctgtactttccattggccccctattcccgccggccccctattcccacctcctcccccaccccccacccagattctgcccaggaaaatttgcattcagtcaaaattatgacagcgttcagctagaagtctttctcactgtggtacttccctagttccactgactgccttccccaaggaccactgtgagatgaaagtaaaaaaaaaaaaaaaaaaaaaaaaaaatggcttccctagggactgggagtgtctacaggggtctcttatcgctgctgcttctagtttttgtttttgtttttgttttgtttttttttttaggtggagtctcagtctgtcacccaggttggagtgcagtggcgttgatcttggcttactgcagcctccgcctcctgggctcaagcaattctcctgcctcagcctcccaagtagctgggattacaggtgtgcaccaccttgcccagctaattttttttttttttgtatttttagtagaaacagggtttcaccatattagccaggcttgtctcaaactgggctcaagcgatccactcaccttggcctcccaaagtgttgggattacaggcatgacccaccattcctggcctgcttcttctacttttatatttcgctcagctctctaaatttgtttcagtcctaggtaaggttaaattcttctgtgatctggattttcaggttccccagtgaggatgtgtgtttggaggcagactttccccctctcacactttgggcactcacggtgttttggctgtctcatggagtttgcagcggcaagctgcttctttcaaagggtctgtgaattctttcagttttcctggtatgttcttgtggtggttcttggagcagagtttacactgtgagtctccacatgctgttttgtcctgagtgggagcctcaagttagtcctgcctgatatccatcattttctccgggtgacctcagtgaatctatatgtcccgttatctattgggaaaggcaaacctgtattttggacatagtgtattaattgataacattaggttaatggaattactataactttagtaccagccatatatccatttactcattcatttgttaactgattaattcaagtggttaccttctagtcaatattaatttcgccttagatatttttgttatggaggttaagaaagattttgtgcctgtcaacaataactctaaaatgtatttaatcattctctacttggttatattcataatcaaatcacatagacacttgtttcattctcatgtggtctgtgctaggttgacattctctgctctttcaaggactactctgcagaatccatggctttctgattgcaagtctctgcttctgttcaactgattgcagtatttattaagcttaaataagccaaaatattattacaatagaaaaaaaacttattctcttcattttgaagttcctaaaagattgtccatttctttaatttttaaaagcctcttcagaatactggttgatcattagtagcataccaccaccatgatatatttaacacttgctttttacatatctaagagaaataaaacattgtccctttcagtgagtgtcttacagtcttatatatgaacacgtaatttgatggtaaagattaagtgccaagtagacaataacagccatcagtattacaggtaatgataaacatggactgaagtagttgaagtaagatacaggccttgaccgaaaagtaggcagttatagatgagaggaaagaatattttagccagagggaatactatgaggaaaggctttgaagtaggaatctggacaatggatttggtaaaaaaaaaattttatagatggtttttaattagagcaggtaaatgactagtaggaggtaagactggagatgtagttagtgagtgaattgggacgacttgaatgccagctttacgagattaagttttatacgtagctgggaggaattaatattcatgagcagtgcatgatgcatttaaaggagtattttaggaagctcagtttgacatgtaaagggaaggtgggagacactaaaaaaccattgtcatagtttatgggtgaagaaagaaagagactcacgtgcattgagtactgtatgcctcccgctctgcaggagtgttgagagtggcatttggaatggaacagaacaagctgtctaaggcatataatgtaaagcaaaggcatataatgtaaagcaagagcagttaattgtgtgctgagctctgggtcaagtccatatttagaggattatagcaggaagtaaaccagcaagagtcagaggaaggaaacaggagagtgtctgaaaggccccagtggagataagaatttccatggttgagtgttatagtaagctgagagaatgaatcgattatttggtgtaaacttttaaaataaagtctaatactgtatacagacaagggcacattacagttatagagcttgatgaatttttatgctgtgaacacttcaccacatgttttactagtgctatggaagcttccctcatgcccacttcagttggttaaacaactctaaaggaaaccaatattctgatttctaccagattagttgtgccttcttgttggaatcagacagtagactcttgtgatagctcatttttctcaatattgtgtgtgagagtcatctatgttgcatttaatggtatagtatttcattgctatgtagtattctattgcataagtatacataatttacatattattcattgtactattatacgtatttgaattgtttccagttttgagctattagaaataatactgctgtgaacagtattcttaaaatgcatacatttctcttgggaatatatctaggattggaactgttgggtcatagttatgaatgtatttggtattaatacataatgtcaaagaatgtcagtttaccttcccaccagcggtatgagagctgtccacatcctcatcaacatttgatatctccagctttcaaaattttagctattatgctgagaggtataatagtaattcattgtgtttttaatttgcatttctctaataacaaatgcaggtgagcatctttccatatgcctgttggcattaggctaggctctgttgtaaagtgctggttggaatgtttttcccacttaaaaatctgcattgtctgttttaaaattttttctactttttactggcttacagggttcttacatattctggattcatataatttatcagatatgtatattgcaaatatctttctatactcctaagggtacattttgatgaatagaaattcttttcaatgagaccaggtacggtagctcacacctgtaatcccagcactttgggaggccaaggtgggtggatcacttgaggtcaggagtttgagaccagcctggccaacatggtgaaaccccaactttactaaaaatacaaaaattagctgggcgtgatggtgtgcacctgtaatcccagctactcaggaggctgaagcaggagaatcgcttgaacctgggaggcggaggttgcaatgagctgagattgcaccactgcactctagcctgggtgagagcgagactccgtctcaaaaacaaaaaacaaaacaaaacaaaaacaaaattcttgtttagtggaagctaatttattagtcttttcctttatagttagcgcttttttggtgtgccatttaatacacctgtgtctcttacaagtttgtgaagataacctcatgttagttttagaagcagtattattagatctttacagtttagatctacagtctgtcaggaatcgagtttaatgtatgatgtgaggtagagttcaatatttttcttcatttaaaaaatatatggacattcatttaatccagcaccatttattgaaaagatagtccattcccctctgcagtgtagtggcacctttgttataaacctggtgactgtaactcagtattgagaagtaataggtctgtggaggaaagatccagtcttgactccacagtgtgtagatgggtcttaaaaagaagttatatcctaatgaggagttaagttcatttgcagcatggttgatctgttagtaattgggaatatattatagaactgttttgctttctcccttttatttttttttaaactatggaagtaatttcagatttatatacaatttgtggaaatagtacatagacttcccatgtatccttcacctttattccccattgatagcatttctgaaccatctgggaataagttgtagacatgatgtcccattaccccttaatatttcaatgtatatttcttaaggacacggacaccgttctatcgggaagttaactttgatccatattaccatttaatccacagactccatttcagatttcactaatcatcccaaacctttacagctccaggagctaatcaagaccatgtgttacatgtacttaacatttctcttcattccacttcaatctgtaacaaacagttcctcagtctttcttaccttttatgaccataatatttatgaagagtatgggaccacagagtttttagaatgcccctcaattgagtttgtctggtgtttcctcatgatttatgcattttagcatgaataccagaaaaatgacttggacttaccttagtgctttctatgaggagacgcctgagattgacttgtcccatcagtgacgacttttgtcatgcggtgaggagtatgccaggcttctttgctgtaaagttaattaatccgtatgttttgttgttgaatagtaagtaataagtattttctgaggagacattttgagcctgtgtgtgtgtgtgtgtgtgtgtgtgtgtgtgtgtatacatgtatgtcttatttgtgctctttcagactttttcatgcaggcattcagtgctgtaaactttgctcttagcaccactttttctgtatcccagaggttttgataagttgtgtcactattatcattcagttcaaattcttaaatttccattttgatttcatcgttgacccaacaatcattcaggagcaggttatttaatttccatgtatttgcatgctttttgagtgttccttttgcagttgatgtccaattttatgccactgtggtctgagagagtagttgatataattttgattttcttaaatatactgtgacttgttttgtggcttatgtggtctgtcttggaatatgttccatgtgttgatgaatacaatgtgcattttgcagttgttgggttatggcttttaggcctcttaagtggatacttaagctaggaaatacctagtacttttttttttccttaagagaaaatacatcatgaattcattgtgatattttcagttaggatttaagactatattttcagttaggatttcagttaggatttaaaactacagggttttaggtagtgtgtttgattttatatttgtgtctctttatgctaaaaacctttgtttctgacattaattctttagtctattttatgtatattttatatatatataaaataattttataatagcaattgcagtgagacagggacgccaatattactaacagcatgattactaaaaatagtttatgatttatttgcagggtttaaaaaaatctttagaatatgtggttatttgactatattttaaagttatttgaaataactgttcttcgtatgattagggccaccaatcaattaggttttaattgctttgttttctttatagagattactttgtctccatttttatttaattttgtttgacttaagtaaaagcatattacttgttactaacaatgtgattactgaaaacaatttaagatttttttttctctttaggatctcatggctattttacagttttttaagtcttttgaaataattctctttgtggttaagtcactgtagatagatttagttccagttttctttcgattttagagattgctcccccaccccttttggatgaaattttgatttctgtaattatgcaaaaaattcatgttttcaaaataaaatctatgaaacagtgtacattcagagacatacagcttccattcctaagtaagttttttttttttttttttagttttgggtttattctttaaaaaaagtaagcaaatatatatttatattttcattttcacctttcttagacaaaagataatataaagcacacactatttggtaccttgctttttttcgtttaacattataccctacactgctaaggtataacctccgaggtatattaagtaaaataaaagaagcaaggtgtgtagtagtcttcctccttttatagctgttcagtgttttatgctatggacatttatataactgatgctgcattgatggttgtttaggttgttttcagtcttttgtttttatcgataatgctacttgtacgtatctttaatatttgctaggaatatattcgatgacattttagtttcaggaaacattgcttatatttactctgttttgttggttatagaaaaaattcaaaaaacttttttcattagataagtccaagaaccactgatgactttcttgccaatgcttagttatttaattaccaaagtataaataaaaatattcacagatgatgtttttaatgattaaatacatgcaagctttctggggtaagtaatgatgaaatgcagtactttaaaaaataatattcacggttagcaatctaagaatcatctgtttactatgttttgatagtaatgattgcacactcagattttttgtcattaatgtacagaaaacattgcaaaatcccaagattttattaggaactattttcttggttttttactttgttttcgcagttccttagaaaatcatacaggtggtccatccattcttaccttcttccatggtatttaagcgttgtataaatatagcttgcatgtttaattgtgaagatatttcacttgtgtgcctttaatgttttttttttaaacaggcagtataactccaactgtggaactgaatgggcttgctatgaaaaggggagagcctgccatctacaggccattagatccaaagccattcccaaattatagagctaattacaactttcggggcatgtacaatcagaggtttgtatgtcttttttggttttgttcttaattattattttatccatgttataaaagtttctcacactcaaaagagtattttcattgtaaatctaattgaccttgggcattgtgcatggaatttagataaagcaggttcacaaggaatatttaaattaataacttaaagaaacccagttttcaggaactagtttttttttttttttcccctaccccacaaacgtaaaagatctgaaggaactagtttttattgtgtcatgagggccctgtatttgttgcagggaagaccaagtcttaaagtcatttcacagtttatagtgttgactttctcattcatttaccaagcagagctcagtttttttcttgatttgtctaaatacattagtgaacatgaatgtttgtaatttatagggaaaaaagaaaaaatgtaaataatgtaatcccagaatttgccaccttttatattttcatgtactttacattctttttttctttgcatttaaatatatttaaccaagttgaagttgtcctttatatgcagtttttgtagtactttatgaaggtatgatagacatacagtaaaatgtacaaatcttaagtatacctcttgatgactttattttatgtatgtatatatgtatttatactttatttgatgactttttacatacgtatagcctcacgtgatcaccactcagatcgagatacagaatgttcccatcacctctgagagtttcctcagacctctttgtctttgacacatccttctcccagaaataatcactattttattatcatagactagtttttgcctgttgttgaactttttatatctagactcatacagtatttatgtgcatctggcttcttttactttgtataatgattttcttgtttggggattcatccatgttgcttatatctgggttttgcccttttttattgctggttagtgtactttgtatggatatatcataatttgtgtatcttgtatatgcaaaacaagcactctcttttcacttaatatagtggccatttgtcatatatttaagaatttttttttcttttctttctttttttttgagacgcagtctcactctgtcacccaggctggagtacagtggtgtgatcttgtctcactgcacccacagcctcccgggttcaagtgattcttgtgtgtcagcctcctgagtagctgggattacaggcacctgccaccatgcctggctaatttttgtattttagtagagatggggtttcactatgttggccaggctgggggtcttgaacttctgaccttaagtgatctgtccgcctcggcctcccaaagtgctgggattacaggcgttagcccctgtgcctggcacaaaatgattttgatggctacataatgcttcatatggcttcataaggtatataaatgtatgtctatttttttatctaggttgtttatgcccccttttttgttaagattgctgcagtaaataatcactatgtaaatctttgttcacatcactgattatttccttccttatattactataaggggaatattctttaaaaagaataaagcattgcccaattgcactaaagtttgtactaatttcttacagtatatgagaatgcttattctattctgagaacactgagttaaaaaggtttttgtcttctttggtagttaaaaagtagtgttttttttgtttttttttgtttgtttgtttgttttttagatgaagtctcactctgtcacccaggttggagtgccatggtgtggtctcagctcactgcaccctccgcctcctgggttcaagcgatttccggctaatttttgtatttttagtagaaacagggttttaccatgttagcaaggctgatctcaaactcctgacctcaagttatccgcctctctcagcctctcaaagtgttaggattgcagacatgagccacctcacgtggccatcaagtagtagtttttaaaattcaattttattgattactagtgaggctgaacagttttttttttagatatttgttatcctttttgatttgtctattttaatttgctgatttttattccattgcttcaccagttttcaaatgtttatgtgttgaggatgttaaccttcagtctattttgtttgttgtaattttcctgctttaaaaaatttggcttttaattgtgtatttgtttttaatatcctgtagttttaaaattttatgtggtcttatctattgatttttctttatttctctcacttcttttatgcctgagaaattctttcctatatttgatcagatatttgctggtgcttttgttatggttttatgtatttactgataccataacttagatgtgtagggaagatatttatttagtccataaataatctgatactttttggtttcttgcttgctaggggaaaaattatctttaattgtatccatttaaaacttagttctattcaattgtaaatagttcctttaaatattattgtttaggttctctaagaagaatttgcacactgtattagacttctgcccttcccttttcctctcaggtatgcctgggggagctttctctatgctaggaagggagaggcatctatatacctcacctctgtagaggcatcttgtgttgtcctttagttcctcttttctttgtggtcgtgtgccttgtccacgaggtgtggaaacttgcagttggtggcatctagtccgtctttttctcccttaggtaatgcttccagagtgtatctactatcttccccttgctaatgggcctaaaccctcagcttttcttggcttccttggtatatttcattctctcctgtaacatctctgcttctaattgtgatgcatacaatggcaggcttcccagccctcagcttggtgtccacaccgcataggaggcacaagggacaacacatttctcttgtagttgttttattttctctttctctgtataatatacgcattgcctttatgtttaatctgacgttccccaatgtaaataaataaagctagttgcccacttcaacacagtagatatctttagtcacctgagtaaggaacacctagcctattatatactaattttattgctaatgtactctagtaaatagatttatgagagtattacatctttatatttgttttattttggtatctgtggtcctttattgaaattttgctacagttctgactagtgaatttattacttttaaatggaaataaactacttttattacttctaaatttattacttttaaaaagtctggtgctaaagcaatgaaaagtcagacactaatccctgtccttatggagctcatgttcttgtaggggaggtagtcagtcaataagaagtggttagtcactgagaaggttgcttttgataaagacctcaaaggaagagagagaaaaagcagtgtgaatgttgagagagagagagagagagagagagagagagagaattccaggctcaagaaatagcaagtactccccgcagtagaagtgtgcctggcattggcctcaagaggccaatgtggcttgatcagagtgaaccaagggagagaggagttagtatgtgaaattagacagggatcatgtgattttgattttctttttttcttttctaaattttctgttaagaatgtcggcattttttctttgttggcagtttctagttccaagatctaattcttatggttgttgtgaggggtacaataattttatttatgatttctccaaagtcataaataaaggatgtgccttaggccattccatgaatagataatatggacttttccttttttggagtgtctttattttatgatattctgcagatcacaaaaaggtaaaaagaatatcggaaagtactagtaagctaccaagccatgtttcaactgaaaagctctttctgctcacagaagcgcagacctaaccattactcagtaggctgttacaaccatgatttctcatatttattttaatttatagatggcaacacttgaatggattacagggactctggagccaaagatccaaggagatgtcttttccttgtcagaacccagattaatcattagcttcttaaggcagggaatgaaaggtgaagtccaagaaacaggtatcatttagagggatttttgaaaaggtccttttattttctacttaaagtaatattaagcaaaattaggtattacctatgctgttttaccaccctctactgatgatgtttctccacttgaacttattcaaaggcctaagaagaactgaatttttcttcttttttaatgatgagtggagaaaaaaacatttatccatgagcaaactctgtagatacaacttggattctgaagtacctgtctccttttattatgcccaagatgtttgacaataattacatccggttatgtatttttctttatcatttgaggcacttttcactaacagatatattatgaagcagaaagcatataaaaattcatttgacaaagtacaaggtaaagcttggagaacacttcgtgcttttgttctcccatctttcttataaaaattatgtacattagagaaatagaatggctgaatttagacagtttttcaattttgtatattcacagataaaaaaatattattgcttagcaaatggccaaaatggcagaccagcagaccaaatggccccttgatctgctggtgtagatttccatggggccaaaactcaaactaggttatgtgcaaatgggaatttttgagctatgtaactgggatatctcttggggagatgtacaggcatagttggatgtagggctttagtgttgttcttcctcattttctatttctctctttctagctcttgtttctttttttctctactttgttttcaaataagccaattcccatttgctatacttcatacactgtatagtctgtagacttgtagtgaagaaggtgaagttttttttttgatagtcattagaaaagtccccacaaacacttggagtaaactgtccatcctggaattaatcattcaaacttggttgggggtagggacatactttactttagccaagcctgggttatatgtccaacctggagaaacaggttagccccatccaaactactccgcagggtacaattattttatggagcggttcctcaaaagcaaagatttttagagaaaattatttccattacagtcagaacatttggttcagttcctagttctgatgcttttagttaagtgatcttgcacaaggctctggacctccattaatttcctcatttgcaaaacagagatagtaatagcaaatgaaggactttcgtgaggtcatcttcattcagcagacatttattgcatgcctactcattgccacatgttgtgtttgagtagagactttgaggaaagacaggcagtctaatagacttaagtttagtagaagaggaaaacgaaagaacagaatgatagatgtgccccgatggtgctatggaaacattaggaaggaactaagcaccccatccagattggggcaccaaagaagccttccaggagggatgaactgaatcttcaaggttaactaggatttagccaggtgaggagggcaaggaaaagtaatacagattttggcaacaaaggctaggaatcctgagaagtttagttcattcatggacttagaaacagttcggtaagtctggaatgagaagagtgaagtctaggcagggccccgatttgaatgtcctgaattgtccatgccacgaggtttggattttattctgaaggtgattgggagtcattgaaggattttaagctgagggataaaataattggatatatgttttaggaatattgctttggcaatattcctaaaacttgaagggataaagaattacgacaatgttgttgtaattcaggcataatgtgatgcaggcctggaatagtgcagatggagaggaggggacagtgtctatagatatttagaaggtagacttgattgcatttggggtattaaggataacttcagatatttggatggctagtaatactgttcaccacaagagtagttggagcaggtttttggaaagatgaagagtttaatttgcactatgttgcatttaaattgcctacgaagtatttaggagtcattttatcactctttatggccacaatgaagggtagcaaagattatctttgactttaaagacttgttggaagtagacgtggcaagaggtagtataacatctagagctttcagaataggtttgtgtaatatatcttaagaaaatggcagtttaggattcaacccaagtttgagtgacctatcagctctttgttcattgaaggtgtatcctttcttccccaaagggtttgtttatttgttaacactcagtttggaacaagtttatggcctacattctcattagatgtgtttagtatattttatgtcaaggttacctttagctaatgtatccagttcttggcccaatctcttatagctaggttggtcaagttattttcttttaatatatgttgagtcatagcaagttaaacaagaagaaaacaatttggactattttgcctgaatgttacttgtttctatggccagaattagacacttacttaaggcttcttggtttttcattgtacccctgtgaaataaatctgtgagacacggaaatcattttacagatagtgatggctatcagtggaaatttgatagggcgaaagaagttttttgaaacatccaaattgacttgattgcattatgttaattatcagtaaaattaataatagccaagattctgatttatgaaaacagcttgtttattacatttcagtttatgttatataggctgatgatttgttgctaagtattgtgatgttggtgtgctatttattctgaggttgttcaaactttgcatataagatttttcactcatttgtaacaccctcttaaaaagcatattggaaagtacaacagttgatgttgaatattcagttggcccctcgtatccctgggttctgtatccatgggctcagcattcatggatccagccaattgtggattgaaaatattcaggaaaaaaagggtggttgcatctgtattgaacatgtacagacatttttttcttgtcattatttcctaaacaacgcagtgtaactactattttcatagcatttacattgtattagatattataagtaatctagagatgacttaatgtatatgggaggatgtgcataggttatatgcaaatattaaaatattaatattttatatcagggacttgagcattttatatcaggggcttgagcagccatggattttggtatctgtagggggtaagggtgaaggtcctggaaacaattccccacagataacctagggatgactgtatttgtaccagcagtgatatgaacagttacaaacctacagttttggtttctgccaccagatggtgcttgtatactgatcaaacaacatacagactgggtgagctcactttggttactattccaaggccattaaattagaggttaaaccgtatgaaactgccaatatttgacgtttctttgacctacaaatatgtcagtttcatatgttcaacccaataggaaaaagtcatccaagtatacaacattaaattctcttggataaatgaagtaagcataaagtggtgaaaagcccaatttgtttcaatagatatagaactttgccttttgtatactacatcccttggtttggggaatatattcttttctcttttctcatatgctttacacatggaatgtgtgtcagaactcttaaactgattctacttcatgtagatatcactttatagaatagatgtagaactgaaagataggcagcaaggtaactttttaaatattttgttaaaaataatgttaaattattaacattaatgttaaattaggatttttttttatttgggagaaattaacctaaacccataacaaagacgcattagaaatgtctttttaaaactctcataaaccagagaagaaaatttgaacaagttaccaaagcaaggatgaggaagagtgaacttaagatcagtatcccccatggtcacagatataaaaattattattattattttttgagacagtcttgctctgttgcccaggctggagtatagtggcctgatcttggctcactgcaacttttgcttcccaggttcgagcgattctcatgcctcaatttcccgagtacctgggactacaggcgcatgccaccacacctggctaattttttgcatttttggtagagacagggtttcaacatgttgcccaggctggtcttgatctgcagacctcaagtgatctgcccacctcgtcctcccaaagtgctgggattacaggcatgagccaccatgcccagccagataaaaattcttaacaaaatatcagcaaattaaattcagccgaatttaaataacattatgattaaatgaagtttattctaggaaagcaagatgaatttagtattcagtaatcaaagtaattaacccaattaatagaataaaggagaacaaccatatcagtatctcattaggtgcagaaaaaacatttgacagaagtcagcgctcactaatgatatagactcagcaaactaggaatggaagagaactttcttaatctgataaagggcttcttcaaacaacctccagataacattatgctttatagtgaaagactgaatacttgtaagatcaggaacaaggcagtaatacacactgttatcacttctgttcaacattatacttaaggactggtacggtggctcatgcctgtaatcccagcactttgggaggtcgaggtgggcagattgcttgagcttaggagtttgaggccagcctgggaaacatgaccaaaccccatctctgttggcgtgtgcctctagtcccagctacttgggagactgaggtgggaggattgcctgggcctgggaagtcaaggcttcagtgagctgtgatcgccactgcattccagcctaggcaacgcagtgagaccccacctcaaaaaaacaacaaagaaccccacattatacttgagttctatcaagtgcaacaataagaagaaacaaatgggggaatattggaataggagatataaaactatcttcatagacaccatgattctgtatgtagaaaataataaatcaaaagtactgaaaagctactgaataagtgaatttagtaaggccacaagttgcaaggttagtatacaaaaatcagtggtatttctagtaaatagtaatgagcagttggggaattaaatagcgtgaaaacatattcagagataaatttaataaaataggtacacaacctgtataatgaaggctataaaatactgctcaaattaaagaagactctattatttaagatttcagttctctcaaagttgatgtgaagatgcaatgcagttgtaacaaaaatcatagtagagtttttttttttttggtaaaattaataaagtagtgctgacatttggagatgcaaaaaaacaatttggctactgcaaattgtttttgcagtagccaaagcaattttgaaaagaacaaaattggctggcccacactacctgacttcaagatttgctataaagctacaataatcaagacagcagaaaattaacatagggacagatatatggatcagtggaacagaataaaacagcagttggcaaactatagcccatgggtcacgtctggcttgcctgtttttgtatggcttgcaagctaagtaatgttttttacatttgcaagtggttggaaaaacatcaaaaataaaatgatattttacaacacatgacatttagatgaaattgaaattctagtgtgtgtcagtaaagtgtcattggaacacagccacagtcacttgcttatgtgttgtatatacttgcttatttatagtctgcttttgtgttacaacagcagagtcgaatagatgtgatagatcatatggcctgcaaagcccaaaatattttatattgggccctttacagaagtttgctgatctctggaatatggaggcaagaaatagatcaatccatatatgaacaatttaattctttcaaaattaattccagtgaaggtgctaatggggaaaggatactctttccaacaaataatagtaaaataattggcctttctgacagaaaaaaaaaagaacctgggctgggcgcggtggctcatgcctgtaatcccagcactttgggaggctgaggcaggtggattacctgaggtcaggagttcgagaccagcctgaccaacatggagaaaacctgtctctactaaaaatacaaaattagcctggcatggtggcgcatgcctgtaaccccagctactcaggaggctgaggcaggagaattgcttgaacccgggaggcagaggttgtggtgagctgagattgtgccattgcactccagcctggcaacaggagtgaaactctgtctcaaaaacaacaacaacaacaacaacaacaacaacaaaaacccctgaaccttgacttcacaccacagacaaaaataaatcagaaatgggtcatagacatatatgtaaaagttaaagtaaaatttccagaagaaaatactttgctactttggaaatagacaaagatttcttagaacacaaaaagcacggatcatgcaacaattgagaaattacatgtcatcaaaatttaaacatggatcatgaaaaaattgagaaattataagtcatcaaaatttaaacttctggtactagaaagacactttttacaaaatgaaaaagcaagacatatattagaaggaaacattcgtaatacatatatttgaaagaggacttcagaatatataaaggaatacctacaactcattaataaggcaaaaatggacaatatttttgaatagacaatagagataagaatggctaataaacacatgaaaagatgctcaaagtgattagtcatcagggaaatgcaaattaaaaccatagctaaagtttaaaaagactgacaacacctagtgtcatggtggggcaactggaagtctcatatattgctgctggggatataaaatggtacaggcaccttgtcagagtttatgatgttcttatgaagttaagcatgtagtacttatcttaccacccagcaattccatgtggtatttacctaagataaatgaaaatatatggccattcaaagacttatacatgaaagtttgtagcatttttctttataatagccccaaattggaaacaacccaaatatctaccactaggtaaatggttacactgtaatgtaaccatgacttggcatactattcaacagcaaaacttgtgattcatccaatgatatgcatgaatctcagaaacaatatgctgagcaaaagaagacaggacagatacatagtgtaggtactgtaagattctatttttgtggaattctagaataggcgaaactaatccgtagtgacagaaagaggttctttgattgtctagatttggggctgggaatttcctatacaaggaaagttttgggggtgatagaaatgttctgtattttcattttggtgattgttaatatgagtgtatgtcaaaattcatcaaactctgagcctaaaataggcacatttcattaaatgtaaattttacctcaataacattgatttaaaaaataacattttgtaatcctccattttctttgaggctaaaaatatttataagaaagcgccagatttttgcttctcaagcatttggccaaaaacattgtaaatgtttttctagaggttaaaataatatttaccttatagggtgtttgaggacagaatgataggctggttcagttgcttagcttctgcctttgtgcactgattgttattataattgttagcctttattgcattttagcttgtttagttacaagtacaaactctggagttggaatcatagttatgtggatttgagcaggttattcgacttctaattctcggttaattcacctgtaagttaggagaataaataacgcttccttacagtgttgttttcaggttttaataaagtaattcagtgaccatgcatgaccctttaccttactttactgtagtgttttgagttcctttaaaagaatctaaatatcagtgtatttgtactggacattgttactgtgggagatttaaaagaatttacatctgcttaattaaaaaaattaaatcaggctgtgattctgttattatttctgggtgtatgctttataggaggaatggctgattctctattgcatatggatatttttggcccgtgttaaaatttacttgaccctggaataatgttacccagagaatcatttctcccttagaaaactgcgcatatcaggagttattaagttaggatttaaacatgagctttggaaaatctgtggcctttgtgtaattatatgcagcattttatacacatacctcttctgccttgtctagcttgatagccattcaagctggtctttcagctttctcagcgttcattcccaaggaatatctggtctgttttcttgccacagagttagtattcaagtactaataacttggtaatacatttaccatgatagaacttcaggactccatgctcctttgttctgcttttagaggcagccaggcaggcccagggatcaccacttaatcttggtcctgagccggtgtctcgctctgtcacccaggctggagtgcaatgatgcgatctcagctcactgcagccttcgccttcgggttcaagtgattctcctgcctcagcctcctgagtagctgggattacaggcatgcaccaccatgcccagctaatttttgtgtttttagtagagacagggtttcaccatgttggtcaggctggtcttgaactcctgaccttgtgatccgcccacctcagcctcccaaagtgctgggattacaggatatgtcacacaagtttaacatttttcatatcccctttagacaaaaacaaaagcataagtaaacagagccaattcttaaattaaaaaatgtctataattttgggttgaccttagtctgattttcatttggtcacttttttttaatgctattgaaatcctttttgagttctttatgctaaaagtttaagcattattctctacaaaagtgaatataaacaaagtggcaacaaagaagataattaccgtaagtttttctcccctcaagtttgttgcgattatttaggaaagatatagccatgacttaaatctgattaatactgaattcgtaatgtttttacaacaaggggtctatctttctagtcctaaagttatttaaaaattttaacaacttttgtctagaaagggagaaataaatagcattctctattcttttatttgaggctagttttattaatctgttgctcaagctctgaaaaatacttggtttattttgtgtttgaagcaatgctctttcaccaatatctttatttttttgttcagttgagcaaaatcttgcttagcaatgtttatttacttgtgtttaaaaaaaaatctgggtacaatgacagtttaaattatgaagctcttctttttttgagacagagtttcgctcttgttgcccaggctggagtgcaatggcgcgatctcagctcactgcaacctccgcctcccgggttcaagcaattctcctgcctcagcctcctgagtagctgggacaacaggcatgtgccaccatgccaggctaattttgtgtttttagtagagacaggttttctccatgttggtcaggctggtctcgaactcccgacctcaggtgatctgcccgcctcagcctcccaaagtgctgggattacaggcatgagccaccaagctaggccatgaagctctttttaatatgtcatgtgacatataaatacgtgggctttcagtattcagaattctgaaaggtttatataggttgccagtcattgctctaaaaattccgaaaaacttttgaagcttttttttctgctttgttttggagggttcctttatgaatcaaaaaacgttatccaccagctgtttctccttaatgctcaatcactttttatgcattttcttcaaatactgattttcagtgaaggttttgtgaagttttagtgtccgttggatttagaaagcaatttaagtatggttggtttttttttttttgttgtttttgttgttgttgttgttgttttttgagacggagtttctctctgtcgcccaggctggagtacagtggcttgatcttggctcactgcaacctccgcctcccaggttcaagcgattcttctgcctcagcctccagagtagctgggactacaggcacgtgccaccatgcccagctaatttttgtatttgtagtgaagacggggtttcaccatgttggccaggctggtcttgaactcctgacctcgtgattcacccgcctcgggctcccaaagtgctgggattacaggcatgagccaccatgcccggcataagtatggtttttaaaacaaatttgctttgactattaatgagggtttatgttacatgtttatagaagtttctgcaataacataatttcttggaaatgtaatattgtgtctaataaattctgggtaagattttgggtgatcatcaaataggccttgttccaaactttgtttttatgttgattactggaaacttggaatgtattttctcatagaaacattgtgataaatggtggtgaacttcccaagataatttttttttttaaattgagatggagtgttgctctgttgcccaggctggaatgcaatagcacgatcttcgctcactgtaacttcccctacctgggttcaagagattctcatgcctcaccctcccaagtagctgggactacaggcgtgggccaccacgcccggctaattttttaatttttttttagtagagatggggtttcaccatgttggtcaggctggtcttgaactcctgacctcaggtgattcgcccacctcagcctctcagagtgctgggattacaggcgtgagccaccgtgcccagtcccccaagatagttcttaaaaccccgtgttactgagtgtgactattgtgccttttaaatattttttttttttaatggagtgttgctctgtcgccaagctggagtgcagtggtgcaatcttggttcactgcaacctccgcctcctgggttcaagcgatccttgtgcctcagcttccctagtagctgggattacaggtgtgcgccaccacacccagctaatttttgtatttttagtagagacaaggtttcactattttggcctggctggttttgaactcctgacctcaggtgatctgcctacctcggcctcccaaagtgctgggattacaggcatgaaccactgtacccggcctctgaattctttttagcaaataaagttgtcattgacacctaaacctggtaaagacagtacagaaaaggaagttgcagtctaataccaatataaatatagaagaaaaaaatgagcaaataaaatctaatatgaaattagtaataatatataccttctaaaaatttatgttgaatttaattcattcatttgaatacgtttattgctataactgttgaaggttatgaattctccttcgaccattgttttacatttgtactatagtttctgctatgtagtatttttattattctttcagtattgattttctagtttgtattttccctttcatgtacaaattacttaataaaaggtttatttttcaagtagaagggccctttgctttttaaaattttgttattaatttctagtttgttatattttgatttgagactgtaatatctccaccttgtggcacttccttatgctttctttgagatcaaatggaggatcatatgtacacacatatacagcataacatcttctgtaagagtttgttgctttggtcttttatatgtttttttgtccacttgatctgtgttgtactgagagtgatgtgttaaaatctcttagtatttgtgtgcttctgtttatatctccttgcatctcctgtagtttttggcttcaggtggctgctgcattatttggtgcataggtattcataactgttatatatcactgaagaattgcaggttttagcattaatacctagtgttcgccattaatacctttttgcttgaactctgctttgtctgatatcagcataacaatcactgctttccgttttcattaagctagtacaactttttagcttttctctgtttttggtgtctcttgtatgtagtgtatatttgggccttgttttatgagacaaatttaaaatcttttttgtttaagcctgaaatgtatttgagttgagaaataaaggcagattttgatttggcatttggttgacagcgggtgtttaccataaattaaatgagctgtttgcagctctaccatttgggtaaaatatatttgaagtgtatgataagatcaaaacattttataaaacaaatgttatttcagcaaaaggatattggaattaacaatattttgatgttttctacccttttggactatataaaattaaactgctaagggaaacaatagcaggtataattcataatcatttgataagtcatagtaatactgttttggaatatttcccagaaatggagaatctgaataattgtagcaaatgtgtaatgcatcctttgtaagtcaggtagtttctggttacttgctttcagcaaattgtgagaggacttaacatcaattgccacgtcattaaaaataatttctgatggtagatcacagtgtgtgttttggcatagaaaaaattgagtgaccttgttataacaaaactcagagtgatttagtttttaatgtgaattacatttcttagtgattatacctgaaataagtgaaataagagtagaattgagaacttatctcattttagcagtaagaaatattctttcttagatacatcaatataaagaaaaaaagctctgtaaatgtcagtgagtttcatgtccattaatattttactttttgtttaaaaattatgtggcctggcacggtgactcatgcctgtaatcccagcacttcgggagactgaggcgggcggatcacaaggtcaggagattgagaccatcctggctaacacggtgaaaccccatctctactaaaaatacaaaaaaattagcccagcgcagtggctcatgcctgtaatcccagcactttgggaggccgaggcgggcgaatcacgaggtcaggagattgagactatcctggctaacacggtgaaaccctgtctctactaaaaatacaaaaaattagccgggtgtggtggcaggcacctgtagtcccagctactcgggaggctgaggcaggagaatggcgtgaacccaggaggtggagcttgcagtgagccgagatcgcgccactgcactccagcctgggcgacagagcaagactctgtctccaaaaaaaaaaaaaaaaaaaaaaaaaagatgtattaaaattataatatttgtttcattatctgctaataatttcaataatggctcattgcacaaaatattttctaacttacatggaagtacaaactcctataattttaattaatatatctatttttgttgcatagaattatggtagaatgaggaataaaagacttttagttataaaatatgaaattaggatgaaatggagagagtgcagtaaaatgcaagttaaacaagatacagctggtgtaaaatttctgttgtatttaacagaatttatgtattttttgagtagataaaggtggatgtcagcttgctatgatagttcagtttttggatacacttaaaagagtgacataattttattttaaaatgtaaatatttacagtaaattagaaactacatcctttgcaagtacttaatgaaattttaaaaatgtgaattaaaactttagctgtaagaagaaatatgcaagaatatgtgtaactttctaaaatgtttttgtagggtacaagcattcaagtttgaacactactgccatagatttatttgaaaaagaagctaagttagagatggctattgcagaatgcagaagaggtgtacatttttatcctgatttacacatgcataggcaaatgtggtggtttaagaaatggtttgggccgggcgcggtggctcacgcctgtaatcccatcactttgggaggccgagacgggcagatcacgaggtcaggagatcgagaccatcctggctaacacggtgaaaccccgtctctactaaaaatacaaaaattagccgggcatggtggcgcgcgcctgtagtcccagctacacaggaggctgaggcaggagaatggcgtgaacccgggaggcggagcttgcagtgagtcgagatcgtgccactgcactccagcctgggcgacagagcgaaactccgtctcaaaaaaaaaaaaaaaaaaaaaaggtttgataattaaaaagagttcttttttttttttttttttttttttgagacaatcttgttctgtcatctaggctggagtacagtggcatgatccacggctcagtgcagccatgaccttctggtctcaagtgatccttccacctcagtctctctagtagttgggacaccatgatgtctggctaattttttattttttgtagagatggggtctcactatgttgctcaggctggtctcaaactcctgggctcaaacaatcctcccgccttggcctcccaaagtgttgggattacaggggtcagccagtgtgcctggacagttaaaagggtcttgagcttgaacatagcagtcatagttaagtttttgggctcagttataccaaaaattgaaatcttatttttcttttctggtatataatgtaatcctcccatttataaaataataaaattgtatttatcaccttactactatgtataggtaaaaatatttatcttgaaccattagagggcagcacggttttatctttgaaattagctttcacaacatgtaaatgcttttgagtcacaggcttaatataagcatgattaaaataaactatgaaattttaagttaaaattaaaatatttcatttggaatttttgtaatataaaaaatgtggtagcaagataaaagtaagtcatccttttattttttccctccccttccctcttcctaaccacattagaacttttacaaagtttgaaaagctatacaacttgattctaaacttaatatttaccttgattttcagatgaagagttacctaagtcagtgttataagatgttccatggtaaaagggatttgaagacaaattttggaaatgctgcatactgtatctctcttgaagactcctaaaggtgtcatgaagaaaactgtttacctaagtggttcctaacactgactgaacatcaggctttcctgggcagctttaaaaattctgatgcccagactttatgtggactaattaaatcagaatttctggttgcagagcttgaaccgcactgttttttaaaacttccccaagtaattctatgtccagtcatttaaatactggtccccacaacccaaaacacattaccctctattaacatcaaagattatgagatggtttgaatagtcatagaacttttgaaagaagtaaagaagaagggaagaattacagttaaccacactccttaaggataattgttctggacagctagcttccccacattgctgagggttcacttttttttggaacctaaaactttacttagttcagtaattttggatagaaatatttctaaaagttatggcatatattttttatatccttaaatagaaaatgccacaattcttagcatgaagaatccttgctgttgactcattatcaaccttataaacaataagtattacaagcctcatgagatatgtacatggtttgtccttataccagataatcctagacatctgtttctagagtacccaagtgtgcttttagttactttccaaatcattgttgtcagtcagattgtcatcttatttcttgtttttgtcagtgcacctttgcatattgcttgctcctttctttgatgcttttcaattgctattatcttgaaaactgatattatagtttgaatttggggcaaagtaagagtagcagggctttaattacgccctaagatgtccccttaactgtggaaaacatcgagttttatctagttggtgaatttttttacttcagaatttatttttttctgtcataaattttgctaaggatctgcattttgagtagaatgaagtggccagatagttgaataatggtttggtgaatatctatatgtatatatgtatgtgtatgtgtgttacacatacatatttaatgacatgaagtactttggttgcttggaattggacagaaataacagtttttttttttttttgggacagagtcttgctctgtcacctaggctggagtgcaatggcgcgatctctgctcactgcaacttccacctcccaggttcaagtgattctcctgccgcagcctcccgagtagctgggattgcaggcgcctgccagcatgcccgccagcacgcctggctaatttttttttttgtatttttagtagagatggggtttcactatgttggccaggctggtcttggaactcctgatctcgtgatctgtgtgccttggcctcccaaagtgctgggattacaggcgtgagccaccgcgcctggccagaaataacagttttaataaatttcatgaaatcactttcttgtatgttaaaggaaacagaaagggttcatttgtgcatggtttagtctttcttttgaatgtggaagtttttcttcttatttgtgtgtctaaaaaaattaaaaagtgaaacattttccaaaatgagaagatttgctagtaagtaatgcatacttctatgaaattatctgcctgagtttgataattttatttatataatttcttttttttcccccttccaatccttcatggttttcttttttacacacaaagcctacaacctttactttttccaactggaaaaccagtttttccaacactttttaaaaaacaaattacccttttatcatatgctgaaagccctccctataacaagcccacttctgcgtttgactctacactgacccttcatttacttcctaaaccaacccttttggtaacttttggtgaagaggtggctttaataaatatattctccagaaatctccagaacctttgcgtgggtcagggtgagaggtgcctccacaatgtaaacagaacagctgagttctctgggtaggtgccaggtgcaatctgcacagacctgtatgggaggcctggagtcagaggcatttcctcaaaatgcatcccttctccggcagagcacaccaggccccagggccccgtggacagggctggtcccagcgtatgcatgccacttcctgggctttggggggtggtacgccagaggctgcccacagcagcaggcccactcagaggccagggcctcttgttccacttgcagagaccccagaaggagccaggggacagcatcagagtctggggcccaggcaggggtgcccaagggcacagcaggtgcaggccattggcaaggccagaagacggtgagtggaaagccaggggtgcgtgcagtgactccgagaagaggctgttcagctgggagtcctgcatttgccgttcgtgtttcatgcggcgattttgaaaccaggtttttatctggacctccgacagctgcatttccctggccagcctcttccactccagagggcccaggtactggtggtgctggaagatgccctccaagccacggacctgctccgtggtgaaggctgtgtggacacagtggggcccgccaggcgtttggccctttcctcaacccagccatagccctctctggcggaggcagatttgaggacctagcctccttgatgctgacggcctgagggggctcctcggggcccgatgcctggtccgggccagggaggctccccagggagacctcggcaggcctgggggtgtgggtcggccctgagcagctgctttgggagagccagtccacggagccaaagctagagggctgctgcccgccacaaggtggggaggaggagggacgcatggccgggcagggctggccaggggcaggatccaatatttatatcatttcctcaaagatgttcctttatcgacttgacgtttttgcttggcattacttctattctcccatttagagtccttacatatatatttttctgttcttctattattgccctttattttcagagtctcttcttgggaactgaaaaggaaactttcttttggaacttttgatttctaggtgtaagaacttctgttcactaatttgatggaaaaaaagaaataggattgcacagtatttttctttagaaggaaaaaacccaccctttttgtgagttgtagatcaaaagtcaacagagaaatgttggttccacattaaaaatgtcctaatacgtattaccgtctgatgtataagtagcaaatattctacctttaatagtgtttagttagagatgggggttatcatttgtcaggaatattaaagagaactttctttggtttgatatagatgagtgacttttaaaacatttttgactctgacctttgctaaggaatttttaaaaataatgtgacccagtatataaatacatacctacatccacacacatatacatttttacatatatcactaaaacaaaaaatttatgatacgataacatctgtattatactctaatattttctattttgttttattaaaaaattacagttgtggtttattaaatttatttcatgacctgttaatgggtcataatttatacttaaaaaaaatttaaatgatttccaaggtttcatccaacataagattctatgttagcatgactctatgctctcatagagaatcaaagctcatcatagagcagctgggaccatgttaaattaggaatgataatagaaattctcccaagacatctggatattcagttatccccatcatatctggaagtccagtgtcaccagttactcaaaaagtacagaatctttgaataaaatctgcgatttacttaatactgttgtatcaatgttcagtttccagttttgaccagtgttactgtgtttttgtcagttgctaatgttagggaaagctagatgaagggtgtgtgggaactctgtgctatctttgcaccatatatatatatatatatatatatatatatatatatatataaaattatatagaagacatatatactaacttataaaaaattaaatatagaagagcatctttgagtagtgtgctctcaaagatatctaaaaccttctcaaagacatctaaagcgttgtgtttggaacttttgttgtgatatattgatgataatatcatacaaactgccctgtccatcatagtacattttaatatgacttttataagtaagagaaagaagcttagtgagcagtattaaagttgagtttgttaatcctatttgatagttacttgacagttccttttaggagtttagaactaggagaagaattagtagaataaattcttcagagaagataccaaattacagagtgggggctggtattatcttttttataatttctattgtgatggaacaaatataatgaggaataggtgagtttagagataatttctagaaaattgcaaagatcagggtcggcaacctggacctctgtgttgagaaaggggtaatggggagcagtgttagtcaatttaaatacaaatagaagtctttacttaaatggtaagcaagaataatgatctgtatgaagtgatgagacgttggaaaaatgccacttattggatatcaaaaaaatatttttaactggctgagttagaaacaagaatatgggatgtgcagaatgtttggaaatctcggtctttgttttgcatctctgaactattacaccattgaactactctttcttggcttgatgcctttagaaactacatattagcttcatcaaaaagctcttattggaggctggcctggtggcccagcactttgggagggcaaggtgggaggattgcttgaggccaggagtttgagaccagcctgggcaacatagcaagacttagtctctacaaaaaattaaaaaataagttgggcatgtggtgcaggcctgtagtcccagctactagggaggctgaggcaggaggatcgcctgagccaacaagtttgaggctgcagtgagctatgatggtaccactgtactccagcctgtgtaacagagagagactgtgtctctaaaaaacaaaaacaagaaaactcgcatttgaaaaacaagacacaactgaaagactccaaacctaacccttttcagaaaatcagaggataaccatttacagtaaagaaaaagggtaattttaatggcagaagttaaaagttcaaagaaaattgcatgttgggtattttttgtatacttatcaccatgctgacagcagtaaggtgattcaagggaaatacatgaaattgttcctgcccataggaatgtgtgttaccttcagggagataagatgataacagtaaaagttatgtagtctactgtgtgtagaacactgccagtttctttatacacagacgtggtggttctccaaggtatatatattttatccctgttttagttacgaagaaacagagactcaagtttaatttgctcagtatcatttatgaagtaagttatagaattggattataaatctatttctgcaagactcaaacccattttacaaaataattttgttattgggtattttggatactgtgaagtaaaacactcgaagcctcacttcagaacgtattttttctagaataaaaatcaccatgaaataaaatcattcaagaaaatactaggaatggtagtatatgtgggatgtaaattttcaagatacgtatttggaaacttgagaatgtagatactgctaattactattgatttagttattctgtcttccttttgaaaaatctttttatttagaaataattagagattcactgaaagttgtaaaaatggcacacagaagcccatgtactctgcactcagtctcccccattggttacattttacagacttgtaggacaatatttcaaaccagtatactgacattggtaaatgtatgtgttgtagttctgtttcattttgtcacatgtagattcatgcaagcactgcagcaatcaagatgcagaactcggccaggcatggtgactcatgcctataatcttagctcttttgaaaggcccaggtgggacagatagcttgagaccaggagtgtgagaccagcctgggcaacatagtgagatcctatctctacaaaaataaaaataaattagccagacatggtggtacatgtgtgttgtcctggctacttgggaggctgaggtgggagggttgcttgataccaggaatttgaggctactacgagccatgatcacaccactgcactccagcctgggcaacagagtgagactgtctccaaaaaaaaaaaaaaaagatgcagaattattctgtcaccacaaagctcttccttatgttgtcccttaactactcttctcttcacctctgctaccctactatctctagcccttggcaaccatgaatgtgttctccatctctatgcttttgtcatttcaagaatattacataaatggaatcatagtatgtgactttttgaatagtattctatgtttttgagtagtgttctgtgtaccacagtttgttgaacccttcacctattgagggatgttttgtttttcttcagtttttagctatacatataaagctgctgtgaatatctatgtatgggttttgtatggacataaatgtttatttctttgggataaatacacaggagtgtgatacctcagttgtgtagtaaatatatgtttagtgttctaggaaactgctacactattttccagagttgctgaactgtctggcatcacaatcaggaatgtatgagagattcagtttcttctcatcctccacagcatttgtggttgtcactatttttattttggtcattctgatgtgtagttatatatcattatggctttaatttgacatttccataatggttagggatgttgaacatcttttcgtgtgtgtgtgtgtgtgtgtgtgtgtgtgtgtgtgtgtctggctgtgtgtctttggtgaaatatctctgtcttatgcacattttctataaaattgttttttttttactgttgagttttgagagttttgtatatattttagatataaatcctttgttagatatgtggtttgcaaatcttttctccctgttcatagtttgtctttccatcctcttaacatagtttttcatagagcagaagttttttattttgatgaagtccagtttatcagttttttttgtgagtgtgctttgggtatcaagtctaaatctcctcaccaaatctagatccccaaaggtgttctcctaggttttcttttaaaggttttatggtttacatttaaatgtacattttgaattagcttctttttatcaggtgtcatgtttaggtcaaaggtttttgtttcggttttttgcctgtggttatccagttgttcagcaccatttgttggatagctctccttcctccattgaattgctttttcacctttgtgtaaagacagttggccacactagtgtgggtctgtttctgggttctctattacgttctgttgaactctgtgtctctgccaactcctcacagtgttattactgaagttacataataagtgttaaaataatatagagtggtttcttatgctttattctttttcaaaattgaatactctgctttctttgcctttccatgtaaattttagagtaaatcttttcttgtatttttactttcaccttccatgcatttattgctggtatgtagacctacatttcaatttttgtattttgatcttgtgtcctataaacttgctaattcacttattagttctaggtaattaaaaatatgtttctttctacacagacaattatttcatctttaaatagggacatttttatttctttgtttctgatctgcttgcctttcattttgataaggtttggatctgtgtccccacacaaatctcatattcaattgtaccaatgttggaggttgggtggggtgggaggtgattggatcatggggatggtttctcatgaatggtttagcaccatccccttggtgctgttctcgtgataatgagtgacttatcatgagatctggttgtttaaaattgtagcacctccctcctttctctcttcctcctgctttggccatgtaagatgtgcctgcttcccctttgccttccaccatgattgtacatttcctgaggcctcccagaagcagaagcctcaatgctccctgtacagcctgcagaaccataagccaattaaaactcttcttataatttacctggtctcaggtatttctttatagcaatgtgagaacggactaatacgtgtttcatttcttaccttattgcactggctagatcttcaagcactgtgttgtgtaagagtagtgggagtggacctccttgcctcattcttcatgtacaaaacagtctttcaccattaagtctgattttaggtgtagatttttagtaaatattttaaatccaactggacatgttcttcttcctagttttttgagaattttttttatcgtgaatgggtgttgaattttgttaaatgttttgctgcatcaattaactgatcatatgatttctcatttttgacctgttaatgtgatagattacattgattgaattttaaacattgaaccagccttgtatgcttgcaataaacgatacttggtcatggtctaagattctttatgtatgttgctaaattctacttgctaatattctattaaggttttttgtctctatagtcatggacgatatttgtctgtagttccccccaccataacccctttggcattctttttctgatttttatatcaggatactattgtactcataaaaagagttgggagacattctctcctcttctgttttctggaagagattttatagagtagacattacatctttaaaagtttggcagaattcttcctgaaaacacccacaactggagattttcttttttaggagttttaaatgtatgagttcaatttattgaatacttatagggcttttcaagtcatcttcatattgggtaagttgtgatagcttgtgctttttgaggatttggctcattttgtctaattgtcaaatttctgtgtgtagaattgatcttagtattcccttattcttttgatgtctacaggatctctagtgataatccctgattcttttctgatattgatgatttgtgtcttcttttttctttgtcagtgttgctggaagtttgtcagttttattatccttttcaaagaaccaagattttgtttaattgcttttatgtatagtttttttctgtttccagttttattgatttctcttcttagatttactaccttctgctttctttagatttactttccccttcttgttctttgttcttgaggtgtgggcttagattatttatttgaaacgtttcgtcttttctttcttttttttctcagaccattcttcataacatttttttttttttaagagacaggatcttactctgttgcctaggctggagtgcagtggcataatcatagttcactgcagccccaaactcctgggctcaagtgatccttctgcttcagcctcctgagtggctaggactacaggtgcacacctggctaattctgatctatgtatttagtgttatgaatttttctcacttctgcatctcacaaattttgatatattgtattttattttcgttcagtttaaaaatttcccttgttaattcattgacccctggattattttagaagtgtagtttccaagtgtttggagatttttcctgttatctttgttattgatgtttagtctgattccattgtggtcagtgaatacactatgtataatttcacttctcttaaatttgtcaggtaagtttgtaaaacttacttttcaaaatctatttctaatttttcattttgccttcttagttcctcactttcctgctttctaggacaagtccatacaaacctttggcttaccagaggtgcagctgtagcattttatatgagtgtatctatttatgcaaattatatactatgctttcacttcagaatgtgttatgagtttccatgtaactaagtgtacaactatttaataaatttacatagtattctgctgtagtaatacaccataatgtattgtcatttttgttgtagagtttgtttctagtcactatgaagtaacagacagtagcacagaaaacaaacatgggggcattttcaaacacggcagtagttcctagtctgtgttcccatctctttttagagtataaaagtacaggtatatggtatgttgatcttgcttgatgggctcactggacctcctgtttttaaattgatattgtcagaggccataaggacctcttcctccatgatggctacctcttagctcgaagctattatactatttgggctaaccctctgggtacaggtaccattttgtcttagatggacattgggcatttcagaggatatgcagattcactgtcccacttcacctagtctctgcccccataggaatgtgaactccttgattgggactcagatgcaagtgatttccttcttgtatgtgtgtaatatgtgactgggtggtaatacttaacggagtactgtatgtatgggattagggtctttaccatatttgctatattaattaaaggctatagctgcctagtgtggaggatgtttaattggaatttcatgtctattctaaatttagtgggagaaccttttaggattcttgcttttgccagtggatagaggttactgccatttactgagatgggaaagaatggagaagaaacagatttggagtgcagttaagacttcggggatagacatgtctgtaagacatccaagaggagttgtcaaatatgtgtttcatgtaggagactggactcaggagagatctagatgagagaggtaactatgggagttgattgcatatacatcaccctacaaagccctgctttttcagacctttattacttctctaacccacctgctgctccctgctgttccaacttcactccagccacactggctgcagtttccaaacaagtcaggtatactcccattttagaggtatttattttctgttctctctcatttgccaaggtctaatgtaaccttttcagtcttgcctttcatttcaccccaacccactccaccctgtcctaccctgacattccccaggcccctgccttgcttttttctctatgccgtctagtttcatctttattagctttgtatggctaaagcagataaaataaagaaaagcagtgataaaagaggtaaagcaggagagggtaggcagagactagatcctccagggctattttacgaaatttggtcttcattttcagaagagtggaagatgaaagttttttttttttatttttggacggagtcttgctctgtcgccacgctggagtgcagtggcgcgatcttggctcactgtgacctccgcctcccgggttcaagagattctcctacctcagcctcgtgagtagctgggattacaggcacatgccaccacgcccagctaatttttgtatttttagtagagatggggtttcaccatgttggccaggatggtcttgatctcctgacctcatgatccacccaccttggcctcataaagtgctgggattacaggcgtgagccaccgcacctggcaaagatgaaagtttttgagtgggggagacctgaccatgtttgcatagagaagcagtaggagaaaggcaagagtggttatgggtagatcaagtgggagattattgcaataaaatagaaacaaaaccaaaaccgaaacacatttagtgagtgatccaagcattctcctaagtgttgaagaaactaggatggttccatctcccacttaaggagtaagtctagaaagttagagaaatgatgtctacttaaagataagtgctctagtagaggaagttcatagtgttgtgggagtataaaagagtacatttgatccagaggttccaggtttgtaaacctgaacttaatagttgaacagctttcacaaaattaccacttagaattagtctcacagaattctaaaatttagaacccaaagggatgtttatctgatttcgactagagattagaaaattttctaaagtatgttttaagaaattttaggtttttttggatgttaataagtatgacacacaaaaagtggttaagtttggacaataccagattaaaccaacagttttctttactgcggaacttctcagaatttatgatctgcttaagtacattataaatcttctagagatgtatataatgtgtagcatttctcagactcaattggccatagatcctgttacattaatgaatgatctgtggatacagggcaaactttaggaaatgctggctgacatgatttgctgaagatcttaacaactagttaaagggtaagctataattaaaatacagttttcacaactttgtcctttgagttttctaagacatttcagtattaccatatgaaacagtgttaactatgaaactaccaggattctttttttttttgcaagggtaggaggacaggggtctcattctgttgcccaagctggagtgcagtggcaccatcttggctcactgcaaccaccactttctggggtcaagccatcctcccacctcagcctccctagtagctcgttaatatagaccaggtggtccaagggccactatgcctggctaatttttgtgtcttttgtagagacgaggtttcaccatgtcacccaggctccaggattcttttggccacattttaatactatattacatttggaattaatgaaattctaaatttggcataatataactaataactttgtatcactcagtgggcaagtattatatagagttagtttaagtctacgtgaaatttatgacctaggaatgtgtaatgaaacaacacttttctgttttttttattgcttcttttttgtggctttgaaatattaagaatacttcattttagctttcttagctttgattccgtcattattttggcagattatactgttttagaacttacatatggtaaaaataatggcatagtaaaaatgcaacattattgatattcagttattagaaagaatgtttggaaagtatttctagtaactacttttcatgtatttctagatgaggcaggggttggcagtctagagcccacagctttctttttatgtatgtcccatgatctaaggttgtatatttaaaaatcattgaaaaaattagtagaagattggtttgtgatgtgtagaaattatatgaaattcagatttcagtgtccataaaaacaaaattttattggagcaccaccaccctcatttgttgatgtattgtctatgactgctttctcaatacaacagcagtattgagaaggtgtgttagaaaccttatggcctgcaaagcctaaaatatttactatttggctcttttcagaacgtttgtggacctctagtctgtattaatgaataatagagtgtatgggattataagtttaggtatatccaatataggaagctatgttttatatataaccaattctttaagtcagtgtcttctaatcagttccacttatttgtccctgctggttctagtctctttttttttctggtagaagttgtatattttattctaattttgtttcatttttttcttttttcctattgatcagtaaacagtatatgatgtgtattattataggaagcacttgggtttgagaagtatctttgtaaaataaatcttgaataattttatattgtttctatacagttgattgatggggaacactttttatatttgaagttgactttgataggctaagttctttttaaaaataattatttcatatgatcatattagcaacagaatgttattcttactggatttagttggcccgaggaagtcataatttagtttgttcctaacacaactggagtaaatattcttagaatacttcacctctttgatttgaatgctgttaccagtgtataaaattttatgtatctatttgtattctatttgatagcttttattggttcttaagagggtttgttaaattttcgtttccaaatattgaataattttgcagttgaattttttcttttgcaaattttatggtttgggagagataaaaataatatcaaaccagaacaaggataatggaattattgatgtcttgttcaaacatctaaacatggaatttaaagaagnnnnnnnnnnnnnnnnnnnnacatctaaaacatggaaattttaaagaagtagctttaaatatgtaggagcctctacggtgctaaacacgtccttttcagtgtaatttttagtttcagttgtaatacagaagtttattttcaacctgagtgatctgagaaggttgtcgagcatgagggtaccaagtacggctcattagcaccttactattagtactatctttttttcttaggaagggttagctagactagaatatgttgctaggcttccatgtctttcgttttagcatctcattcatctcccagatgttttggtaataaattctccttgttagcacaaatgaaactaggatcatgtcctcccttcaaagagcatagaaacaattgtatacattctccatgattaaggaatttctgggtattcacaaattgtattctttttcctttgttagtgtaggtacaaagataaattgaataaaatatactattaaagaaaattttcaagtggatttagaaactcgaaccagtgaaattaatgtatcatagaaaaaattttcactattaaactgttaaattgttaaaaacaagatactacaatttaaataatatctgttgaactttaacaagaatttgtgggtttgtttttcttttttgtatcaaaataatggttatatttcatattaatctttagcaactaaaatatattgtggcatcttcttatggaatcatttgtatgttcaacaagcagttttttatgttttcagaaatagttgatatcatttcatattaatcaactatttctgttgcaacactgactggtattgcttacaccatattaaaaaacacatttttttaaatcaattttttactacttgtaccaactaaatctagtaagaatatgactcaggtcatgtgatcatttcatattaatctttagcaactaaaatatattgtggcatcttcttatggaatcatttgtatgttcaacaagcaattttttatgttttcagaaatagttgatatcattcagtttggacagtaataacagaggtacctaatgagtttttaaaaacaggtaagcatgggacagtgactgaatttaagaatgtcttggaaaatattaagtctagaactttagtgggtggaattttattagactgccagtgaaattgcaattatatttgaagttactctgatggactctttttaaaaaaaaaaaaaaaaaagaatatttcaaatgacctgggttatattcttactagatttagttggtacaactagtaaaaaattgatttaaaaaaataagtgttttttaatatggtgtaagcaatacacagtcactgttgggatagaaatagctattatttgaaaaagggagaggagtcagtttcctatagtcatataggtttgtaaaatgctggatcaaggaaaatttaaacgttttcttattgtagaagttctcagagcctttacttttttatttttgtgggtatttaattttttgtatttattttatacagtataaaatataaaaaattcaaatattaatgtaaatactatgccacccctgcattccagttacccaattttgcccctgcccctgccagtttcatgtattatcctttcaggatattctctggatatgtatatgtatatgtatttactttaagaaagtatcattctgtaatagtattccgaatctgtttttttttcctttgaaaaataccttaaacagcattccatgtcagtatgtaagaagctgcattattttttctaaactgattatgaaaattttagaaaccctgcaaccatataggtctatttaactcccaccccatatatagatgtcatttgtattacatttatatagatcataacttccacaatgttatgattttttgctttagtctatatcttaaagaaattaagagaaaaaggtcttgaatttatttgcccacatatctatcatttccctttttttgttttgtttttgtgtttgtgtttgtttttgtttttgttttctctgaagatccagatttctgtctggctttacttctcttcagtttgaacaccctttagtatttcctgtagtgcaggtcttctggcaatgatttctctgaatttttgtttactgaaaacatctttattttgccttcagttttgaagatattttcattgaatatagaattcggagttgacagtttttcttttttttcctttccttttttttttttttttttttttttttactttcagcactttataaagactttaaagatgttgttccacttgtctcctggcctcagattttttctcttgagaagtcatccatcatttgaattgttgctccccataaataatatgtctttttagcttttagcagttaaactataacatatcttgtgtggttttctttatattaatctagttcactgagcttcttgaatatgtaaatatgccttttaccaaaggaaatttttgggtcttaggtcttttaatatttttctgttccccccttttcctcctctccttctgttagaccttttttttaattttaattatttttaattttgtctaacaggtccctaagcttcagttcatttttttaacttctttttttctaatagttaggtagtataatttctgttgattaatcttaattccttggtcatctccttttggctattatgtctatccagtgaattttaaatttgaatatcatattctagaatttgtttggctactttttataattactgttctctgctgaaattctccatacatttattcattaaaagcatattttctttgatctctttgaacatagtataactttgctgttagttcctttttttttttttttgaatacagagtctcctctgtcacccaggctggagtgcggtggtgtgatcttggctcactgtaacctctgcctcccaggttcaagcgattctcatgcctcagcctcctgagtagctgggattacagctgtgtgccaccacactcggctaattcttatatttttagtagagacaggattttgccatgttggtgaggctggtctcgaactcatagcctcaagtgacccacccaccccagcctaccaaagtgctgggattacaggcatgagccaccacacccggccctttgctgctaattctaacatctcggtcatttcagggtagttttctgcttacagttttttttctcttgagaatggatcattttttcctgtttcatatgttgaataattttggattgtattctggacattgtaaaattatatgttgtagaacctagattctattatgttcctgtgaagtgtgtgtatgtgtgtgtgtgtatgttttagacaggccctcactctgtcacccaggctggagtgcagtggtgcaatcttggctcactgcaacctccacctcccaggctcaggtgatccccccacctccgcctcctgagtagctaggactataggcacatgctgccatgcccagctaattttttgtagatatggggttttgttgtcttatctttatagatatggggttttgctatgttgcccagcctggtctctaactcctgggttcaagcaatcttcccgccttggcctcccaaaggtgttaggattataggcgtgagccactatgcctggccaaaaaaattttttaggcaggcagttagttggctggggtctcaacaaaacttttctgcattgggtggcaggcacctcaaattctaatctcgtagctaaatttctttgaattggttccaggtgtgtgtgtgtgtgtgtgtgtgtgtgtgtgtgtgtgtgtgtggttcaggggtcagatagagattcgaacagttttatacatagaatatgaagctccctctctctccagattatttatttatttatttagacggagccttactctgttgcccaagctggagtgcagtggcgcggtctcggctcactgcaacctctgcctcctgggttcaagcaattcttctgcctcagcctcccgagtagctgggattacagttgcctgccaccatgcctggctaatttttaaatttttaatagagatggggtttcaccatattggccaggctggtctcaaactcctgacctcatgatccacccaccttggcctccaaaagtgctgggattacaggcatgagccaccgccctcggcctcagatttttatttctaatatttcctcctccatattccaggggctttggaatatgagcccttatcgctgggtcttcaaaccagtatgactattttccagtggcattttagctatttcacatggaatagatgggcttgccttcaaattcaagctattaaaagaaaaaaaagggagagaaatgcatcctatgctgttctttttttccagatgttaacttgcctccagtgtccacctgtttcattgactttttggtacctttagatgattgtttttttacagtttgttcagaatttattgtttcctgcaggagaatcagttcagtgagagtttacttggccatactggaaatagggttactgctttatttatttaagaacggtttagtatcccactgtgtgatttctctgtaatttatttaacttcttagtcctgtattcatggacatttagttgttttgaatcttctgatgttatcagtgttgcagaatgtatctttatacatacacgtggtgagacattcttatgggtacttggagtacatcaacagacatttctgtcctcatgaagtgtacattctagttgggggagatagaaaataaaaaataaatacaagtacattgtatagtagattagaaagtgaaaagtgcttatataggaagaatagagccctgtttgagtaaaaggatgggaatcacaatttgaattaggtcttgctgagaggtgagatttgagcgaagactttaagaaggtgagagagtgagccttgaggatgtctgagggagaagcaggagatcagccattgtaaaggccctaacgtggaggcttatatggtgagtttgaggagcagaaaggagactagtgtggctagagaagagtaagtgaagaggtgagtggtagaagaagccagagatgtgactgggagcctgatttatgtaaggccttgtaggccattgtaaagattctggctactatgaatgaaatgcaaaaccaatgtaggtttttttattttttgtttttttgagacggtgtctcactctgttgccaggctggagtgcagtggcgcaatctcagcttactatatcttctgcctcccaggttcaaatgattctcctgcctcagcctcccaaggagctgggattacaggtgtgtgccaccacacccagctaatttttgtatttttagtggagatggggtttcaccatgttgaccaggatggtctcaatctcttgacctcgtgatccgcccaccccggccaacgcaggttttgagcaaaaaataaataaataaataaataaaaaccgttttgctgattaagagagcagttgggaggttattacaataatctagactagagacgaggctgttttgaatgttttggagttttttaccaatataattaggtgaagaatgatacctctttggcattttaatttgcatttctttgattatgaatgaggtcaaacatcttctcatatgcataaaatcatttatatttccttttctgtggtctgtaagtgtataacctgtgctagtttttgtgctgattcagtagtctttttcttttttttgagatggagtctcgctttgtcactcaggctggagttccgtggcatgatctcggctcactgcaacttctgtctcttgggatcaagcagttctgcctcagcctcctgagtagctgggattacaggcacccaccaccacgcctggctaatttttgtatttttagtagaaatggggtttcaccatgttgtccagactggtcttgaactcctggcctcaggtgatccagccgcctcggcctcccaaagtgttgggattacaagcatgagccaccgtgcctggcctcagtggtctttttcttactgacttgtcctcagtattttttaaagctcctcatgtacttccggtatataggcaaagatgaaaccactgatctagcccatcctcatcttgtagccgcctcaaggtcagatcatgcccaatgttaagaggtacttggagtctatagtcacaaagtacattcactcccagcacttccccattcagatctcacatgcatcctttcactttgaacttgtccttctgctagtcctgattgctttactcccacatagctgagaacctggcccttgctggtcctgtctctcccttgcaatcattcacttttaagttgagaggaatatagtaatgtagtattgaggttagggggtgctgtggagccactctatcttcatttgaaacctggttccgcctaggccaagcaacttatcttctctgtttttcagtttcctcaactgtaaaatggaaatgataacaatatgtatttgccttatcaggctattgtgaggattagatgagttactgcatgctcagtgccggcatatagtaaaccactcagtaattgttagctataacctctccttcatttaacagatatgtagtggactccttttaagtgctaggtatcatgctggataccatacactagggctgcagtgaatacaactccctttttccctgtgtataagcagaaattgtcccttttgtagccttcctagaacactattcctggaatagcatgcgtatcatttactctaaacttttccctttgttgaggaactatgaggtctaatacagggttctcaagcatttgcaggggagtctggcctttctaaatttgagaagtaacaggatatacttattttgattatattagaattacattttgattaaacaagagtcaagtgacaactaagattataagtttagctcttcatctgtttgattttatcatgagttcaccagctctgaagtgttcagtttctggccagaatttcttatgcataactggggtgattttagcttcctgagagatcaccatggtcatactcttgtcagtcttgatcactctcctgctttggagttctcagtcttataagctcagattgtattgcaggtttctaagtctcataagaagtgtcatcctctgcaaataggattatatggtcttatttgcaaacccttttttgttctcttgagtgactttttcaggataacaaagagaacaataagtaaaatttgcttaagatgcattctttctttactcccatgtgggtctcagattttcagaattctccatgttgattcctcaaatacttaaggaaccttatatacactgggtttgaatgacttattggtttgcttgacatcctgtctttgtaagagtatgtggcaggctttctccaaatcaataaaggcagcaagactttttttttttttaatgtactgaacttaatagttgtttacatactcattttaaaatggaaataaaactatcttatattctgatcttttctaaatccaaatcagttctttatgtcagctttcaatcgtctatatttctaatgcaatataatacaatattcttaatatcatacctactgtcagcaagtattttttgcccttgttctcttgctcgtgttcgtgtgctgtctctctctcctttcctccctctgtcttcctccctccctccctccctctcctccccccttcttgcctcgtccttatccctcctctctctcattgagataaaaatgagcaacttcagctttttggctgttctcttttgcgggtgggtaagatttaggatcgtaggcagtaatatttggactatatatttaatcatctcaggtattattctcatcatggcttactgcttttctcagtttgagtttcctgggagcttattattcattaatttcccaggctttttcttggcttcagttacaaggaccttgaccaacttgctttatttatttccttatgatttgttgacattctcatgttctctggtcaagatgcacttctttaaagataaatgagttactagactcctgtactgtaattgactgacaggtcacagaacagtctatacagaacagtctgtgtagaacagaaccccaaacatgtaaataaatggcctttacaatttttaaaaattgtagtaatgttatttattattttacattaaattcttccagaggcttatttagttgatttctactggtttttatagtatctgaatttatcagcttatcttctgcacactgcttggtgttttgaactgcattggtgttcattttttattcctcttttttttttttttaagagatgaggtctcactctattgcctaggctggagtgcagtggtactcaaaccgcaagggtacatttgatgctgagctcactgtacccttgaattcctgggctcaagcaatgctcctgcctccgcttctgagtagctggaactacaagggtgtaccaccatgcccagataattttttatgttttttgtagagacagtcttgctattttggcaaggctggtctcaaactcctggcctcaagtgatcctcctgccttggcctcctaaagtgctgggattataggtgtgagccactgtgcctggcctagattggcattcttgagtgaccaatgaaccaaatgtcagatctcctagacaggcatgaagtgatgttctcccgggtatggtacaagcgctaatgggaaactaggggtgccactgagcgtgtgaaatgaaagtctagagattctgccagcataaccacagctaagggtattctttacagggaataaccaaaagctttagagatgctgcagcttcatagaaacattgtagaatatcaaagaaggctgatggattagttgtcaagagggaaagaggccaacaactatgatttcctggggctactatgttctgacacagcatgtatcttgcatagggtgacacagctagtaaagggctgagctggccctccagcccaggagtaatatgtcatcaaagctcgtgctttttctgctatgctacactaactcatgtaaacatccactctttgggaatagtaggatgtcatgatgactgagttatttcagaatatcttcaaaaactattttgtccacagaaaagaatgtctttggccacactttgtatttagtgtgactaaaatacacgtatctgtattgtgaacaggagtaaaccatcataacccgaggccaaaactgttagcctttcaaagctctaagtattacttcagcctcttcctatgtgtggtagtcagactggatatcaatattgtctctaccaatatcatctcccttatttgttgctgtgttttacctcagggtacatggcaaagataaagaggattggatagttctcagcttagtgtgcatcctggaataagagacagttcacactgactaaccgatgtaaaagcataccttgcgtatctgcagcaatgcaggaaaaggagagcataggtaattgaaatccacatagtgcattccccagaggatttgtgcaggaaaaattttacaaattaatttaaaatgactgaaaattataaattgtttaacgttaatccaaggtactttaaaagtggaagagttttcttaaagttccaagtactgtactattttagcaaatgttgctttttttacacttttaatattaaacagtatgaaaggatccaggtagttgagcaaagttcattttcctatttctttgaaaagcatctctataaaacataaaaataaaaaaaaattagccaagtgtggtagtgcacgcctgtggttcctgttacttgggaggattgcttgagccttgaaagttgaggctgcagtgaggcataatcgcacgactacacttcagcctgggtgacagagggagaccctgcctcaaaaaagaaaagtgggcttcgagtcagacagtggtattggctccagagcatctgtataattccagtaaatcatctggtttggattgtaatgaaccccccaaagtgtgttactcatagccgaagaaatttctaagacccttaaatgattactgtcaataatctgagactatttgcattgcctaaaatctgacaggagatctccatgtggcagttccagctaataaattatatttctacttttagtttctacgaagctactttaaaaccctgcaatttttttaaaacatacgtgtccttctaatgattgtgagactatgaaacaaaatgattatcttttagattaattcttatcgcaggtgagaggataaagtgttttgtaaaataatgtattaaacatacctattccttggcatgtatgtttagatttttaattataatttttatgatgtgttggagccagcattttcctgtagaaatataactcaagatttaatattgggcaacagtgggaaaatgggatttagtatgaaaatatttgctttatgtaaacctttttatgaatgcacctaatgtataaagtgaagtcaagctgtaaaaacaattagctgggaaaatgccaagtaaattttttctgttccagtgagtatctattaactatacattattgttatcattaaactgtatgcaaatgtatgactaaattcatttagatttgagtgaaagagacagaatactagaagtatgcagtaagtataattagtttgcatctccaaacaaagcacattaatctttctgcaataccgctgatgtaatgtctccatgttacttttgggagtatgtgaagtgggcaaacatccaaagttgatagttaattctgatcagcaaaagcactggagtagatgcctgggctggacgttgtaataaagcaaacagtttttaaacttcttggaagattttagtgcaaacgtaatcatccatttgaatcttttattatagacattataaaattaatttatcgaaaaagagtgtaaaccctcttttaaaaaatccagtatgtttgtatcttttatactttcatgctttttatacttctaacaaacttttcaaaaacatatgcttgtggacttaatggagagatagaagttttataagtattttctagagctcgtttcgtgaatccttttgttggtgggaaggacttgagagattttctacactagttgttttcaaagtgcattctcagagaacccttaaccaaagatgatatctgctgctggaattaaataataggaatattcttacaactcaaagaaacaataagccatattttccataagtttttagtacgtaagattctgctattagattactagcatgcagtatttagtgaatatatattgaaaagttaaaagtggctgggcacagtgactcatgcctataatctcagcactttgggcgcccgagttgggaggattgctttagcccaggaattcaagaccagcctaggcaacatagggagtgcctgtctctacaaaaaaaaaaaattagccaggcatgatggcacatgcttgtggtcccagctacttgagagactgagatgggaggattgcttgagcccagcaggttgaggccgcagttaaccataatcatgctctgcactccagcctgggtgacagaacgagaccctgtttcaaaaaaaaaaaacttacattttaaaaaaaattgtatgtttttgaactgcagagtatatgtgtgaacatatatatctatttgaaaattgtccctcagtacacagatatgctatatttcatgaaaagtataataattttcaactggtttgtcacttgaataaagctgaaagttgatacagacaaaattgttcttattactgatggctcttagagaacataaggcttcttgcccaaagtctttatagatctagtagctggaacttaaatccagtagatcttattctaaacctaaaaatattttcctctgtccacactgtcagtgttttttttttttttaacaaggtttaatgagtatttactagccgtgttcccattcaagtaagaaataagaatattctttatcagctgctatttagtattcttttggaagtttggatcaacaaaattagcaaaataaattgtggaaataaataggaaaaacaaattctggaaataataggaaaatcctaattttttcttatgaaacaaatggtgagagaattaactaaaatcccattaaagacaggaagagcactctgtaaggcagatgagtacaaagttgatattcaggaatcagaagcctttgtattcacaaacagggaagaaggcccctgtgacgaggcccttctcaatctgtagcatgtgtgcaaaccacctaggctgttaggtaatgtgcgcattcctggactccatcctgaatccctttggtcagccctgaatctgctttttagcaagtgtttctagaccccattaggaagactccagtgttttctatgtgggacccacttgagaaatactactccagggaacccgccctcctgcccccccctccccccccccccccgccgtattcctgcagcatcactccacaattctgctggtttccacagtgctagccatttacctctcagacaggcctgctgcagcacccaggggaacacagtggcagcacactggaagaagaggcccccagatcgccttgccagggacccttcttcacagttgcaaagtaggaacacttccagcactgctttgcttgtcagccaccacaggggaggcacatcttactgcttctgccacacactgtctgaccaccaggagggcaagaaatagggtggtgtcctttagcacctgaagactttgagcagaacctccaggctgggtgcaccctttcctcacctgccagattcagcgtggctgcttttcactagagttgatcacccatttttcactagtcctatggctacctaattcctgtgtgttctactgcctcccagttggaatgagcagcgatgcttggcaaaactgtaactggttaattccagctcctctgactctgctgcagttgctcctaggaagctacagaaaaacatctatgctgactagtccaccttgatataatgaccacaatccttaagtgaaattgtagcactgcctgcaatcctatattttcttgagcagttcagtctcctatttttagagatgacttttcctgcactatggaatggcttgtcacctattctcttcttgcctctcctcgggtaaatagcaacaagatccttttaaatcatgtcagattgtgccactttcctgcttaaaactttccagtggcttccatcatgtggaattaagttctgatttgctgcctggtgacttctcagacctagtttcctactaatcattccttgactcagggcttgtcaggtacaaggaacacttgccctttctcaaaaatggaccaaccaacatgttatttctgcagggcctttgcacttgctgtcttatttgcttagagcactttttctttctggcatttccatgcctagaattctcactttattcaaatctgtgttcaaatgtcacctcctaaaggagcccctgttaatctttttctataccatgctttatttttcttcctagctcatctcatttgttgatgtgtatgtgtctgtgtgtgtgtgtgtgtgtgtgtgtgtgtatgtgtacttacttgattgatagtttcctgagggcagtcctccatctctagaaactaaaactccatcccagcatgaagtaggcctttaataagtatatgttgaattattaatgtaattcacatacccccctagcaattagacaagagtaggaagaagaccaggtcagtaacatcctagagtgcaaaagggaggtcttttacacttccctttacaaaatttggtaggctagtttgtgggagtctgccaagaatgtgaatgagagtaggtgagatcacctacaaaaactgtcttgtcagtgagaaacaaaatagaaccctagggagtatcaacattttttaaaaaaatgatttgtattgaaataaaatttacgtaacacaagattaactattttaaagtatacaattcattgtgcatttagtacattcacagtgttgtacagccatcaccgtggtctaatttcaaaacatatctatcactcctaaaagaaaccccatacctgttaacagttactcctcaaactccatcctcccagctcctggcaaccactaatctactttctgtctctatgggtttgcctattctggatattttgtctaaatggaatcatagagtatatactcttttgtatctagcttctttcacttagcataatgtaagttcgtttatgttgtagcatgtaattatacttcattcctttgtacgactgtaaaacactccattgtggggacataccacattttatttattcatcgggacatttgggttatttccactttctgactattaggaataatgctgctgtaaacatttacctacgagtttttgtttgaaccccagttttcatttctcttgggtatatatttagaagtgaaactgctgggtcaagtggtaattctgcttttaattttttgaggaactggtaaactattttccatagcaactgcaccattttacattcccaccagaatgtatgagggttccaatttgccatgtctttatgactttttttttttaaactatagccatcctagtgggtgtgtgaagtagtgtcttattgtggtttggatttgcatttccctaatgagaacatttaaacctgggctccagatgggtgggttaagaggagacaaaaaatgagcagagaggaaataggactttgcagtcaacttggtcttctagacttacagtgtccccatcattgcctttggcagctgatatcctgcacctgacttttggcgtacagagatcttcagaatctgccagatctcatacatctagagagacttaagttgctttgatattcccagtccagcatgacttcttcagagtttatagttagtacttctgcagtttatagtgttcatctatccagttcattcagaggcagcatggtatagcagttatgagcatgggttctggagtgagactgcctgggctcaaatgtgagctcaagtcgggtggccctgggaaggttagtgaatatctctattcttcagtttcctcatctgtaaaatgaagtggggttgtgaggattcagtgagattagtatctaaatgcttggaatagtgcctggcacatagtaagtgctttgtatgttttagctctaattatgataatggtgatgtgataatgatttatctatatatccatttagagaaggggcaagaacaagtttatgttggttccaagtatgagattgagggtggtgattgtgtgtttacaataatggggctctttgataacgtgctgtgctttgcatagtcctgattatggcactactgtcagtgatacagtacaagttacttattctcttgatttgtgttctgtattccataaatcattccactagtttatcaaatttaatttcaaacacagatttacctttgtttggatagggactagacttccttcaattaagtatttttttttccatttttattctagtgtaccgtattattttttaaaacttgaaattatgagaggaaagaacatcatttataatgctatcatttcaaaacaccctatcctagcttttagtgcatatctttctatatttcctctaggcatttaaaacatacttacagtaattctacaaatagaatatccatacacctcttttaaagcatattttcatctgacctgtgaatcttttctaatcagtcctaatatttgaaattcctcaagaattaacagttagatctcataaaagatatatttttcaaaatttgtagatatgaatagagaaagaactgtcttctatctagatattttatatacatacaagtttgaaaatgtgccaaggactattttatagctctatgataaaaacctgctgtttttctacagcaagaaaaagaatgcttagcagtgccaaaaagtgtacaaagagtcaaaataatcgacatgtcatttgaattcttagttttggcctttagggtcctttaaacataaattctacaaatattttgtagataagtaaactgagatagaaaggttaagtgacatttctgtttccagtcaatgttagaaataaacacagaaatccaaagcctctccttattagatcggaagatagcattttcatatattttaagatgtaagtctgtaggggagatatgaatgtttaagctgtgttgagatttatgaataatgctatcaaatagaatgaggtaattatttttcaatttgtaaaaatcctaatgttatttgggatatgtctttctcaccttgtaaaaatgatactcaggaaagtggagatgttggagaataaaacagtcacagaatggtagggaggacatacgggattttagttgtttagaaagataatacaaaatgagtccataaagagggcattaaatgaagtaactttagggaggttggcaaggatatgtggtataaaaagttgctacaactaacagtcagatataagtgaatgtaaaatctttcctttactcaaaaaaactgtaaggaatatcaagtattaaatcaaaggaaccagtatacattctttcttactgttgtattgacttgtggtatcttgaagataggctgaatctcaagacttgtttgggatctaaaggaaaggaagattctattttattttatttacaattttatttattttttgcaagacttccagcagttagaaggcaaggagacatggggataaaaaggccttgcaagcagcatttgtcagatttagtctgttaagtaatgtggcacacaacgctgttcattttgatgtttcactttgattttacgtcatgcacttgtgtctatttgatctgacatgctgcagaaacacagtgtttcatcatggttgtctgtttgtttcagcagccattcactcaataaaacatctctgaagtctatcagtgggccttactttagatcccttgcattaggttctctggccttccatgaagatagacaatttaataaacaaaaattaacaaaaatggaagaagataaagcagatttttaggaagctccatacggaatttcctggactctgcagttaggcagacttaaatttggttcccagcaactcttttggggacatttgttacctcttaaggtgaccttggggacatctcctgcctcaccaggctgtagtgaggattaaatgaaaaagagatatgaaagacctggccaggcgtggtggctcacgcccgtaatctcagcactttgagaggccgaggcgggcggatcacaaggtcggagattgagacgatcctggctaacacagtgaaaccctgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaattagctgggcatggtggcgggcgcctgtagtcccagctactcgggaggctgaggcaggagaatggcgagaacccgggaggcggagcttgcggggagccgagatctagccactgcactctagcctgggcagcagagcgagacttcgtctcaggaaaaaaaaaaaaaaaaaaaagagagaaagacctaaccattgtgcagtaagcattgtgtgtggtctccttgaatggactctgaagcaattgccaagtcacatgggccacattgtgggatgtggtgataatcctggacctttatcgtgcagagagtcagcagggcagcttaaaattatggttccatcctcagaaactctgatgcagcagatcaggcttggatcacaggaatcttcatttttaacaagcatggaagataattctgatgaaagtaggatctttcaaatcccaagacttttttgggatttaaaagaaatgcaaccatttgaccctgaaacttaaataacttggatgggggagttttcgtggttcatcttttaacagtaatcattatggggatctaaacattgaccacagaattctacttgagaaaaatcattcaagaatagctatgtctgcttaggtaaatatactaatttgtaaaaatatgtacatcacttattatacctactgtgttagtctgatctcatgttgctgtgaagaaatacccgagactgaactgggtgatttataaagaaaagaggtttaattgactgacagttctgcatggctggggaggcctcaggatggcagaaggcacctcttcacaggacagcaggagaggaaatgaatgccagcaggggaaatgccagacgcttataaaaccgtcagatcttgtgagaactcactccctatcatgagaataccatgggggaaaccgcccccatgattcacttaacctccaaccaggtccctcccacgacacatggagattacaatttggattacaattcaagatgagattttgagtggggacacagccaaaccatatcaaataccttactaaaagtgagcttaatacttgaaataagtgaaagtagaaggaaatccactaaatagaacatatcgatctttataattaataaactttgggtatttctttaccaaaggaagtaagtattttgagaccagacctatcacacaaaaaccattctgcatcatctcccctgtaattcaatctggatgcaattaatgagagtgctctggctaatcttgattgtcatgatggtatgaggagatgtgatatataaggtattcaaaccatgtggggtatattattaagaatcattgttaagtaagaggatgaagtgaaacagaatgaaataagtcaggcatccagtcttggtatttcctgttgttagtgctagaatttttaccttttatgttaaaaatgcaacatacttaatttttcctctgatacttacacaatataatttatatatacatatatatccacatgcatgcacatacacatacattgagccatatttgatgaccaaaaagggagaggccccaagggctctttggtgtgcaattaatattttggccagaaaatcagcagattgtttcagtatggttatgtgttatgacatcatattccagtaaagttacaatgaacagaaattttgtttgtctctgtggcaaaccaaaatgagttttgtaattgtcagcaggccttagtgattatagtggcgcccactccctctactgtagttaaaggtctgttagcatttcagttgtggaccttctattttcagaagtttataattaattgtaaacatttgctctatggtgaaagtttgccatatgagatctcacttcaggagtaaatttctgatttcaagttgtctgttttaaagttttatagtaccaccagttaaaaataaacaaagttatgtggaggtgggaaaattgaattttgtgaaatatgaagtgaagatgaccggcgttattcatattagtctgtcagatttctgcattaaggaattaaaataaatttctgcattaaagggattaaaataaaatagatgataggaaattgtgcacttcagtacacaatatttaattgttgtaaccaaaaagcaaaaaagattatagttttttaatgctttttaatctttgtttataataaaaacatttaaaatgcgttatcttaaattaatagaaaactgtagttcaagaaaattgattttaggttaagcatttaaaacagcaactttttcttttttttcatactctgaattcctctccttcatttgacactgttaattactcctgtccctgacattgtgttgtaatttttcttctaactttgaccctttttcatctctttcactgctgtctattgtttcccttgcactttgatcacaggcattaatcagttccgagccttaggctcttttttgattcctttacacttaccctttccaggtgcttatccacttgcatggtttcaattattgcctcacaaatctgcatcttcagtaccaatcaacatttctagttcttcaccttcagtaaaccttcattgattagtcccatctgcctggtgaatgcttacatgatgcgctctatccagtttatctcaggttggacatagagcgtcactacttggatgtgcagtaattatctaaaatatagtaggacctcaattggacttctttttgcttggaaacaaacattttttaggactggagtgatttttaactcatttttttcagcattgcagttgtaaatccaccattccatcaaaatcgattctgtttattttgctaagttgctcaattcagtggtcatatttctcagtcatcattttacttgacctgttagtagcattagatccagttaatccctcccttctccttgatagacttttttcctgtttgactttcaggaaggacatcgtgcttgcttggcttttctcccatcacaccctcccacagagttctcattatattatgcctttaaataccacctatatactgatgattcccaaatattatttctatcttggacctctttcctgaagtccagactaataaattcagttgtccagttgacatctacacttggatatctaataggtctaataattgaatatccccaaaacagagctgttgaaatccacccccagcaaacccatttcttttgcaatcttcactgtctcaatagatgggtactccattttccagttgtttagttccgaaaccgtgatgtcatccctgactcccctctcatattccatagccagtctttgggtaaacccatcatctctactttcaaaattcatctagaaacaatgacttctcgttacttccattgctacaccctagttcaggccactgtcacctttccccttgattatcccagtagcctattagatatccttgcttccagcattgttcccctacagtgtgtcctcaaaatagtagtcagatggttattccaagagataagtcagattttgtcacttctctgtgcagaaccttccagtggctggtcatttcacttgggttaaaaatgcctacagcaatttgtagggaaggccctatggaatcttgccacctcttctcatctagcttttcctgtctccctaaacttttgccagacaggcttcctccgagttacttgaacatgtgtggcacactcccgcctcgctgcccttgctgctggtatactctctgcttcagatgcactgtcccagagatctgcatggcttgttccctaacttatttcatgtctttacacaattgatattttctcaatgaaacttctcttggccaccctatctaaaacctacctccctgacacttctgaaccctttcctctttactttttcttacatctacatctaacatactaggtattctacatatttttcttattgtttatcttccccactctaagtgttgttgttcattgtcatagtcccctgtcaaatagaagacgctccataaataattgttgaattaatggattttattacatatcttaattttttctgcttaatttcttttggtttttttgtttcttcttacattctctgttatctcttcatatctgcattattgcagctttttagtcacacctcattagcctcattacctcaggcaccgtaaaatgtatgaatataacacttcctgcttaagaactggcctaaactccttattcttatgctgaatctgctctccttattactttgcattgtagtcggtccatttctaatctatatttctaatcgtaattatcttctgcaaaaagcacggtaatctacatgttgtcgcctgaacagtcttgcctgacccagcctctgttgtagcttcatcagactgttctcttacttctgtcaaaatctgaccgaaaacttctcaccaggaagtatcctgtgatataattaaataatttttactgtattgttttatgtttaatgttgtattctatatatgtttttcatggagatcagtataagctattatctatagatgtattgactcacattttatcaaaaaagtatgtttttgaggttaaagttttattaagagtatagcacattatataattggtatcattttaaacaaatcttatgaatgattatagagtggttttattaagctaactttaatgtttttattttcttattttaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcaggtgtggtgctgctgcatgtgacagtctgttctttctactttcccagtgaaacaaatcagagcattttataattaaaataaataatctgttctgatagggaagaatactagagtgaagacctgacagtcttgcttcatgtgttcctgcagggtgactacctttcagagctttggttcttcccttgagttcacttcccaggcaactggggatttggggatgtatatgaggatgagaaataacattgatttggcttatatttcatactatgtttattgaatatagattacattgtgtgaatctagaatcaaggatttaaagtggaagagattttatggatttttcagtcctcttttgttttacaaatgacattgaggctgttcttaagtaatctcactcattctcatggcttcagctactttcttgattgacttcaaaatagtatctctagctcaggcatgtcctatacatagcatagtgagcttccttttttttttgagatggagcctcgctctgttgcccaggctggaatgcagtggcaggatctcggctcactgcaacctctgcctcccgggttcaagcgattctcctgcctcagcctcttgagtagctgggaccataggctcatgctaccacgcccagctaattttttgtatttttagcagagatggggtttcactgtgttaaccaggatgttctcgatctcttgacctcgtgatttgcctgcctcggcctcctaaaatgctgggattacaggcgtgagccaccatgcccggcagcatagtgagcttcttacttaccctacagttcaacctctacagttttcctttccccaaaccaattgtttctttctcctttgatatttatcttaatggcagacttaggtgtttttctgcttgtactctttcatgagagctcctatctatttcttgatctgttttcccactagatcattctctcccagttcttgacagcaaggaatactgtctctttctaatagttatagtaagttcagcatatatgaggccttccagaagtatgtgttaaataagtgaataaagtaaaccaatgcctgtgccagacatagatctccaattaggatgctcctggtttgcatcctgtactctttctgtaacttcatcctcatagatcacattagaacaccagtgggggaattcctgggtgttgggggttgggtgggtagagaactctaaaacaagagtgccaggtttagggatgtaggctaaactcaaattagtgtatggttgagtaaaagatttccaaagtctgcattaaatgcttttccttcaaggaaaacaagctaaaaatcgagtaacaaaaagcctggcagcaaagcccttgaccgctgtggttacaggagaatgcagcagatacagtctatatagtttgttgtttcttcttgtaatttaaataggccatcttgactgtagaataaaagtaaagtttgttataatgtcaagattcagtgttatcctattttttgtgatttagaatggtgaatcaggaaaggatatggatgatgacaaagatgcaaataagtctgagatcagcttagtgtttgaaattgctctgaagcgaaatatgcctgtcagttttgaggtatgtactcggtagagatcttcccattttttcccttgctgtggttattttaaacaaacaaatcaaattaactggtgtattagtatcctgcaagagttagtgtgcttctatatgttcaaacccagtattatgaaatgatctaggccctggtgaaaatagaaatcatgatgataacacagattccttctgatttttttcttttctgtattaagccttttgtatacatggtatttcaatttttattataaaagttattttctgggtatagataatttgtggtatcctataagatttggcattttaaataggattaaattaaatttattcaagttaagatttagtgacatacatgttaatatccaatttttttttcaattgtgtggaggccaaaatatgtttcactttaacctcaactaacaaaatcaccaagaagtaagatgtaatgaagcaactcttgacttaacagctagataaatatattgcaaatatattcataaaattgtatgaaatttcaaaaaagaaaacttaaaaaaataattattataatacttcttttattaagaggtcactaattttacaactcatgtctggaaagtagacaagaaccaggaaataagctgaaagagttgtggagattcttccctcacattgtatgacattcacctactagaaagctcccacatcttactcattggcaggatcatctgagttggactgagaaactgtttgctttctcttggacacattcttacaagttgcattatctcagttctcggtccacagcttgttaaaagcagcaaaatgaggaagtcagggagagaatgtacttgagatcctattggtccagcaagaaatgatacggaaaatttggaaaacctgtaaaaagtaattgcttatactaaaaaattattgggattttttttaaaggctacaatgagtaagaacagacagttttattattcttaggtgttcttgggaacatcaatatattatgatgtaggatatctgatgtttataatgatgatctaatgtgaacaattaaaggttaaatatttagtattgcagattaaacaaggtttaggaacattacattcatagttgacaggtccataactcattactctagaaagctaggaatttttttggcatacctacttacctttttaaaatcgtgtcacaagaataaatatccctttctgtaaaacagcttttgacatccctatcaaaaacagcttatttttatccattgactgtttttgagaggcttccacaggcacagtgccttgtggtttatagaactactcgtttctccagcaacttactcgtacataggaggaagttaggtatgtaattatatacaaattatcattctagatgaccaatctaatatggtatctaatctaatggtatctttgatgttcttaaatttgtgttccataagacatggagaaactgtaattagaatgatctgttttaaagtaataaatcattttgactatgaatcaaatgtgtttatttagatttcttttgtttcaattgcattaagcatcaagtgtcataaatagtcccagtataataccttcataatagctttcttaaagaaatactataattttggcataatactaattttggttttgatatgaatattaagtcatactttaagaatacatctcaagtgcctatccattatttaatattttacttgtatttaataggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggtaagtttatatttgtgaacatcagtcagttttactaaataaatattatagtagctatagataagcatttttctataaggcagatccctgaacttatggactatatacagtcctgaaatgagggcaggacatgtgactataaattaatgacaattctattttgctttttaaatacctgtgcacctgcatttgtacatcaaataatcataataccttaggtatttatgtatttctttgttgtttaaaaagtgctttaccattcatgtcacctttactataatccccctcatgaccgtataaggtagatgatgttagccctcattttacaaataagattttacaaaacgtgttcaaagagtttgcccatttttattcagcaatcatgtcaaacctcctgaaccgctctgatctctaatccagtgttctttctgcacacatggctgttgcatagtaacttcttaggatatcatgaaatggtaacaggatacacacaaaaaaatcatgtgactaatactaacaatgatagctacagcagctggaaatcataaagcagtctatgtgccagactttgtcccaacactttgcatgctttaatcacatttaatccacatagcaaccatatgaagtagatggtgttattttgttgccattcgttcagatgtgtataccttgccaaagaagaatatagagcacacagcttttcaagatattgtgactcttttattgggtcagaatttatttacattaataagagaagcaaggtaaatatcagaggaatgagatgaatcagcatttagtacaggacagtgcctgtgaatgcttgacacgtatgacatgtctggagctagagttctgtgtttccagagaaagccttaaattgccagcattttagttgctggctcagcctcactgatttagcagccttcttctgatcaggctatacaaatgaaggattacagataagaaatatatttaatctcaatggatttcttttgattgcacaatggcacaatttaggtatttttacaggttttatacctttgtacctttatttaaaatacatatatacatatatacaaaaataactacttaaatatttgtttttaatgaatactgacatgacttcacttagaagatgtagtaggtaatgcattccctgaactggaattatatgttatatgtaaggtagactaaaaataaatacaaatagatccacttatcatgagtcatagtggttccaaagaggactggcactttcattcatatgctcctcctacacagtcaggagtagaatatagctattaagagaatgaactttggagtcagttctgagtatgaatccctgtggcctgagcaagttacctaactttaaaaatatttcttcatttataaagtgggaatagtaactgaccttgctgtatgggattgttataagtattaactgaaacaatgcacaaaatgcattagtaattattaagtattcattgttattaatgataatgcaaatactataataaataacacatattaactattggtattttgtatctaatactacctattcacattttatgtttatgtgaatatatccatgaactgttttcttaaatctattaatatataaaatctatggcttttctgtgatggaggaacagcattttatgttggaatggtggcacaaaactggtcacataacttctgtctgctctattaaactaagttttatcttgataaattaagaataataaaccaggcaaaccaggctgggcacggtggctcatgcctgtaatcccagcacttttgggaggctgaggcgggtggatcatttgaggctaggagttcgagaccagcatggccaacatggcgaaacttggtctctactaaaaatacaaaaattagtcggttgtggtggcatgcgtctctaatcccagctacagctcaggaggctgaggcatgagaatcgcttgaacctaggaggcagaggttgaggtgagccaagatcactgccactgcactccagccttggtgacagaatgagattccatctcaaaatgataataataataataatcataataataatcatcataataaactgttaggctggaaaagatctgtacatttctatagtaggatataaatctaactcttgttttaactatagctattaaaagcaagattattatttaaatgttattccccagaggtgggagacaggagaaacattttgaattctcagttatttgctactgcttccagtatataagtaatattatcccagaacttccctcctatgcatcattcagatctcagcataaacttgacttttttaggaactcctctggtcctctcctactcccagactaggttagcctcctgcatttttcctcatatacatcacacttggagttacttttgccatgtctgtcttatgttaaaataaagcttgtagataccctctgaaatgtaagattattttgagagaacaacatgtgtataatgagttggaatctagataattttaagtatgttcataccttataatatgtcagtaaatggatcagcttggaatagtatcctgatttttagcatattcctcacttccttgtatggcttatacattgagggtctatagtttgttacactcaatggaagcaggtaaaatatctatgattatttgccttggttttatttaaagtaataaaataatcacattgtctcatttgatcacttaatcactctgtgatgcagcattcatttccatcttacagatgaggccctttatatttaagaaacctatccaagatcctgtagcagaatcagctttcagatccagttgtcacatctgactccagtgcccatttgatactggttaattgtgaacttttggattttcagagtcactgtatagggttatcctgttaacatgtaaaactgccctgataatgtctttgtgtttacattctgtttttaaatgtaattctcctctataagacgagactacaaagaaggctttctaatcttagagatcaaatgttctggacacaattattacaagactgtccttattggtatatagaatgatgatttaagatttgctgtccaaggaataacttaattgtcaagggtgctggtagttcatttcaatcagagcaagaaaccaagtcatcccctcccccgctgcctttttttttttttttttttgagacggggtctaactctgtctcccaagctggagtgcagtggcaccatgatcttggctggctgcaacttctgcctcctgggttcaaacgattctcccatgtcaacctccagagtagctgggactaggcatgtgccaccatacctagctaattttggtattttttggtagagatggggtttcactgtgttggccaggctggtcttgaactcctgacctaaagtgatctgcctgcctttgccacccagagttgttttttttttttttaaacagggtctcacttgttgcccaggctggagtgcaatggtaggatctcagctcactgcagctttgatttttctggtctcgagtgatcctcccacctcccaagtagttgggactacaggcacaacaccaccatgcacagctaattttttgtattttttgtagagacagggttttgcaacgttgtgcaggcaggtctcaaactcctgggctcaagtgatctgcctaccttggcctcccaaagtgctgcgattaaaggcatgagccactgtgcccagccccaagcaattcttaatgtacactgaactccatcattatctaaattggatttatgtatctgattcttttcattgcaatctatatcaacaataatttccttggaactcagagacattctttgagtcaaattaaacagaaataaagacagtatgccactggaaacacattcctacttatttaacatcttcatgaactgggcatactacttctagtgctagactcagagcttctctttaccttttcattgggatttcaatcttagacttataaattattatgtggatttgtcttttctcatcagtccctcttcattccccttataattaatttaatttttttttaattgagacagggtctcgctctgttgccaggctggagtgcaatggcatgatctcggctcactgcaacctccacctcctgggttcaatcgattctcctgcctcagcctcccgagtagctgggattacaggtgcacaccaccatgctcagctaatttttttgtatttttagtagagacagtgtttaaccatgttggccaggctggtcttgatctcctgacctcatgttccacctgcctcggcctcccaaagtgctggaattacagacatgagccaccgcgcccggccctttatttaattttttttttcaggatataagtggaagttgaaaccagtattttatcaaaagctaaaagtttcctttgctctttcctttcccttcatctaaccattgcaacagtgaagttctcagtctttttcctcctctttccctaagctgttcttctacttctgggggttcaatttcatctttaaatagatgattcctgaataccgtatgctctgcactacctattagacatccccacttagtatttcacaggtgcctcaagttttgggcccaaattcatcattttcccttctaaacctctttctcctgcagcattctttatctcagtgactggcacaaacatccagctgctgaaactgctgggggtcatttttaacttctctttttttttgaagatggagttttgctcttgttgcccaggctggagtgcaatggcactgtcttggctcactgcaacctctgcctcctgggttcaagcgattctcatgcctcagctgggattacaggtgcccaccaccatgcccgactaatttttgtatttttagtagagatggggtttcaccatgtcggccaggctggtcttgaactcctgaccttgtgatccacccacctcagcctcccaaagtgctgggattacaggcgtgagccactgcgcccgacgtttaacttctctcttaccccttacgtcctatcagtcattaagtcctattactctgttagctaatatttcttttttttctttttcttttttttttttttatgggacggagtcttgctctgtcacccaagctggagtgcagtggcatgatcttggctcactgtaacctccgcctcctgggttcaagcaattctcctgccttcctcagcctcctgagtagctgggattacaggcgtgcgccaccacgcgtggctaatttttgtttttttagtagagacgggctttcaccatgttggtcaggctggtctcgaactcctgaccttgtgatccgccctgccttggcctctcaaagtgctgggattacaggagtgagccactgtgcttggccttgtcacctaatgttttttaagttggttcctttttttccatcccttctgccactcttttgtccaactcacagacatctattaacctgaactactacagttaaggttttaactggctacaagtactcttgacaccaaatgatcgtttaaaaagtatgatcttttagagacacctgtctaatcatatcatgcctctgcttaaaacctcttagtaattttcttactctttggataaagtccaaaatcctaaacatagtttgaaagaccatgagggatctgcctggatgctgtacctggagcaccaaactacagattgtcaagatgaaatggcagcaatcatccggaagagctaagactgcatagtggctcttacataagtttagtgtaacgtgtaatctgtaacagagtgattatccatgtctccatgtctctacagatagtagagacaagaataaattttcataggtggaaataaagttttgaccgtatgatatacgcagacttttatttctaggaaaaatacatgaagaaagttcatatgcagaaagataatttggtttccaagaatttttgcttttttttttttttttgagacggagtttcgctcttgttgcccaggctggagtgcaatggtgtgatcttggctcaccgcaacctcctcctcccaggttaaagtgattctcctgcctcagcctccctagtagctgggattacagacatgtgccaccatgcccggctaattttttgtatgtttttttttagtagagatggggtttctctgtgttggttaggctggtctcgaactcccgacctcaggtgatctgcccgcctcggcctcccaaagtgctgagattacaggcatgagccatcacgcccggcctgaatttttgcttttatgttataatacatacaaaaagctatatataaacttgtgtataagttaaaaagcatactaagtaagtgtgagaaagacctactgcccaacttgagtataaaacatttctcaataagctttgaagctctctgtatgctcttcttccatcacgtcctcatgcaaccttccctaggcaacctctatcactagttttgtatgaccatttcctaccttatagttttactatgtttgtttttctaaagttatttgtttagttcctttaaacaactttattgaggtataattgacatagagtgacttgtacatgtttaaagtgcactgtttgatatgttttcgtatttgtttgcatgtgtaaaactataaccaccatcaagataatgaacccatccattcctcccagaattttccttatgcccctttgtaatcttctaccttaatttgccgagaaaccactcttttttttggctggcttctttaacccagcataattattttgagattcatccttattgttgcatgcatgaattggtagttctgtttttttgcaggtaatatttcattgaattgatataccaccacttgtttatccattcacctgtcagtggatatttgggctgtttctaatttttgattgttactcataaagcagctatgaatatttgtgtgtgtatcttaagagcatatgctttcatttctcttgggtaaatccttcaaagtggaatggcttggtcatttagtaggtatatagtcaactttagtttttcaaagttgtagcagctgtgcacttttacattctcatcagcagtgtgtgataactccaattgtttcacatccttgctaacacctagcatagtttttaaaatttcagatgttcatgtagatgggtattgatatctcattttggttttaatttacatttcctctgtggcagatgatatcaagaattttttatgtgtttactgtcacatgaggcctgatgaagtgtttatttaaattttttgccagcttaacaaattttaattgcttatttcaaataataataaatttattattgaatttttagaggtctttatatactctggatacaggtgctttattacatatgtactttgcaaatattttcttcaagtctgtgacttgtctttttcaaagagcagaagttattaattttgaagatttattatgtttattttattattatttatattgtttcattttattattattagtttttttacatggaacgtgattttggtgttatatctaagaaattgttacctaaccaagttacaaaaatttttcttctggaaatcttatagttttagaaattacatttacgtctgtgaggcattttgagttaattatttttataaatgttatgaggtttggcttgaagatttttttttctttttctttttctttttacatatgaatagccaattgtcccaacactattggctgaaaagactaccccactgaattccttttgtgcctttgttgaaaatcatgtgaccgtgtgtgtgtgtgtgtgtgtgtgtgtgtgtgtgtgtgtgtatgtgtgtgtgtgtgtgtgtgtgtgtgtgtgtgtgtatgtgtatgtgtgtatatatatctgtgtctgggcacttattctgtttcattggtccctttgtctgtctttataccaatactacacacactgtcttgaatgccatagttttataatcttgaaattaggtagtctgagtctttttttttcccccaaaattttggttctttgtcctttgcatttccatatgaattttagtatcagcttacacattaaattttaaaaagccaactgggggccaggtgcggtggctcatgcccgtaatctgagcactttgggaggccgaggtggaaggatcacttgaggtcacgagtttgagaccagcctggccaacatggtgaaaccctgtctctatgaaaaatacagagattaaccaggcatggtggcgtgcgcctgtagtcccagctactcaggaagcttaggcaagagaatcgcttgaacccaggatacagaggttgctgttagctgagatcatgccactgcactccagcctgggcaacagagtgagactctgccaaaaaaaaaaaaaaaaaaaaaggaaaaaagcctactgggattttgaggagaattgacatcttattgttgagtcttctgatcgatgaacatgatgtattgactatttagatcttaatttcagcagtattttgtagttttagcaggctttacataaaatatactatatatatattattctgtagcttgccttttttacttactattctttctgaaaatcattcatcttgatgcatgtagcaataattaattcattttcactgctatataccattccattatatgaacatgctgtaatttatctgttcttttattgatgaatattctagtttttttttcctatttcaaataatgcatctgtggatattcctgtacatatgagctactgtgcatgggttacggttttctagggtttatatgtgcctaggaataggctaattggggtaggatgtaccatctcaggctttactagacattgccaggttgttttccgatttatagtactcccagtgttttataagagtttctgttactccccattctcaccacttggggctgttagacttcttaatttttgctaatttggtggatgtgaaatagtaactcactgaggtttttaatatgtattttctgtgtcctagaggttagttatcatttcatatattgagtttttccttatgtgaagtatttatctcttttgcccatttcccttttatattctctttttcttagtactttttaggggtcttaaaaaatatattttggataccggatacgtctttttaaaattatgtgtgttgcggccgggtgctgcggctcacacctgtaatcccagcactttgggaggccaaggccagtgggatcacctgaggtcaggagttcaagatcaggttggccaacatgatgaaaccccatctctactaaaaatataaaaattagctgggcatggtgtgggcgcgcctgtagttccagctatttgggaggctgaggcacgagaatcgcttgaacccggcaggtggagtttgtggtgagctgaaattgcactaccacactccagcctgggcgacagaatgaaactctgtctcaaaaaaataaataaaataaaataaaatgataatgtgttgcagagatctcctcccagttcatggttggtcttcttctgttctttttgatgtttcttgatgaacagaagttgtgaagcacctctggtatactgaagagtgtgcccaatttaaaaagcatagttgacaccttgccattaatacatctaagccccaagtcccatagaagccttggttacaggtctattttatgattttcctttataaatattcataaatgactcatttatcttttctagtcacagttttggggtgtgggggtggagggaagaagcactgtttctttaaggattcaataacaggtttcacaagcatattttaaaactttttcttaaattaatttttaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtatttctaaccttttaaaactattgaaaagatttagaaatccccaggatggaataggcatttgggcgaaaggcaaactaggacttaagagcagaaagtaaaactgtttccagttaaagcattcattctgtccaggctcacctaccaacttggtggaaacattcaagtgtcaaggacatgttacaatagacaacatgagttttccaagggactctgagttcacacaggttatttaccatggagtttatcatttaatgcctatcttttaactttttgtgttacattttgtagccggagtctgttaactactgggaattggagacacatggaattagaaacaaaatttagaaggatggatgtagtagatggatcagggccaaaatcctgagcttgtgggctgtcaggaaagttagaaaaagagagtaagcaggctagctaaccatggtgggggctgaggcactcaggattgctgagatctgactgctgcattgtggagccaagaaaatcaaggaatggctgctagtgtattggcagatgggctaggaatgaagtagaatgcctaaaatgctctccttttcaacccctacctattcatcttcatttgccagctcaaactccagtcttaagaaatttttcttttacttttttattacaatttcaaacatatccaaaggtggggagagaataataatggaccattaatatgcccatcactcaaacacaacagttattaagatttttgccacacttgattcagctattaatttttctcttctccctctctttcttcctttctctcttcttttactgaagtatttcaaagataatttctaactacatgtcatttcagccttacatattcagtgtatgtttctaagaaatatgaaagcttttcttacattagacatgattcattagaatcatctaatacccagtctatatttaaattattattttccccaagctgttttttaattttttgtttttttttttttttggtggggcaacagggtcttgttctgtcagccaggctggagtacggtggcatgatcatggctcactgcagccttgatttcctgggctcaagagatcctcccttttcagcctcctgagtagcctaggattacacgcatacactaccatggccagctaattaaatgttgttttattgttgttgtttatagcaacaggatcttactatgtagcccaggctagtcttaaactcctggcttcaagtgatcctcctgcttcagcctctcaaagtgttaggattacaggcgtgagccactgtgcttagtctcaaactgttttttaaataattggttagtcacagaaactttttagtcaaatccaaggatctcacattttatgtaacttagataaaatcaacaaatattaagtgctgaccatgtggtagacattttggcactcaaatacagtgtctcatattgattaagtttaagtgtatagctaagttgtgccttccctcccaatttataatctccatgtttctttatctttcagtacccaatacagtggtttgtaaatagtaggaccttaataaacatttgatagatatttgctgcctgcctttctgcctgtatggtttttttttggagatgttaacttataatgtagtcatagataagtcactcctgggaacccagatatccaaaaagaggggaattctctggttagtaatcacattattgtcaagatgttattaggatccagcacatgattgtttcattattttcactggtaaaatatgttcactatttttttccttaacattcttaactttgaagaattctggaacatatactttgaatgccaaagcttgaagaaaaaaatcgcctgaattttagacatgtattgggaatataaactggctttggctttattaaacaaatccttttctacagagtatattgagtaccccttttgaaagaggaatttagcatatcttaggccagcttccattttatgggtattcataaacattctagtcaaatggggacatttggctgtgcttttaaatgttttcgcactgaattcatattgttttttccccttctggaagccccagtggattcattacagtattgcagcaattttatcaaagtaacggcctttgtataaactacttaggcaatgttatcatttgttataattgaatgtggcagcaaaatatctagagatgagatgctcatttttatctgttaccaaagaaaaagtctatatattaaaaaatggatgcagttacttatgttgattactagataaacgaaagaaaatctccgatgacattatttgggtattttattccagagcagatttcttaaagcttttcatttttttggtgaggagtattttaatctttcaaacagaaaataatgataactaaaccaaattgcatatcagcacactgtattactaacttttcagcctgtgattgagatcaccaggttgttaaaaaataaataaaaattaagtttttggtaaatcctatttcagaactttttagtttcttaggtttttgaggatttgattcatgtgaatgagctgttaaatttaaagacaaacatttggcagtcttaaatttactgcatggtaaaataattgagcttctttacagatagaaattaacatttaaatgtagagaccatatttacaatagttataaaatttgtgacttctcaaggaagatgacttgtgaaatttataaacttacttaacttttataataaagtgatgttttgagtgaccattgtgtttattagcagggaatgaaagtcctttggcaatgtggtctttttatattaacaaattaggataactgcttacaaactattcaaccatgcgattattaaaatttgcatgaggcaagggctgggtgaatgggtaaatgaatctgggaagcacttgttttagaagaagtaagtcttgaaggtatcagaataggccagatggaaatctagcagacggagagacaaggtgaatacaggaatgggaacagcattacagctgacaagtccaagaccaggcctcagagcagtagaggaagcttctgacataactggcctaatcttttcaccagcaaggattccagcagcaacatagggactgatgaagctgggggaacaaacaaagcattggaaaaaataacagggagcagaggtactctagccagggatttgagtagattatccatagggcctgccatgttgaggcagacactgttacggcaggtggtgtgtattcatctggctctgagtacctggtctgactgtactagatttgtccttctcagagtgaggtccaaagactgcttctgatttgtcacgacatagtggtttccagtttcagaaaaaaaggcaatgaaatatttaaaaaatatttcacaggtttaaactatgcaatttgtgatagttgttacagaaattctgtaatgaatatgttttcagcgtttcatgtgctgtatgaactgtcatttagtttgtctttactgaaactctgttaaaagagagtacagcaccttttttatatcatttgtacattgtttatgtttaagtttgtattttcttaccattttgttgtatattctcccagttccttaaaattgggtggttcactgaagcttaaaagtactgttggaggctgggcgtggtggctcacgcctgtaatcccagcactttgggaggccgaggcaggtggatcacgaggtcaggagatcgagactatcctggctaacacagtgaaaccccgtctctactaaaaatacaaaaaaattagccggacatggtggtgggcacctgtagtcctagctactcgggaggctgaggcaggagaatggcatgaacccgggaggcggagcttgcagtgagccgagtttgcgccactgcactccagaacctgggtgacagagcgagattccgtctcaaaaaaaaaaaaagtactgttggaaataataacacaaataaaaactgtaaataaggatgtaagaataaatgatgaacagtactcaagtgtggataccaaatgggaatctgtatgttctgggacagatgaaacagccaatattatgattttacacaatagacaaaaaagaaaagtatggttagagtatcatgctgtatagctgaaaactgaattttgttgtcattgtgaaatgtattaaagtggcatgaaactattattgaaactttctaacttttttttaagtaaaatgataactggtaaaacaattcaacttttcagatatggattgcccacttttcttgctcatttttctgctcgttttttaaaaaaactgatatatgggaacctcctgtatattctggatgcaagccctttgcagttatatggcattttaaatacctcctcttgtgttgtgactttcctttctaaataatgcttttagaagaacaagagtaatttttagtgtagtcaaatttaaattttttctttatattaacttcataataagtctagatatccagacaaataagtgtcccacaccttgctcttcctcaaaaggattttggctgttcttagcacttcacatttccatgtaaattttggaatcatcttgttcaagtattgtaaaaagatatatggaattttgattgagttttcattgagttcaattaattgagtttaggtcaatttgaagagaactgatactattacattagtattgtcttcaatccatgaacatggcattttgctctgtttatgaggtttttcttaaagtttctcaataagactttgttttctatgtagaagatttgcacatcataggtatttgattttcatttaatgtaaatgttatctttttaatatttttcatcttctacttgaatgtggatggaatgtagaaatgcagtcctctttttcatactgagcttattacaatctaatcaattcttataattcatctgtggagtttcttagattccttatatatgaaatcacatctataaataatgagttcttttcccttctgcttctttttttacttttccttgccttatttctctgtctaggatttgtgtaaactgttaaacagtagtaataatagggaacatccttgtcttgtttctaattagtttcgttcaacattaagtacagtgtttcctgaggtttgctgtaggtgttttgtaaaatgccctttatcatatttaaaaggttttcttctactgggcgtggtggctcacacctgtaatcccagcactttgggaggccgaggtgggcggatcacgaggtcaggagatcgaaaccatcctggctaacacggtgaaaccccatctgtactgtaaatacaaaaaattagccgggcatggtggcgggcacctatagttccagctactcaggaggctgaggcaggagaatggcgtgaacccggaaggtggaggttgcagtgagccgagattgtgccactgcactccagcctgggtgacagagtgagactccatcccaaaaaaaaaaaaaaaaaaagttttcttcttttcctagtttgctaataattttcattatgaataaatgtcgatttctagtttgaatttcaaatgttaaaccaaacttgcattcctgcaataaacctaactttgtcatgaatctttttctttttctatattgctttattcattatactgtttaaaacttttgcatctatgttcatgagtgaaactgttctgtaaattttcttatactgttcttgttgggatttggaatcaaaatgagagctcataaaataattggggactgatttctcatttcgtgttttatggatgaatttggatgaaaagaatagcataattcttccttaaatattgagtagaactttatggagaagatctgaagagtcctttttgcgaagtttttaattatggtttgatttcattagtagttttagtcatattctttaggcttattctgtggcaatttggtaatctgtattgtctaggaatttttccattgtatctaaatatgtttttaaattttagcatgaaattgctctcagtattccttttttttttttttttttttttttgagacagagactcactctatcgcccaggctggagtgcagtagcatgatctcggctcactgcagcctctttctcctgggtccaggcaattctcctgcatcagcctttcaagtagctgggattacaggcacttgccatcatgcctggctaattttttttttttttttatttttgtatttttagtaagacagggtttcaccatgttggccaacctggcctccaactcctgacctcaagtgatccacctgccttggcctcccaaagtgctgagattacaggtagtgagctactccacccggcctcagtaatccttattattttgtaatgctacagaagtgatggtaatctccctttttaattatttcatttcttatttgtgtcttctcttcttcttttcttttttaaaaatacccatctcagagaagaactcgtattttttttcttgatcagtcttacttttggtttattgttttattagtcttattagagaaccaacttttggcttttctaactttattgtactttgttttgtatttcctttttgctttttattcttctattttctctgggtttgttttgctgatatgtttgggacttcttgaggtggatgtttagctcattacttttttgccctcctgtaagctgttaacggctatgcattttcttctagaccctccttttgctgtgtccttcaagttttgatatatgtccatggattatttaaaatattttctagttttcactggaatttcttcttttgcccttaggtaatttggaattacattgtttataaaatttttaatttttaattttaatttttttagagatgtggtcttactctgttgcccagggtgcagtgtggtgatgtgatcacggttcactgcagccctgaactcctgggctcaagcagtcttcccacctcagcctcccaagtagctgggactacagccatgcaccatcatgcctagctaattaaaattttttttgtaaaaatggggtctcactatattgcccaggcgggtctcaaactcctggcctcaaacaatcctcctagtgttggaattacaggtataagccaccacacctgaccagaattacactgtttaatttccaaagttgtgattaactatttaactacttcttcaatcacttactgagaccactgtgtaaaaagaaattcaactatagttgtgtattttctatttctccttgtaattctatccttttttgctatctactttactttttatagttgtatggttgatgtgtatttaagtacatgtataaattgctcacagaagataactgtagaatagttctaatgataaaaatcttttttttggagcaattgtgatggattaaatgctgtggtttacatacattatcttgtttaattttcaaagcaacattgtgcagtagttggtattaccccggctttactgatgaaaaacctgaggcttagagatattaaataatttgtaccagttcgtacagctaggaaataatagagttgagtttcatatcccaatctgacttggaagcctttttttttttttttaaagatggagtattgctctgtggccccaggctggagtgcagtggcgcaatcgtggctcactgcaacctccacttactgggttcaagcgattctcttgcctcagcctcctgagtagctaggactacaggtgtgttccatcacacctggctaatttttgtatttttagtagagacggggtttcaccatattggccaggctggtctcaaactcctgaccttgtgatcctcctgccttggcctcccaaagtgggattacagctgtgagccactgcgcctggccagaagccttgtttttaatcataatgttgtaggaacacttgtatattaattctcttcaggaactatttaatataaatctttgtaaacttgaatgtttacataatattgcaatttgaacattattttaaatggcaccaatatgaattttagccttttcagtttattaattgaaatataagaatgctaaaatgtagtcataaccaacatgaacgctgttaaaatgtaaattttatttttctgcttatataaataatataaatttagtgtttaaaaaatcaaatagcatataaatatatatggaagtaaaaattctataaaattctaccatcctgagataatcctccattgatactttaaggaccattttttcatgtacatatacaacattacataaatgttatcttagttgccatttttactttggactgaactttatgttttcaaatgctagagagtagaattgctttatgatgtaaggacttcctgtttaaatttatcataaatgtatttctttaatttatttctttaatcttatcaggtgaaggtaggcaatgaagttgctacaggaacaggacctaataaaaagatagccaaaaaaaatgctgcagaagcaatgctgttacaacttggttataaagcatccactaatcttcaggatcaacttgagaaggtaagagttaagtttacatgtatgtatcctatctgtcataatatcaaagtgattaataaattttgatcttaactgatattaaagtaaatgtcaattttaacttttctgaggcaatacaaagatagatgatccaagcacaaaataacatatggagtaagatgagatattaatgagtatttataatcttatgattagaaaatacaaaaagtttgttgtatggttgtacatattttatgtaataccaatttaacatttttaacttgttgactggttgtttttgccatatagacacagtcttaatttgtgccttttaagaacacaggttgttagcctttatttttggaatacagctgaaaacactggaaataaaaattctgacttacccctttagggcaggaactgtattggacagacactctataaactaatttttctatttactttaaatttaaaggtgaactcataggttgtttattttctgccaagacctgtgttcatggtcccctattttttctgcaacagttaatgacatcattaacacctacatctgttacaagggaagcagagaaccctgaattcagaacttggcagataacttggcagaaattggcttatttccattttgtattaagtatcattttgttatctgtggatatgtagacattatttctaccaaacattttatttatgtgaacattcacaaaacaggcttactaattacttttatcaaaagtaatatgctttagaccaggccatcttctcacacaagaattctgtttcagagatttttttagtttctacaggaacacattttaaaagtttagaattagaaacaaaaatatataaagacacttagatgtacttttttgttttctaggcaattcttttgaatgattttaaaaaatctttgtctgtgtattattgctagagatttcaattctgtttttataacctggctagtcaacactttttcttcttttaaaagtatttgtaacgtgaaacctaacatgtgttccagtttctatagtccttatattgtatatatgttgttttaacttaacacatttatattgacttaaaactggtgagtgatctataaaaatatgtcaaaataaatctcctcacagacatgtatttgtaaattaagtgaaagcaaacacaacaaaaaaccagcattaattaatttcattaatttgaaaaacattttttgcataaccactgtataagtcagggttctccaaagaaaaagaaccatcaacgtgtgtgtgtgtgtgtgtgtgtgtatgtgtgtgtctgtctgtgtatatatattaaggaattggcccatgtgattgtggaggcttggctagtgtaaaatctgatgggacagcctgacaggatggagactcaggaaagagttgaaatttcagtccaaaaacagtctactggaaaattcccacttgcccagggaggtcagcgttttgttctgttcaggcccttcagctgattagatgaggactacccacattgtggagggtgatctgctttactcagagttcaccactttaaatgtaaatctcacccaaaaacactcttgcagaaacactcagaataatgtttgaccatttggcactgtggcccagagaagttgacatgtaaagttaatcatcacactcactaaatgccagacacttaaaatgactgattttaataagatgactgagacttggtctctgcactcaaggagctgatcgttctttaagtgcagggagtgaggaattttaaccatataacaaaactagaggatgaacctggaaagtcaggaaaagctgaggtcactgttattatgcgaagtagaaggtttgaagaaatgcttatttaagatttgaacatgaatgtgaattgatctggtttgcattcttcaaaagataactctaagtaatggggagcatggatttgagcagagtgaaaccaaaggcagaaaggccagtcaggaggcaaccagagttgtttaggtgagagatattgagggtctgaactgagacagtgaaggtagagaggaggaatggaaagactccagagatatttcacaaatgtaatgggtaagatttgaatagtagataagatgcatgcaaggtacaggaaaaaagaggaggaaagactacctgcaaaaaggaatagagaatgactgctaggtggtagtcagatgctgcagagagatcaaataagaggactgaatatattgatttatcaataagacttttgatgagtgtggcaaaagcaatatttaaaaccagcaaaaacaggatttttttgttgtttttttgagacggagtctagctctgtcacccaggctggagtgcagtggtgcgatcttggcttactgcaacctccgcctctcaggttcaagcgattctccctcctcagcctcccgagtagctggtattacagtgtgcaccaccatgcctggctgattttttgtatttttagtaaagaagcggtttcaccttgttggctgggctggtcttgctctcctgacctcaaatgatccgcctgccttggcttcccaaggtgctgggattacaggcgtgaggcacctcacctggttggtatttcttaattatttggtagaagttaccagtgaaggcttttgggcttagaattttctctgtggaaagggttttttaactacaaactcagattttaaaaatagatagggttacttaggttacctacttctgcttgaatgaactttggcagttttagtctttcaaagaattagttgatttcatctaagttgttgaatttactagtataaaattgtttataacattccctttttcttttaatagtggcaaaatctaaataacatttctttactcttttagtagtagcagaatctgtaatgatactcactttcatttctgatattgatcatttatttcttttctctttttcttctgttcagtttagctagggggtttataaaattttaagtcttttcaaacaattaggttttagttgcattgatttttctctgtttttctattttcagtttttttggatttctgctctttattttatccttcacttgtttttgtttttaattttttgttcttttctaattttgtgaggtagaagcttaggctatacatctgagaactttcttttttctaatataagcatttaatgctgtgaatttttctttaagtactgatttagctctgccctacacattttgacaagttgggtttttcctgtctctctcttggtttttttttttttttttttttttttttttacctctgggatacacgctgtatgggtttttactttcattcaactcaaaatatgttctgatttccctcttgatttcttctttcaggccctgtatctgttatgattacttgttttgtccagtgttaaagtttccaactataagtttggattttcctacttctacttcttacagttttattagtttttgttttatgcattttgaaactttgttgttatatatgtatacagttagtgttgtgtctttgttgacttgaccacttctattggatatttccctttattccttgttctgaaatctgttttgtttgatattaatatagctactccagttttattttgactggtgtttgcatgggatatttttttccctgtgcttacttttaacctatctttaaattggtttcttttagaaagcatataattgggtcttgttctttaaaatttaatttgacaaactttgccctttagttagggtgattagaccatttgcacttactgaagttattgagattgttgtatttaaacacaccattttattagttgcctttttttttccccgcacttactctgtttactttttttcttttttgacctctattgtggtcacataggttacttctctaagtttctctgacctcctattgtggctatacattttagttttctatatttttcaaaccgtacaattcactgttactaattttgctttatatagtcagttatctttttaagtgattaaaatcagcagaaaatgccttttatatttactctcattttgattattttcaatatccttcatttatttgtgtaaattcaaatttctttctggtattataccccttccttgcttgaaggacttcctttaatattacttattttagcagatctgtaggcagtgcattctctcagcttttgtttgccaaaaaagtctttatttcactttcattttttttctttgcaggttttattatacacaaagtggggtgggggctcagaccttcttggcagctgctttcctcatggcagtcaggatattgcctcagctcctcttgcttcctgttggtgcatatgtgtgttttcatccttttcttaatgaacttgagggcccgcttgtccttggagactttgagcagcttcatggcatgccactttcagggggaagccacacacctcccagatgatgtcttacacaagctttgtgtgcttggtaaggtgtccagggtggcagccctgcctcagcttgctcatattcttgttcaccttgggccctggttgaggcccatgggcatggggtaatgcagaactatggctgctgctcttcagtgactgctctagcagaaaatttcacgttattttttcttttttaagcctccaatgaatcaccttcatttttgaaagttatttttttctggatataggattctgggtttcctgtttcttttagtactttaaagatcttgctcccttgtctcctgataggcataattttcaatgtaaagtctgttgtaattcttacttgttcttgttgatgtattttttttcctctctcagcctttaatatatttcttttctttattttccaacaatttggttgtgatgtatctaattgattttttttgtttcttcctttctcctctgcccctgtactcttttcccacccttcttcctcccttctttctatttttcttccttctccttttcctccaccttttcttcttctccttcttatcctcttccttccttcttctcatttcttctctcgttttttcttctcctcctacttccttctccccctacttccttctcctctttcttctatctcctctttattctttcttctcttcctccttccctattgttcttcttctctcctcttccctcttccttctcctcctccctcctctttcttcttcccttctccttttccttgtcttctttatcctcctcctcttcctcttcctcctcctgcttctcttccttcctcatcctcatcctcatctttgtcatcctccttgtccttatagggttctctgagcattttggatctgtgatttgatgtcatggaatcagttattttgacaagttcttagctattatcttttaaaatatattttattccttgttttctccctcttttccttggagtttccatttatacattcattagaccattggtattgtcttataggattttctttattaaacagtttgagtaatttctgttgatttgtctacaagttcaacaatatttcttcagctgtgtgcagtctgaattaatgcattattaataatgacatcaatgttttgatctctaatatttttcgtttaggatttccttatgtttttgttctgtggtttctattggtgtgctgaaattccccatatgctcatgtatgttatctgctttttccagttggtctttcaacctatgaatcataggtgttgtaaaatacctttctgaaaggtctagcatcagggtcatccctgggccctgttttgttgacttccctgtgttttggcagtggtttatttcttcttgcagttttgggtatctcataatttttgaatgagtgttggaccttgcaacagaaaaatagtagaggctaagtcaaatagtatttgttgagaaatcagcatatgtctctctctcagactttttggatcgagggttgcatcagtctagttattaactgaattcattttgggttttgttattgccatagtcactgttaactacaaattccttcaatagtgatatgctgttacccatgctttgtgtaatgtgaggttttgagaggattttttcacagtttctctgctcagccctcaggtttagaggtctcttctttgctgtgtcatggcatggggttatctctcttcaggctctgtagtagactgctgctatttattatttaatcctgggattgtggtgggtgtcatagttcttgatttttttgtccagcttcattttctggcagattctgtgagcctggatgtcagaggtggatctttctgtttttgctgtcttctctgtggtaaccaaattttatcttggatttttgggcagtttgggcatgagagagtttcctgtacatttcccagcatttgcagacctctgctttatactggtgtagtgtcttactctcaagtaggttttctatctttttttttccccaggagcatatagcttttgctttcaatcctcttcagaagcaatgaagctttactgagctcttaggaccagagaatttcctgcctttgccccaacggcatataggatttgtttctacccttcccccggtggcttaaattttttgttttgtattggagaatggcctagagaagtggcaaggttctgtgcttatccctcagtgcagccattaaccagctgcattcctgcaccaagttgggctctctctggtctgcagctgtagccccagttgtccttctgagaatccagggcaggacaatggaaaagagctgctgtctggagctcccagtttttctaaactatcatgctagctcatactcaggctttaagaatttaacatttcatctactttcttcttacttacattcatggcagtcatctctgctatccctgccctgccaaagctgttaacatttttgtgagtcctatctctcccagaaggatttatcactcactagaattcattttgcttgtttaccttgtaatctcaggtctctaaagggttcaagaaaagttgcaattgtctttttcagattggctgtttgtcattgttatgtttccagattctaaggaaaagtggaatactctcttcacctcttttttatatgccattcttgcatcttgattttcttcattcagatatcttagagtttttcttaatatcttggagtttgttgaagtcaagacatgactactcttttttgtatttgatcattatattcatcaaagtagtactcatactcaaaataatacatatataaaaaggcagaatttatacaagattaatagtataaaaactcaaggtttataatttaaaataccaaaatatcctgttctccttccctgccactggccatttctgcttcccctttgccagaggcaaccactttaccacctattgtaactatttattttattacttaccactatgggtagtttgtgctatctcttggtttctcatgtttaaatattatgagaagtaatataaaagtaaaaaaattaaatgtactttctgctatggaaaatgagggtttaactctggtacatactccacacatacacttttctacatctttctgtccccaaagtctttaccagtcaagcacatcatgcagtttttttcgttcctttcccaacgtacaccctacccaacccttagagctctttatcctcctcttgtattgcagattgatcgatatgcctgctgcagagctgctgttaaggttcttctcttcaccattatcctgaaaatttctctggcctctgtcctttgttgagttgactattttctggacagtttcccttgttcttggtttactttcttgttttaatggagtacatactttagggccttccctgtgaaggatacatgggaagtaaactttttttttgagatcttgtggtctgaaatttttttatatttgccacacacttgatagtttttttctaagctgtaattctaaattggaagtgaattttcacggagttgggaaggcatcgcacccttgtcttgtacctcccagcattgctgttaaaatttcaacacctgattcttcagcctgtatatgaaacttttacccttctcttccctctcgatgcttttctattttctcaggggttctgagatatgtgtattttatatgtgtatttgataaattgtgttggacatttgagttttaatctagaaattcatatactttaaactgagaaatttcttatttctttaataatttctttacttttatttttgctgttatttatttctgagatgccaatcttatggatggtcttgtggtttttcttttctccccctatttctgtttttgttgttgttctgttttctaggaagatttcctcaagtttgttttctagtccctctctgacattttcacatcagctattttatttttgatttcccagagttcttcctcattctcagaatattccttttaagccttcctattcttgtttaatgggtgtagtctttctcttatgtgcctgaggatttttttttttttttttttttgcattttttttcttctgttctcctcattatctttctgttcctgtggtttggaaccctggatgtgtcttctgaggggcaaatgagaaaagagtcttggaatcttatttttcagtatgaaaccttggaactcccatctccttatttgcagggtgacacatggatttcaccctcaactatgcctggtatccagagcctctctgttttagcctctcccaacaggaaacccctattaggaaggggtaggcacctgactgcatggggtcaaagagttgatagggagatttcataataccttgaaaagacttccagacaaatctttctgtttcagccccttccaggattcatctttaaatgtaccaggtgtactcctaattctggaggctttctagggttctgggtgacacatcaccttactgtgagctctttgttggcttcttcctctgcaggttaggtttcagttactcacatctgctaagctagctacaacttcttcatctgctttccactttccagactttgacttacctcctgctgttgcctcctatatttgtttgctataaagaactgctagagattgggtaatttataaaggaagaggtttaattgactcacagttctgcagggctggctggggaggcctcaggaaacttaaaattgtgccaaaaggcacctctttatagggcagcaggaaagagaaatgaataccgagtaaaaggggaaaccccttataaagccatcagatcttgtcagactcattcaccatcaagagagcaacatgagggaaccacccacttgattcagttatctctacctggttccacccttgagacgtggggattattacaattaaaggtgagattttggtggggacacagagccaaaccatatcatctccttttatatttctcgtttgtgtctgaggggtacagtagaagaaatacagaaagtaaggattgggagatgaactgtactttgtgcttgctgggtttctccttttcaagagagaagttctcgtagtaattactttgacctcatctctcctgacctcttccccttactcttcaaacaatgatctttaaaagaaagaaattttgaagttaggcatagctctcagatgaaaatcatatgttacctactggataaattgtataatatatacatgttttgagacggagtttcactctcgttgtccaggctggtgtgcaatggcacgatctcagctcactgcaacctccgcctcccgggttcaagcgattctcctgcctcagcctcctgagtatctgggattaccggcatgggccaccatgcctggctaattttgtagttttagtagagacggggtttctccatgttggtcaggctggtcttgaactcccgacctcaggtgagccgctcgcctcggcctcccaaagtgctgggattacaggcttgagccaccacatccagccaattgtatagtattgaggtaacataaggtaagaatagaagaaattagtttagtcaaataaaacagattttattaattccacttattaaaaatgaaaaacttgtttagaaagactagaatcctgtggctaattgtagaactgctccaggattctggaaacgtaattatttctctaagaacctaaacagttgtcagcactttgataagtacaggctatgttttggaggtatgaataaaattaaaagtatggtaggaatgtaaaagaaaaattgaacatactttgtttctttctgttcaccaggttttcatgtgaataattattttagctgcttttcaaaatcttttaaatttctttcatcccttggaactggtctacttctgttttctctcatttgtttttgcagtagtcctttccatcctggccgtacctttagagcattcttcttaatagttccaaactctgttcttcatctcactgtttttcttttcattcttagatggcacagttttacttaatctgtaacttttttgctcattcctttctttagcttcttttttctctcctgataatggcagtacaaaggtagcatgattactctcctctagttagaagatgtagtttgatgtcctggcacctgtgcatattatctgtgtgaccttagagtaattacaggaactctaaccctgtttgcttgtctgtaaaattgaatgttaatatcacttatcttaccaaatttttgtgaggatgaaaatgagataatccatatttatgcaaaacacttagcgcattagcaaccccacttttaaatcttcagtgttagctattagctattactactatcagtctattttattacatagtaatttctctcttgtgaaggatgcctgtgttagcattttgcagtcaaaggttatagcagcaatctctcaggatggtaaatgttgatgaagacaggaatttgtgttttaaagagataaaagagctaattagagagagaaagagatgctccctagttcatatgaagctgctggttgtttctaacatactgtcaacttactcttcaggattctttattttcagttttgcttctgctgtctgccactatatatttccttgtcaccctaagatgtatgattaaaaaggaatgaattcaataagaacaacttttttttaaaaatgaacatgggtaaactatttgcagcaattgtattttgtgtttatatctaggcttaattatctatttgacctttgaccgttaacataaatataaaatgctgatcatcataagagataagttaccagctgtacagaaagataatataactaaagtcacttattaatttgatttgaatacttactacttcaaagcatctacatttcagaatgtattttataccaaacactaatcatttggcaaaagtcagaatattacatgttttgcttaaagttaggacttagtttgcttaaagttaggacttaaagttaggacttagttttcaatttttttgtatatgtcatttttttatttttttattttttttatatttgtattttttgtatatgtcattatagcagtatttggtgacccttaccataggacttttctagatggacatagtaacatttttgtctacagaaatgtttgattgttaggttgttaatttgacctcgggaatcatacaaaagctcttttggtcacttaagcatttgtggtgatgattattatttactattttaataagatttactttttggccaggcttagtggctcacacttataatcccagcactttgggaggccaaagtgggtggatcatttgaggtcagtagtttgagaccagcctggctaacatggcgaaaccccatctctactaaaaatacaaaaattagccgggcgtggtggcaggcacttctaatcccagctactcgggaggctgaggcaggagaatccttgaatctaggaggtggaggttgcgatgagctgagaccaagccattacattccagcctgggcgacagaatgagactctgtctcaaaaaaaaaaaaaaagatttatttttttcaccacctagctagagcttacattctaataatacatatattgaatattggctttatgccttgaattataaatttacatgatcagacaaaagtagaaggacataagtagatttaggtgcagaaaaggaataaatgatacccttcatgttagtttcttttgtagccatcatcccagggtcaaagatagagataatatgcagaataaccatgtgagaggactttgcctttgcttaattggtcacctttttttttttctttttgaataagcttgtttctctggatttgaacgattgatttaatctttcagacaggggaaaacaaaggatggagtggtccaaagcctgggtttcctgaaccaacaaataatagtaagttctcatttttatgttgtctgcacttggtgttcatcagtggctcagtgactagctgtcactgggattggttgggtctgtctgggtctgagaggctgtgttaagtattttggagggtacaaaggagtcctggtgtttgctttcctggaactgacagaatagctggaaaactaagacacagatacacttaacacagttaagccattgcagacagactgccatttaatacatgtagtgatcacatgcttttttaaagttgccatttttattgaaacaacattataaaaaatataaaaatataaaaaataatttaaataatataaaaataatttttataataaaaataaagaagtaattatctataagctgattatactgtcaaatcaactttcaaagttccaattattttttatgcacacaaatttttatataattatgatatacataaaattttattgttttcacttaacattgcctaagcattttttgcgttttgctgagtcattagaattttaatattttattaaagtcactaagtgaaatgtcagaagtgtaagaataaaattgctgctttgttccacttacagtattgtcaaacacttaaaaaacaatttcagtttactaatttttttcaaatgtatatgatcaagatattttacattggacgtttagacatttttccttaatactctccctcacttcctgaaaagtatctatttcactgaagttaacattttactgtaaatcagtgaatcaaaacatttggctagtaaaaacacccagtctatcccatttccaaccctatctatcttctttacaacctctgggcactgaaaaagcttaaatctgtaaattatcgtaatccatggttttagtctttgatattagtggctcgtctcttgatgtataatgaaattagtaacaaattcttatcaaagtatgctcataagaattgaattcttggattatcaaaactagcctcttgaaaagaatatttcagtgaggtaatggcattttggggctgctttctgggaataatttaaattaatgtgcttctgagcccttggcctgtataaataggggtgatgaatatgatggccttagcacatagcccaaggaaaaaatggaatcagttcaggattcctagagtttgtgttcagttcctttgatgtttgaatatattggtttataatgatttggtgagggaatgtaataaacatgaaattgattgcagttttatgtaaagtacttagcacagtacctgtttcctagtaagcacgtaatgaatgttgatttccttccatgcctcctccctcttgtcttttataaaaatgatactattctatgtaggcgtgccagaaattccattcttatacttttgtctgtcagatggtttgtgcatacatatggtgaccaagaatatatagcttattattgaatagttacattcaggcactaaacttttttttcaaagaatataaactttatgtattttaatataaagatcaaatagttattaacttgacaattttaacgtgaaatcactttatagataacctgcaggctccatcattaaacaatgatgttttggcccctagctttatgtgtttgtttttttttaacttgctaagggatacatctcatgggatgacaagtgggggatacttctgtcctgtgcagacatgggaaggaatatcacaaagaggccagtgagtttaagtgatcagaaatgtgtaagaatgcataacgggtttgcttgagacataaagttagaagtgagaaaactatttgaagccagcttaaatcttaaccagacggttaatgctttaggaattcatggtctacaatggttcagattaaggctttgaaataagaatgttctgttatctcttcccagctgtaaggaggtgagaaagctgctctaagagttctttgaatgaacactggattgtcccttccttggattacgatagaggataagggcagcccagctctgaaaagtagctgtttcattccccaagggttagttctcacaagtgaaacctgagtccccttgagccagctcattggcacttaaatacaacattaggaagaagttggactgtgcttaggaattgatcattcagatgatggaccaattagctgaaaattaatttaaattcatatattatggtaatatttaggttaacttcttaatcagtttcttaagtttgaaattctattctaaatggtttctgtcctgtgaagaataccagagttagcattttgcaggcaaaggttagagcagggatcttgtgggatggcacatgtgggggaagacaggaatttgagattgccagtgctggctgcctcactgacatactgtctgaccttgaacaactcaatttacatcttattattcaattttctctgttaagagttatgcatactaatttataatgttgagaatctttaattatgtaacatttataaaatgattacccatccttgaataacatctgaaaaggtaacatattactttgtgaaaaacactgtcatcatgaaatggctaactcactatggttttttgtttgttatgttttgttaaactctacattgcttcaaaattgtagttttaaagatcaaatttttagccacccattatttggataaataatacgaaattagcttggaaccataatgtacaaaaatgaaaagggaatgtagaattggaaaggggaaagaggggaattttaatctggcatagcacctaactataagtagacaaaaaacattaatgtacatgtgcatttaattttttaagtggaagatattttttaaaagattacagtcataggaaactgctaacaattacaactagaaaatagtttaaatggttttgcaagtgattgtgattacatagcctggttcctcaatttattttccttgcttgattgcctgcagatttaaaatatggacctagtttttgggtgctgctcaggctttcttcattgtactgaaatgcagcagaaggtagactattctaagtgtgtttttatcctttgaatcactgtaatagttatgttgaagaataaaaacacataactctgtaatgtgaggtttatgttaagtttagcatagggcaattttatgcttggtgtacacataaaaaactagatttttacagatgaatgaataacttttttaaaaaaagatcatgaattttaaagatctactgacagctcacggctcttggaaaactttgtaaaatatttagatacagttcagctgataacatctctttttgtattcacattccatgtttcttattaatacaggcttttacttaaaagcaggttcatagtttcttgaaggtgaactgtagcttaattcaagattggactaagctcaaaggtattcactggtatgtgccaaatccacccactaaaagattattcggaggcatttttcacataaatatttttccgttaaccttttaaaaagttttatttagcccctgtgaaatatgctggcacttgtaggttcattagagatgaccaaagacaaatacttgtggaatgagatagcattcttattgacctctttaggatcttagttgacttaccaatatttttgtcacttttgtttcatatgcatgtattattaaacactgaacatcctgaaaccaggaggctacactgtcccagtgatatgacattgggtagattgcctgctggtttcccaaatgctatgtactatatttagaacctctagtgtttttttggtttttttgggggggtgggtaggggtgggagatagaagggaggtatataagtgttggacttttaaggtgacagattaatatatactttctttaatagtgttttgagagagctccctgaacaaattccctttggggttcccatagtagaaaccactttgtagtgagacagttaaaacagttggagccaattggatgtaaatataaagctgagtgatccaacttaattatttctttagacataaatactgtgttagaaatgtaagaatgtagccagcttttagtgatcttatttagaaggattggtgggttacttgtactgggcagcccagtccctgaatatctggttgttttcaaacaaaggtcccgtaaatagagggctatctgaagcaattgggagcaatgggaacatacatattctcattgctgtccatttgagcctgcaggtagaattgctgcttctcctctgaacacaggaggaaagatccaaatatttcagaatgatatcatccttcttttacattgatgactgtatattagacctacctgagtggtgagaagctatagtctttaaaaaattacattgacaagaattctcctttcttgcctactgaagctaggaaggaagattagaggtaatgttaagcttgcctctgttttagtcataccagttgagtctgtctctgaagatccattgatttaaaggaaaaagaatctgaaattagagagtaagtttttaatcagattagcacagataacatgtttttctgcaatattctccggaaagatttaatgaatttaaattgtgattttaaaaactcgcttggctcatttttacatgtaaaaagatatcagatacattttttttaaaaatggaaataatatgagcatttttaggatgcatttattcattgcagtatgatagtttttctaagcataagagcaacggatgaaaccataaagtaaaaaagatggatttatatacgtaaatgctaaaaacaagttcaaggagccgcataagaaaataaaaaggcaaatgacagtataaattgcagcatagcaacaaattgaatatatgcaaaggacacataaaagtcaattttttaaaaaaaggcaaacaccccaatggccaaaggtcttaagaagacatttaaaaagagcagataagaaatcatgaaaaaatgtttagcaatcaggaaaatggggattaaaaataaatgttatgaaatttctgatccacgcaaattgtcagggatttaaaaatgatacttccaactgttggggaaacagactgtcacatgctgctgatgggactctgacttattgtcattctgaagggaattagccataagtatacagagcttaggcccatttctttgtagggcttggctaaaacatacggaaaaatagattagttttccataatgaacatatactggttttataatcagaaaaaaatgaatatttaaaacacttacatttacaaactttggcctgaaatacacaatctgactgcatttaaacataaatattatatatatgtgtgtgtatatatatatatataattttttttttttttgagatggagtcttgctctgtcgcccaggctggagtgcagtggcgcaatcttggctcactgcaagcttcgcctcccgggttcatgccctctcctgcctcagccttcccagtagctgggactataggcgcctgccaccacgcccggctaattttttgtatttttagtagagacggggtttcattgtgttagccaggatggtctcgatctcctgaccttgtgatctgcccaccttggcctcccaaagtgctgggattacaggcatgagccagtgtacccggccataaatattatatttaaacagctagggaagcagaattatctgtatactgaagtcttgaggaaacttttctgaaggtaaagaagaagaaacagttttctagagtctgaatgaaatttcaatttctgaaatgtatgctgaaatttagaatatgtactgtgtattctaagaggtctatggggatcaaaaggtgtttaaaattagtcttttcaaaattaggagcagactgtaatgataacacagataaatatcttgcagaaattcaaagttgaagtattaagaactacttaattgcttttctctgttagcaaagaaactttacagtaagcataaggagaaaataaaggtaatgctcctaattactcattcagtttgtctagaaagatggagttttataaaatcttaaagtgtattacaatttgtgaagaaacattaactgctattatttttaaagaaaaataggcaatatttgatgcataacgtatttaacacttatataacttatgaagcaagataatgaacacccatgaacccaccgcccaatttaagaactagacattaccaatatatttaccttcacctttgttctcctctttcatatcccccattggctatgcctcccccagcagaagtagccactatctctgaattttatatgtagtcgccccaccctttattcctcataatttcatcaaataaatgagtccttatcagtacttatttaattttgcttttttttttaaactttagaaaaatagcgtcgtatggtatattgccctctggaattctgccctctcccgccccccacttaagattgcaatttaagattattttgttttgttacataaagtatttcatccactatgtgaatatcccataatgatttatccattcatctgttggtccacagttgggatattttcaggattttgtgattataaacaatattattatgaacatttttgaacatttctatgggtgcacatgtataagagtttctgggagtggaatataatatgtgtaagttcaaatttacaagaaataccagttgtttcatagtgggagggcccttcaaagtatctaattttccatgctgtaacaagtagaaatcttttatcgttttttaccttcaatttcatttttgatgatgaatttagttgaagtttagttcaaattccactatttcattaattttatttttcattttctatttttactggggtttttaaatggggaaaaattaaaaatgcaaaacagctctccgtattttttgtcctcattagtgcagtggccaccctgaccttcaagcaggtaacttgtggttgtttttttgtgtgtgtattgtcccagaatttatatatatgatttatatacatatgtataaatgtatatacattttatacacacatatatacacacacaaattcaaatatatattattcaatcccctagccttttgaacatgctgttctacccattttattttagcttaacagtatgtcctgaagatcctttcctattgatatgtatagggatttattattatttaatcaatttttcacagatggatatttagattgtttatagtattttcctattatctgccatgtaaaaacctcatacataagtaattttacgtatgtggtagcatatttgttggagaaattcctacaaatggaattactccattacagagtatgtatccttttaattttgatggatgttgccagagtactgtcaatagacagcagtttacgtctctaccatcagtgtaggagatttcctgtttccctacagcttcaggaacacagtgtgctatcaaagttttgaatctttgccaatttgatagttgaaatatggtattcagtatagttttattttgcatttctcttattaagaatgagactatgtatttggtagatctatgagccatttctatactttttctgtgaatgacataaccatatctgatgtccctttggacattagattggttagtctttttctctcttttttttttttttacttggtaggactgtgtgcatctgtgtgcctttatgacatgaaaattcttctctgttttcttttaaagtttggtttttctttttaatatatttgaatgacattttaaaatagtcttttcttttatagcatgtgtaagttgggtataataaataatacctttccgactctgaaattaaaaacatttctttatttttattttattttatttatttatttattttattatactttaagttctagggtacatgtgcacaatgtgcaggtttgttacatatgtatacatgtgccatgttggtgtgctgtacccattaactcgtcatttacattaggtatatctcctaatgctatccctccctcagccccctaccccatgacaggccccagtgtgtgatgttcctcaccctgtgtccaagtattctcattgttcagttcccacctatgagtgagaacatgccagtgtttggttttctgtccttgcgatagtttgctcagaatgatggtttccagctttatccatgtccctacaaaggacatgaagtcatcctttttttatgactgcatagtattccatggtgtatatgtgccacattttcttaatccagtctatcattgatggacttttgggttggttccaagtctttgctattgtgaatagtgctgcaataagcatacatgtgcatgtgtctttatagcagcatgatttataatcctttgggtatatacccagtaatgggatggctgggtcaaatggtatttctagttctagactcttgacgagtggccacactgtcttccacaatggttgaactagtttacagtcccacctacagtgtaaaagtgttcctgtttctccacatcctctccagcacctgttgtttcctgactttttaattatcgccattctaactggtatgagatggtatctcattgtggttttgatttgcatttctctgatggccagtgatgatgagcattttttcatgtgtcttttggctgcataaatgtcttcttttgagaagtgtctgttcatattctttgcccactttttgatggggttgcttgatttttttcttgtaaatttgtttaagttctttgtagattctggatatcagccctttgtcagatgggtagattgcaaaaattttctcctattctgtaggttgcctgttcactctgatggtagtttacttttgctgtgcagaagctctttagtttaattagatacccatttgtcaattttggctttgttgccattgtttttggtgttttagtcatgaactcccttgcccatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgtcttttctctttattagtcttgctagcggtctatcaattttgttgatcttttcaaaaaaccgcttcctggattcattgattttttttgaagggttttttgtgtctctatctcccttagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctatacactgctttaaatatgtcccagagattctggtatgttgtgtctttgttctcattggtttcaaagaacatctttatttctgccttcatttcgttatgtacccagtagtcattcagcagcaggttgttcagtttccatgtagttgtgtggttttgagtgagtttcttaatcctgagttctagtttgattgcactgtggtctgagagacagtttgttataatttctgttcttttacatttgctgaggagtgctttacttccaactctgtgatcaattttggaataagtgcgatgtggtgctgagaagaatgtatattctgttgatttggggtggagagttctgtagatgtctattaggtccacttggtgcagagctgaattcaattcctggatttccttgttaactttctgtctcgttgatctgtctaatgttgacagtggggtgtttaaagtctcccattattattgtgtgggagtctaagtctctttgtaggtctctaaggtcttgctttatgaatctgggtgctcctgtattgggtgcatatatatttaggatagttagctcttcttgttgaattgatccctttaccattatgtaatggccttctttgtctcttttgatctttgttggtttaaagtctgttttgtcagagactaggattgcaacccctgcttttttttgtttcccatttgcttggtagatcttcctccatccctttattttgagcctatgtgtgtctctgcatgtgagatgggtctcctgaatacagcacactgatgggtcttgactctttatccaaactgccagtctgtcttttaattggagcatttagcccatttactaaaatctctcagcatttgcttgtctgtaaaggattttatttcgccttcacttatgaagcttagtttggctagatatgaaattctgggttgaaaattcttttctttaagaatggtgaatattggcccccactctcttctggcttgtagagtttctgccgagagatccgctgttagtctgatgggcttccctttgtgggtaacatgacctttctctctggctgcccttaaaattttttccttcatttcagctttggtgaatctgacaattacgtgtcttggggttgctcttcttgaggagcatctttgtggcgttctctgtatttcctgaatttgaatgttggcctgccttgctaggttggggaagttctctgggataatatactgcagagtgttttccaacttggttccgttcttcccgtcactttcaggtacaccagtcagacgtagatttggtctattcacatagtctgctatttcttggaggctttctagattggggaagttctcctggataatatcctgcagagtgttttccaacttggttccattccccccgtcactttcaggtacaccaatcagacgtagatttggtcttttcacatagtcccatatttcttggaggctttgttcatttctttttactctttttttctctaaacttctcgctttatttcattagtttaatctttaatcactgatacccttacttccacttgatcaaatcagtactgaagcttgtgcatgcgtcacgtagttcttgtgccatggttttcagctccatcaggtcatttaaagtcttctctacactgtttattctagttagccgtttgtcgaatcttttttcaaggtttttagctcctttgcaatgggtttgaacatcctcctttagcttggagaagtttgttgttaccaatcatctgaagccttcttctctcaacttgtaaaagtcgttctccatccagcttttttccgttgctggcgaggagctgtattcctttggaggagaagaggcattctgatttttagaattttcagctttcctgctctggtttctccccatctttgtggttttatctacctttggtctttgatgatggtgacgtacagatggggttttggtgtggatgtcctttctgtttgttagttttccttccaacagtcaggacccttagctgcaggtctgttggagtttgctggaggtccactccagatcctgtttgcctgggtatcaccagtggaggctgcagaacagcaaatattgcagaatgacaaatattgctgcctgatcgttcctgtggaagcgtcgtctcagaggggcacccagctgtatgaggtgtcagtcagcccctactggaaggtgtctcccagttaggcttctcgggggtcagggacccacttgaggtggcagtctgtctgttctcagatctcagactccatgctgggagaaccactactctcttcaaagctgtcagacagggacgtttaagtctgcagaagtttctgctgacttttgttcagctatgccctgcccccggaggtggagtctacagaggcgggcaggcctccttgagctgtggtgggctccacccagttcgagcttcccggctgctttgtttacctactcaagcctcagcaatggcggacggccctcccccagcctcactgccactttgcagtctgatctcagactgctgtgctagcagtgagcgaggctctgtaggcatgggaccctctgagccaggcgcaggatataatctcttggtgtgccgtttgctaagaccgttggaaaagcgcagtattagggtggcggtgtcctgattttccaggtaccatctgtcacagcttcccttgtctaggaaagggaattccccgaccccttgcgcttcccaggtgagatgatgccccaccctgctccgtgtgctgcacccactgtccgacaagccccagtgagatgaacctggtacctcagttggaatgcagaaatcacccgtcttctgcatcgctcacactgggagctgcagcatggagctgttcctatctggccatcttggaacctccaatcaaaacatttcttttaagttatcttctggaactcttatagtttcattttttgaaatcttgaagtcttgatccatctgttacttatactgaaagtatggacccaactttattccccactgcattgagagttcactgttaccatatactaagattatgaatttggtattattccagactttctgttctcctctgttcatctaactatctatgtgccagttttaatcgttgtctttttttttttgagatagggtctcactctgttagcaaaattctgtcagttgtgcagtggcatgatcatagctcattgcagacttgaactcctgggctcaagggatcctcttgcctcagcctttcaagtagctaattttacaggcacgtggcaccacacccagctttgcccccactcccccgactagagacaaggtcttgtggagttgcccaggcttgtctcaaactcctggcctgaagtcatcctgccttggcttcccaaagtgttaggattataggcatgagccactgcacccagcttaatcattgagtctttcttgtgttttaacatgagtcagtttaaagtaatgtgtgttttaaacaaatgtgaataaagatgtacttggtctgtaatcttcttgcacgtactacatggagtacaagtaattgaaaagacaaaaatctccttccttggcaacagaaataagagatgtgagagtagtcaaagcatcaattatgaagcactaaaataagcaacagggaactaactgtatggttgaaaactattaaggttcaggaaggcagtgcagatagtttccctaaaacttctttgtataatgttaatgcatcattcattctttcatttttttagaaagtatttgtttattataatgtaccctttttggtattattgatgatttcagtagtttttaaagatgaaattgcttattgaaagacgagtccatatttaagataaacaccaccatcctgcccaactcccccctcccccccagcgagtaagaaaaggtgggatgcctgtaatcccagcacttcaggggctgaggtgggtagatcacttgaggtcaggagtttgagaccagcctggccaacacggtgaaactccatctctgctaaaaatacaaaaatttgccaggcatggtgtggcacatgcctataattccaattactcaggaggccaaggtgggagaattgcttgaacctgggaggtggaggttgcagtgagcacagattgtgccactgcagcctggaccacagaatgagtgagacttcatcttaaaaaaaaaaaagagagagagacaaatattatttgaaaaaaaaatcaatttttttaatcgttttttaatcgttttcttgttgcccaggctggagtgcagtggtgtaatctcggctcactgccacctccacctcacggattcaagtgattcttctgcctcagccttcctgagtagctgggattacaggcatatgccaccacacctggctaattttgtatttttagtagagatggagtttctccatgtcggtcaggctagtctcaaactcccaacctgaggtgatctgcccgcctcggcctcccaaggtgctgggattacaagcgtgaaccactgcgcccggccttttttttaatcttaaaaagtaaatcacatagcacagtgtctggcattgttggtgctcagtatttgagcaaatgcaagaattgcattttcacttttttccccactgtattaatgatcttttgagtagtttataacatataacaattagaattctaggaatttaggtgtgatccagacctgagattctcagcgtggtattgttggattcaatataataatggttggcataattagtatttcagcaacctaatggaagtaatacagttactcttagtagattgctttgctttggattagaattttatttgaattcagacctcaagatgttctgaatctcaggttggcagtctttgaaagatgatttattattacttaataaatgcagtctgtctgaaagacagatcctttaagcatggtatacatagaagaaaaacaacataaggaggcttaagtgtgaaaaggttggagaatgtccaacctcacatgttttacatacaggaaaattgaggctcagttgattttataacgggtctaaagacactcttagttaaaggtagtgaagacttgaactcatgtcttctgactccagggtctctgcagttgccactagacagcacctttatttctagatatatcatttgctggtaattaaaggaaaaaaagagaatagtgtttttaagaaattccattaaaattaagtacgcatttttttgaaagaatgttttatatatcatgtaccagaatctttttttataaaacatttaagatgttttattacatggaaaatgttcaaactattgtttcagataccagattgatatttgggtggatcatgtaaaaacactaaatggctgagaaactatgtgaaatgtttgttttaactattattacatcagtgacacagccatctacattacttgatttttcttaagatttaaaaaaactttagtaatagtcaaatttaaaaaacactcaacaggctttttgggtgatgttattcaagtgtgttcttttattccaagctttctggtttgtgttaagatgattcatagattattagggctgaaagaaatgaaaagttccttaagactaattcatcttacagatgaagaaagcatgataaggagaatatctgctgcctcaactcaaacccagatagctgggctccagtctggtgcatttaccaatgtactattgttgtttttactttattacattttgtgttaatacagaacattagacttcttttttttgctttaccactaaaaaaattaaatccagtaagttcttacttaacatcattgataggttcttggaaactactactttaagtgaaatgacatataacgaaatcagttttatcataggctgattgatataaacaagagttaagttctcacaacatatttgtggttagagaaatatcaccagacttctcaataaagacccaaattgtaatattaaacattgaaataaatatgagcttacatgtacaattaagaaagtttaataaaaacaagataattgtttactcaatgtggggtgaataagtgagtgatagcagtcatggtggtggtgggttaaatcaaagtataaatgtttgcaaagtgaaaattgtaagcagtacttcctaccaccacacaattaaaaaacaaacaataacaaatatggtgggctcactgaacacttttatactgcattgtttattgttgtgcatttgtgtaatgtattagtctgtttttgcagggctgtaaagagatacctgagactgagtaatttataaagaaaagaggtttaattggataatagttctgcaggctgttcaggattttgcttctgggaaggcctcaggaagcttacagtcatggcagatggcaaaggggaagcaagcacatcttcacatggccagcaggagagagagagcaagcaggggaggtgctacacactttcaaacaggcaaatcttgtgaacactctatcaggagaacagcaagggggaagtctgcccccatgattcaatcacctcccaccaggcccctcctccaacactgggactccaattccacatgagatttgggtgcagactcagagccaaaccatattatatgattattgtgcattttacagattttaattttacattcatttgtatacattcagtcattcattttctaacccacttattccagttcaggattgaggttggtcagagcctatcctagcagcttagggagcaaaggcaagaaccaactctggacaggatgtcattccattccaggacacatgtgcacacgcgtgtgcgcacacacacacacacgacacccatactgggacaacttagacctgccagtgaacctaatatgcatatcttttaaatgtgggatgaaactggaggacctggagaaaaccagtgcagatatgggcagaacatgagaactccacataagacagtggcccaggtgggatttgattttttttctcatcaatattataacaaaatgatgttgaacaaaacaacattatttgaggacccactgagtatattttcttttttttttaactttcattttttaagttcaggggtacacatgcaggtttgttatgtaggtaaactgtgtcatgggggttgtcatacagattatttcatcatccagatatgaagcctagtacctgttagttatttttcctgatcctctacctccttccaccttccaccctccaccctccacccttcacccttcgataggctccagtgtgtgttattcccctctatgtgttcatgtggtctcataatgtagctcctacttgtaagtgagaacatgcagtatttaatatctgttcctgtgttagtttgctaaggaaaatggcctccagctccatccatgtccctgcaaaggacatgatctcattcttttttatggctgcatagtattccatgctgtatgtgtaccacattttcaacaaatggtgccgggaaaactaaatatcccaggtatccaaaatatgctggctctgtcggcactccaagtgaagcaagacaaaaattagtcccttgggaagccctctgaaaacgtaaaatgttggatgcacattccactcacctttaccccaagggagaagttgtgatctggaatgctctctcccggcactaagctatgtggcactaagctatgctgacttaggggggtggtgtgggtaaagtgaaattgttcttacatgtttcagtgtggccattcttggctttgtgctcatctgggatactgcaacttcttaactggattctggaattctcaaaaaggtattttggtctgtatatcattgttaaatcaatgtatgagttaggaataagggctgggacttcctgttctaccatcttgctggtgtcacccaagacttcttttttattaaactttttattttgatggccaggcatggtagctcatgcatgtaatcccaatgctttgggaggttgaagtgggaggccaggagcttaagaccagcctgggcaacatagcaagatcctgtctctacaataaattttaaaataattaataaaaattttattttgagaaaattgtagatgcacatgcagttgtaagaattaatacaaagagatcctatggaccctttgccttgtttatctctggtaacaccttgcagaactatagtacaatatcacaactaaggtattaatataaatatgatacagaacagttctgtcaccatgagagttcctcatgttgtgctgttatagccataccctttcccctacccccagccctggattgagtggaaattctggtccccatatggtctccactgacaccatagtgaggtgaccttgttcccactagttctgattctcctttattctctcctgacaccactccagcacggaggtggggggcatcctattactgctaggtgggggtagaagtttagtgtccctacatgatctccactgacaccacggggctaggatgaaagtccaagctgcctactcagttttttctgacactaccacatcagggaagttggggagagttgttacagctttgcaagggtgaaagtccctctctgcctttgatacatagataaaagtgggagaacaggtttttttgtgtgtatttggctggactaaggtgtgttttgtctaaattttatttcttgctaggcttcttctttcctggttctaaaaagtgaatttgttatttttacaagaaaatttaaaaattggataagtactttatatatatatattattttaaaaatacagtttttgagatgaggttttgctgtgttgcccaggctggtcttaaactcctgagctcaagcagcccttttgccttagccttccaaagtgctgattataggtgtgagccactgcacccagcccagtacttaatatttatacagttccagttagttgtttttattaataatattgtggattcttccataagtttctgaataatatataatagactgaataatagactaatgtgtagtaaattgttaaatcataattagatcatataaggagaattgtaagaaagtgttttgtgggttaagttctttcatcctaaggctgtgcttaagtttttctttgtgtgaacctaatatttgaatttattttcttcccacaaacaaaattgtgaaaatagccaagtgcattatttttacatttttcccaatgggtggttttacagtgagaaaaatctcagtctctctctctctctatcttttttaaagagacagtgtgtccaggctggagtgcagagttgccattatagctcactgcagccttgaactcctctgctcaagggatcctcctacctcagcctcctgagtagctgggactacaggtgcatgccaccatgcccagctaaagttttaattttttatggagacagcaccttgctgtatagcccaggctggttttgaacttgtggcctcaagtgatcctcctgccttggcctcccaaagtgttgggatcacaggtgtgagccactgcactgacctccatcttttcttttactatgagaggggagactgaggttcattgagcctagaaaataggtctgaaatgaagaaatgaagttcaatatcttgacagtttcttgtctctatcatggtgttagaatatttcaagaatctaaatgcccagaacttcttaaatgtatagatataagaacagtagttcttggtttatttgttttactactgaaaggtagttatacttgctgactgtagccagatgcctggatactgccccaacacctgccacttactggctgtgactttaagccagtcatatcacctgtgtcttagggccttcaagtgtaaaatgggaatattcatagtccctacttcttgagggtcattgtgaggattactaaactaatatatgcaaagcatttggaacaagcctgatatctagtaaggactctatgagttttagccagaattattattgttattgtattgtactattattgtattgtgagccgtttgcaggtattgactaggaagcaataggaatcctggcagaggagtattgtggtgcagtgtttggaagctgctgcggtagacatttcagtatgtgtttcttcctgctgagagatcaggtcacttttgtcatatgtcagacttatataatccattttttggtgtttttctgtcgtagggaaatcataactaatggagtttttctgagaagaatcataaccaagaagaacgatctttattttacgagcaacattttaaccccacttaaataaactaaaaattgaagatgactcattatcctcacaaggtgctctcaaacatcattttcacagcaactattttgtcttacttggtagaaatagtcacagttgtgtctttattgaaaagctgagccttgaaaaaaatttcttctaaataagccaactaagtgaaatcttccttattattaagatgagtggtgaatgcgcttctggggaattcctgaactccccaatcacttccctgcaccacactgactctgagtcatatacaatgtgcactgcccttgttgtgaagtcaacctatttcaaactatttaggggcccttggatcactattaataacccctgtgccagactgttctttgatttgcatgactcactttgggctccagaatcttcttgttaaagaaaatttctggcaaaagtataagttactgcatttggggtaagggttaaannnnnnnnnnnnnnnnnnnntcaccataccccagggtttatattctttgttattaaatactttcccatttgcctgttttaaagaaaaaatagcagccagtcctgaatttgaaaactcactcgcacttttatttgactaagggtacaagctttccaaaggcatttcccagttcatcataaattgatctttaaaacatttttgaaaaacctttattgctgttatttctgttcattattggtgttttgaggaatatgtattatttactattttgtattcctccttcttcctcttggaggtgtgctggatgctatgtcatgacctgggattctgcctttttgggggcaagactggactaagtgcattttcccgttggtactgtgttcaccaaaaggcaaacatcttcctgaaaagttctttgtcagtaattttattcataaacattcaccaaattaagaacccttcacatacatcattatgttaaatgtagcaggaaaaaaaggaccaataaaatgcacaaattaataaaatcagtgcttccgttcaactctaagggtaagagcaaggttgattttcaccactgttcaggttatgctttttgagcacattaaaatacatcattttggccaggcgtggtggctcacgcctgtaatcccagcactttgggaggccgaggtgggcggatcacgaggtcaggagatcgagaacatcctggctgacacggtgaaaccccgtctctactaaaaatataaaaaattagccaggcatggtggtgggagcctgtagtcccagctactcgggaggctgagtcaggagaatggcgtgaacccgggaggcagagcttgcagtgagccgagatggcgccactgcactccagcctgggggacagagcgagactctgtctcaaaaaaaaaaaaaaaaaaaaaaatctgttcagtaatgactctttttttagtgtgtctttttcgtttccaaggtgattctgaaactgatcttaagaagaaacctctaacaaattatttacctatttttttattttttcattgttttgctgttagctaacattttctctttttagttttccacaagagtttatattttgcattgttgatttttgatttcataagtagtatatatttggcttaaaaattaggcagaactaagggtctgagggccttatctggaagaccagatttgcagtgagctgtgtgtaaaagaagaggtggagtcacttacaaatactacctgttcgatttgatcccaacaacagggcagcaggaagggggatttctgtagctcacatcagtctagtagctaaagatcatgccaaggatgcattccacctgtccctgaccttcagggacatgaccatggtggtccagtaggctcccttgggtcacatgtactcttaactaatacgtggcctcaggctaccctgggagagaacaaggtcccggctatgaggcccacactgtcatcaggatctcccttgctttcatgtagctaaaagtcaagcacccagagcctggggagccagggcctgtgcattaggcaaaggccgtgagcaaagttgtcaaggagcaggcattgccagtgccagccctgcttatcctcagagctatatctaggaatggtgctgccaccagtccttcccactttggtgtccccatcaccaccctgttctggggtctctatgttgagggagaggcccaaagcagcataaaacggtgctttcaaaaaaacttttaaaagtgtaataatgatagactcacaagaagttataagaatggtacaaagaggttgcatgtacccgtcactcagcttcttccagtggtgatgtcttatataactatagtacattttcaaaaccaggaaattgtcataatacaatgaactagactacagaccttacttagagcctaccagttctcatataaatgatttttaaaaatcactagagacagataatcatgctgttgttcataattttctcacatttcctgttttgaaccagaagcccctgtttctagttcttaagaatttttaattataattttttattgtgaaaaactcactgtagcaaagtgggcctgagtattattggatatttgggtatttataaacaaatttatagtccaacattgttgaggcgtaaattcaagctggcaatggaaacaaagttttttttttcaaagcttttctgtgaaaaatgaaaagaaattatttgttgtgaaatagctatgcccattccaaggacttccagagaaactgggagttccagtggagtggcagtaaccatttggatcagtggcattatctttcttgctgcctggcttgctgtgttttaatacctctgataccacttgctactcacaaacacttatcttcttcagcatctctgaaagaatcatgacatcagtgatcattgaaaggcaaggttctcctaagttcgcttataaaaccttttaagagctctccaattcaaaagtccctcttcaactcttcagtaagaactggagctccataaagatgctccaggaagatttgtgtgccagaggattcatatacccatctgaaagaagcacagatctactgagcaaaaacatgtcaagtgggtacaatagcctggtgttaagatatcacagtccctggcaactttagacctttaaaatcatgtataaactctgtatacttcagtgagattttggtgagctcatctctggaacatctagggacaaccatcatgacatgggtcatccttggaaccaatctgggcaaaccccgggcatttacttactggatttaagccttaggggtttggagctggtgagatgttgcatttagtttcctacctgttcttttaggaggctatttaaggtaatggttaagtattcaaactctagagacagactgcctggagtcaaattctagcattgctgcttattatccatatgaccttgggagagtttcatatcttctccatgcttcagtttttttcatctctaatataggaaaataataatgcccatttcatatggttgttatgggaattaaatgagaagtaaagtactagaacagtgcccatgttgtatctgcgttgtaactgtgtactgtagttatagactgtaccaagatgggagcatcaaaggcaaaaccagggacaaaagatagatgatggcagaatgggttcaggacctcttcagataaagggtgaatgaatataatggatgttacaagcctgagcgagggaagtgtagtggttgaagtccatgagcaaaattgaggtcaaagaaggcacagacctaaagtagctacatgagaaaaagtttatcctgagcagtaaccaaacaaaaataaattaacaatgaattattgtagagtggcaatgattatttagagtaactgaaacgtgttgtgggagaagtgtgggaaaacagtcacatcctactaatagaagtatgaactggggtagttttttgggagaaacctaattagcaaaataaggtccttaaatatgcataccctaaattactctttgattctacttttagatctttatactattgaaaagcgacttaaatttacaacaggaagatcctaagtgaattaacacccatccaaatactgttactgatgttcaagttaaaagtcattcagttcttgaccacataaatctatgtttttatgctatttctatgactagtctgttagttgaactctgtagaaagtaatctttatttgtgaagaaaagtccacttaggctttactgtagaataggagagcctgaactccacgttcttatgctgtgaggtaatgcctctcttgagtgtggagagcatttttgttgctttataatattgctattggcaaacccattagtcctgtataataacaatactgaagtaatgctgttaagtttcttgattttttaaattgagtatagaagttagaattataacatttaagttattctttaaactaaaatatatataatgtttatgcagatagtaaaaaacaaaaatcagtaatatgacactccatttgtcaaattggcaatttttttttacaactttattgaggtataattgaagtataataaactgcacataatgtctacagtttaatcagtcttgacattttcatctcaccaaaagatttctcatgcccttttgcaatctgtcactcccaccagctccactccccagacaaccactgacctgctttctgttactattgataactggcaaagatttttttttgagacagttgcctgggctgtagtgcagtggcgtgatcttggctcactggaacctccacctcccgggttcaagcgattctcctgcctcagcctcccaagtagctgggatttcaggcgcctgccactacgtccagctaattttttgtatttttagtagagacggggtttcaacatgttggccaggctggtctcgaactcctgacctcgtgatttgccagcttcggcctcccaaagtgctgggattacaggcatgagccacagcacccagccttaagattttttatagtaatttccaataccaaaataggaaacaagatactttcatatatctctgtgggcgtctgatattggtacagcttctttggagggcaatttgttaagtgtcaaaaactctaaaatatcctttcaactagcaattccgcttctaacttgaggaaataaattttcatgtgaataaggattgagttacaagaatgttcatcactgtgtttataattgcaaaaaactggagataaattagatgtctgataatatggaattgttttaagaaacagttcatataatgaaattttatacttttagtattagttgtagaaatatattgttttataaacagtgacaggatcatattttattcctatgtatttaacttgttttttcaagtaaacaacaactaaaaagtgcatagataaaacaggattaaaaacatatctttaaagcaaaatgttgaaagtaatgtcctctggctgatgagatttatcttaacttttttcagtacataatgttttcttgtaaaaaaatttattgaaattttttcctgattataaaaaaactaacacatgttaatgtagagaatttgaaagctaacataaaggaataaagaaaatacataaaataggattgatatacagtcatcccttgatatccgtgaagaattggtttcaggacaccttatagataccaaaatccacagatgctcaagtccgtgatagaaaatggcaatggcatcatatttgcatataacctatgcacatattccagtatacttaaatcttctctagattacacaacatcaaatattatataaatgctatgtaaatagttattatattgtattagttttaaattttgtatttttttttattgttgcattattttttattgtgtgtggggttttttgttgttgtttttgttgttgttgtttctctttgcaaatgttttctatccacagttggttgaatccagggatatgggactcatgcatgcggaggactgtctgtattattttaagctatttaaagtgtttttaaaaaaacttacaaaactcttttatacttaatggcatcaggataaagttccctggaccttggcccctgcgtgcctccacctgcatttgcaattctgactctctgtatgctcttgtgataaggcatggcctgaggtttcctagaacacaaaccctccaggtccctgcccttgctcctgctggccatctgctctcagtcctcttcctcctggactgtattctcctcatcctttgaaatttactgtcatcgtcatctccagcaagccttccctgagcttttagcacttctcctttcccattcccactgctctatacacctgtctctagtgagacccctatcacattgtattatccattttcgttcctctcctgatagactgagcatgacttgaggtcaggacagtattggttggtgcgatgcctgaagcttaactagcacaatagcagttggagcttaactaagagagtatgtgcatgtgtgtaaccgaacaatagaaataaagatgtgttgggatcaaacagcctggagtattggatatatctgtgtaactggagcatgggatcttcatgaaatatttcgtagatgaagatagagcgataagtaggagccagattattaagggcttcctaggttatcctaaggagtttgggttctatagtgtaactgataaactggtgaaagacctttaagtaagagaatgttctagccttggcaagatggtagaataggaagccctggaacacagcaattcaacaataatttataggcaatttttctttgtgagaaatccagaaaccagttaagaggctcctgtatgccgggtgagcatgaaaccagccagatcttaattggcagggaaatttaagataccctcatgccataatccctcctcacagtgcagggccatacaatcaggacaaccaccctccacccccagctcccagcttctttctgcctagaaggggaaagatgtataccacgcatccaatgccttagcttttctggggctacccagaggactggcttctgtctggccagtctcagagtgctgacaggacatggcatattttagcaaccccggggccaatgaagaaagaggtggctggtggtggtggtcactgtaaccatccccctgctcagcccagcacaaagctaactgttgaaaagcttcagctttcagctttttcctggagaggcaaagaggagcaccatgtatccaatgacccaacttatctgggagttgcctgaagaattggcttcagtcttgcttgtctcagagctctgatgggactgagacaagcaagggactgatgcctggggactgccaagaacaaagaaagtggattagactagcataaaagtttgagaggcctccagaatctctgtccaggctgattggttaggatcttctccagtatgaggccagtttgtgcagacacaaacacagagaatcaaggaaaaatgaagaaacaggaaaacatttcctaaataaaggaatgagataaagctctagaaactgaccctaatgaaatggagatatgtgatttacctgacagagaattcaaagtaatccttacaaacattcccactgaggtctggtgaacaatgcatgaaaaaaagtgagaatttcaacaaaaagaaaactttaaaaagtagcaagcagaaagcatggagctaaaaaataccataaactgaaaaagttaccagagggattcaatagcagacaatgtcaagcagaagaaaaggtcatcaatctcaaagacaggtcattggaaatgactgagtcagaggagagttgggctagcctccagcatttcccaaagtgttagctgttttattcatgctatgttaaaggcttggacaaaaagtaaactcaggaatcctgagttaaaccaagtcgaatagatttttgttctttgagttttctgattcttcactatgctaatgtgtatttttaatttcacaaaaggcatttgtattatgtaatttgcattattttcagtttttatttatggaaccattttatttggggaccatgttatagaacacattttgggaaatggacactgagaatactagcagcagagaaacattgaaagcttgaatcagaaggttagcatcaggagaggaaggggcaagaacaggaaattaagttgtgtctctcagagcacattctttatgagtggtgacttaccaataattttaaaagataatatcatttgagagttattgatacctgatcaaaagataagaataagcagtttgaaatgtggtttgaaacttctctgagacaaatgatagtcaaaggaaagtgcttctctaatatggtttaagctccatcaactaatgacatagcccccactcctcttgatttcagaacctgtccatggcctggcttgaattaatgcactagataatccctacaatggtcatattcttgagatgtttgagcaacacgataactacttgcttatgagtaaatcagagatggttgccaggagtctaggttgggtcatgagcagccacatggtagtatgagcaaagcaagttagagacagtgctagttttgagatgatacccatttgcttttttatgtgttcgtgagttagagttgtctgtgggacatccttgtggaggtgagaggatcactaggctgttgaatacatgcgtttgtacctccaaagaaatttggactgattcagcctttattttacctgatgtgcctcaattgctgtatgtgttggggtttcatgcctcttttatgagatataaaatattaaattgcagggtgaagacactgcacattcctgattttctgccccattatacttccacacattcagtttcccttgtccctttatagcttcactactacacataagtcccattgaaaccactttttttggatgtttttaaacctctaattttaggaaaattgaaatagacattattcacctttcaatagaagctgcaactgcctctacagtatgacaaagatacttgtttggcagtgtttctcatttctttgttactacaccaagtaaagccattgagttaataatgctatgtttctatttcggttattttaagtgtaataacagtgttcttcattttatttatagctccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctattgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtgcttaattttttaaatttgtttttatttnnnnnnnnnnnnnnnnnnnntaattataattttaacatatcttcactgtagtcaaccatgtaagagtctgcttcccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaacaaagttgttttaacttttaattttgtttcatcacccagtctttaatttgaatttataaattacaaaaagctactttgatcaactgaatgtaggtatccaagctcaaattcttttaaacctacaaaataggtaaaattattatacaattaaagttattaataaaactgacttaagagagcagaatgtgaccgaacacttacacattctcagcagttctgttattcttgtttggtctcacctaaagtttttatcgtattttagaatcgaaccttttggatctctgtcagaaatgaatgtttatttctttcaagttttatcaagtattaatacgttttatttatattcttttaaatgttttattcagtagttctgtgaacttcagactttgttgttcagcctaatcgtatgcttctgtaacttctacacattttataagaactcattcaaagttgtagtcctaccatagtgtttcagggttccttgttgtgtacacttttactataatggcaaaatgtttcaaaatcattcagctttttaaagaaacttattatgcaaaagacactcttgaaatgctgtgcatttgagctgaagtgaaagaatttgtttcatgttgtactttgcattattttaagttttcacatctttaatatgcttttctatgctaattatattagaaatctataaatataagtggtttctttgtttaaactagtcattaaaaattaggttgaaaatgaaagtggattattttagcaaatcgtcccttctagatggatttcatttcagtttgctattctgtgcctctcctgtgagcatcatccactgtaacagtgttgtttgtgaaaccttccgagtatagtgtaacaaactaggttttttccctcacataaataatataaagaaacacttagttggtgttttagttaaactataattagtttattgtccaaaatcagggagtgttttatggaggggcatttcattattgatcataatcatgccatttccagcaagatgagattgtccacttaaattaaaatcttccttttcaaatataattcacgctgaatacatttcaactcatatgcctccttttgtggagtttaatatgatgatagcaggtttttatagccacaggcttcttttaagtatttattttttaacaatatgacttagtataggttatattgggatggggctggtggaagtgggggggtggtggctggtctccctgagaatctgagaatcaacctttcacctatttattcttatctctcctatacctcatgttttccaatccatatagttatcatcaaggtggctatttgcagcagctttttttttttttttagaataaggtattcatttttgttaggagatcaatacaagtacaattttgtaaattcctcttaggagaatatggagaaagaaataatgcatgtacatacacacccacatttaggaatatagttgtctcttggtatctgcaggaaggattggttctaggacccccaaagataccaaagttcatggacgctcaagtcccttatataaaatgttgtagtatttacatataacctacacacatcctccttatactttaaatcatgtctagatgccttataatacctaatataatgtaaatgctatataaataatggttataccatattgcttttttgtggttttttttcaattcttttttaatatttttgatatttggatgcatagcccatggatatggagggcccaactgtgtgttttcccttatttttaatttgtcattgaaacataacttactgtgttgcctctgagaccaaatgttcatgtaggctattaaacaaatgtataaaaccataataaattacttagactacaatgagcaaaacacatttgtgggtttggtcagcagatactgctctgatttgccattaaaatcttaaaaattcttaaaaagctctcttgaatttgacctctactaccttccaaggacct

SEQ ID NO: 12741 - DNA, 110403 bp, Human
aaaaaaaaaaaaaaaagaaagaaagaaaatgaattctgaaatgtaaaagacttaaatataagaaataaagtaataaccatcatgcaaaaaaataggagactgtatatacaatatctggataaatatacctcataccctaaaaatagaaaagagctcttatagattgacaaaacaacaaacatgttaatagaaaaaaatgagtaagagaagtgaacaagcagtttacagaagatcaaattaattggtcaatagacttaagaaaaatggttaagtttattagtagtcagggaaatgaatcaatgaatattgattgttggcagaaaaaaaagtgaaaaaaaacccttctattgctaatagaggtacgtgggaaaaaggattatcttaccttagaggtatgatttttttcccccataatgttgctaatgtgatggcacaaatggtttccattcagtgagaaacatgttgtaatggaaacttcgtttatttgcacttggaatgctattgtgtgacatacatagcccttagtagcactgtggctttagaccactcacataaattcttgaagcctcattttcctcattgtgagatggagataaccagccttagctgactgctttcctctggggttgaataacagatcttgtgtatgccaggtctttgcaaatgatataatgtgatttacagaatattaggataggccatgagcttttcaataccagagtccaagaacaaattacataaacgtgtatatagaaggaaaatctactaagtgtaacttgcagtaaagaagagctttgtaaagaaggcttgatgtcttagttactttcattattggatctcagttttctgagcacagaacaacgctctccagtagaacttactgcagtgatgatgttctgtgatctgtatgctttccagtactagtcacatgtagtcgttgaacacttggcatgtgttagtgcagcagaggatctgatttatcgaattttaatttaactttcagttttaaaggctgcatgtggacagtaccatattggacaggaaacctaggctgcacacacttactaaattataatttgaggcagcttacaaccagatgccaaagaaattacaatcagaggtaggtgcagtttatatttgccaagactaaaatcgatatttaaaaaaatgtagtttgatgaactcaagatctgaataagtaaactattaacagaagatattcaatttgaggaaggaatttattcaaagactatagaagttgaacatttagacttctcagccggaagtccagacatgctggcctaggtgctttcccagatcagcttttgctttctttgtagattccttgctgccagtgcagtattcttcactcctcccaggttgtagccctggctcctctcttttctctgttttgattccctgctatgagcttcagtttattcttctacaaaatggatcaaatatctatcttcaaggaacctttactcttctgacattctaggaactttaaggagctagctgatttttcatggactgcatttcaggggtgtcgctcatgtggtgatttagggatcaagatgagaaaggattttgtagccaggagtctcatcctccatgtcaaaatgtctttccatagcatcaatcagtgggtggcctttttgaggtctgggagccttggtctgccctgacctttgcctacttgatctgagatatttttcagttgaagatcccacattcaactttgcatatttccatttattttatcatcaagccaaaccattttaaggctaaatattttttaaaaactactctgcaagctcatgttgtagctgccgtaggcttacttttcttctcatagtttctactgtgctttgtgtaagatagttggaaactgtcattatttaagaagaaaacaaagagcttactattttacaaagagcaaagacattgattgttgatatatattttcctgaagttttacacatctttttgtctttttctttttagagtcctgtgaagataaatcagattagcttggatgaaagtggagagcacatgggtgtgtgttcagaggatggcaaggtatggcaaagatgtggtcatgcagagagttctgtggcgccagccccaggtgatcggaacagcaccttgcttactatataactgcattaagacaatcttgattattctttctgagtattgaacttgcttctgattggtcataattgaagtaaaatatattttgcacaaatgtgccttaggaaaagtaattacaagaatgtcaataatgtaactagtattaagctgattaacagctgtggcagggtgacgtgtcaccttaatcattactaccgtgccacttctgcttcagtgactagtctgcagttcctgcaagacagtagtttaatgtctttctgccataaatccacaaaattggattttgtgggcatgatttctgtgggccagtggttttcattttcacacacaagttatgaatgtttctcttgaattatagaatcttttgataagcaatcatagtttatcagaagaataaagtgtcttacaatggccacattaaataaatgtaaaatcaatatatgtacagttttctaaaaacctggcgcctacttcctcgaccaaggacatacatcatttgtgcagtgtataactaacaattatcagtgcttcttgctgatgttgagctgtgacatttaatggttgtggtgattgattttccacttataagaatgtcttttttgtttttaagtcgatggaaatcttttctaatgttggtttgcaatgataaaatcctaatgcacagtgtatttaagctacttttctaaaataacagtttgagagagtgcattaagaatcattatagatctttacatattccttactgagtaaagcagatttcctaatctaattttgtatttattgtgtgccctaaattcagtgggccattaagatgggtaaattaaaaacagtatacccggtgtaaaagagatatacccatttaatctgttaacaaaaagcaacatgaagtctcttgacatacaagaatgcattttatatatctaagcctaatgttgcccaaagagtcttttgaaacagtaattggaacactagtgcttttcaaaaagcactgtcaaattttacagtactttcagaaattctgagattgtcatgattatcagagagagatgaaggaggagttggtttgtgcagaaatggagaagaattatccacaccgctgaaacattttttgtgttcatgtatttgtaaagaaagataatcttcattttgttttcttaaaggtgagaaattccttttgggctgtaatcagtttaaccgaactaatttgttgaaagatagtactcatttttattaaaaattggaaacgaatttttactaaatacttcatctaggaattttcagagctttaaatgttgaagaattgttatttaatgcaccaaagtggaatatgttagctactccatctggtggataagatgaacctcagattatctcatggtacccttcttgtcaaacacctttggtttcctattttggtaaaatttatagctgcctattttagtgtggaaccatgatatatttttggaaataatcttcccgtatttttattaacattggtagaattgaaagtaaatcttttagtacacataattacatgtaagctacccccttaccatgggttagtcagtattgtgaaaattgagaagctagtatagaatgatctggtaaagtggttggtgatgataaaaatataaagacattacacaaacacattccagatatctaaatctaatgcatctttaaataggttttgtgggtattttttcctttcttcagtgtgttaaggttcctagataaataattatttattagggttatttcaaggataacctttgatatttgcattcagttttcaagtcataattccagcagttgtttaaaatttacaccgtttattcagctggtgctcattttcaatcttttttttgtcatgacttttctgcagttctacattttgagacacacatatcgtatgtgtgcgtgtgtgtgtgtgtgtgttcagtttcagtttactggcatatgtttctagaaaacttttaggataagtacatacaaggtttattttgggatttcttgcatatgttgctttcatatgtaaactatagtataaaattctgggttggaatattttttctcaaaattttggagatgttgctcccttttttctgacatttatttgtgtagacatgtctgaaaccagcctacttttgttcttttctaaaacctttacaattttttttttggtcctgccttggaacttggactaataataataattacaacaagaacaacaacagtaataaatggtctgtgtaattcagtttgctaagttatgtctagttctggtctcttttcattaattttttctggagtaccgtcagtccttttgatccatacactgaagtattgttttcatttcagaaaagtttagttcggttataattttgatgattgcctcagttgcatttgttttcatttcttcaaagaaattcagtaatataaagctgaaggcaatatcgcttagaggctaggagcatagctctgtattccagctgcctgggctggcattcccacttggtgtgtgaagttgggcatgttgctggcctggcagtgcctccctctccccatcttggcagtgggaggcccctgaggagtgttgtgaggtgcaggggatatggtaagctgtcagttatgtattaattgtttttattgctaaccattcatttttaatccattgcagtctggcctcttcctgtctcccattattgtacctgaacttttcaaggcaagagggtgaatgattaagcactatttacccttctcctccttttggcaatacataggttgtatagaaaattgttcattcatattgtgtgacgtctcacacatatactttgctttctcatttttagccttttatttctgtgtagtcagggagagttcctctacttgtttattcccttctctgattcacttttcttccaaagtcagttttgtgtcttactgcttcctggagtagatttttattgcattttgcatttttaatttgtctgaaatctttcccaattctgttttcatatcagcctgatatatatttaattttttaaaaattagaactttttggccagtgcagtggctcacgcctgtaatcccagcactttgggaggccgaagcgggcagatcacggggtcaggaaatcgagaccatcctgactaacacggtgaaaccccatctctactaaaaatacaaaaaattagccgggtgtggcggcgggcacctgtagtcccagctactcgggaggctgaggcaggagaatggtgtgaatccgggaggcagagcttgcagtgagctgagatcacgccactgcactccagcctgggtgacagagtgagactccatctcaaaaaaagaaaataaaaatataaataaataaataaacaaaaattactactttttatatgccatagagtgtcagatgggtgttgtctagtggttagcagtggaattatcctgtcacttcttagctgtgtgatgtctgctaagttatttatacctctctctacctcagcccatttcctcccctgtaaaatggggataataacagtacctacttaattattaggaggattaaatgagttaatatatgtaaattacttggaatagaacctagaacagaaaaatcacttagtaattgtgagctattattataatcattgtcgtcatcttcctgtttttctgctccaggttcttagaggtctgatcttcttgttgtggttgccaaacagttttctagttttttctttggtttctggttaatattaagatatttcttaaagcatggtttttctccctttgaatctttggaatgttctgcaggacttttttaatagaccttggctatgtttttgtttgatttgtttatccattccagaacaggcagatctcttcctcaacctgggttagcaaacagattcaatgtctaacttgcccttgttactgttttgggtattttagaatccccttagttcagcaacagggaccctaaaatgagctcagtttcccgtaactaaatgaaggcagctccctggggggaactagaggcttctgtcatcactctctggtctctgttagtcagcctgggtggagagtatgaaaaccagcaatcttgactgccagagtccctttagctaccactggaggtataatgacagttcacatgtccaccctattctgatttttaatgtgttgtttggaagcagaagtttgagagaggctgttacaagggaagtctaactgggaaggtcatatagtactctggccacctccgtcctcatttctctgcatcagggctgttgcccagtgttctggttggcaaatacatagagtttcatgctaaagtggagaatgattacatcccttactgtttcatgagggtaggtttcctctatttcgggtaacaaaacatgtaccacatacttctaaggtactcacatggctctctggtttgtagctaatgagaattctcccaggactttgcaggagcttggttctatggctcattgttaggaattttctctttttcttcattaggtatttttttttagcaggttcagggtagttgttagggctactacaggagataccgttttcaaaagggtcctctctcgtaacctttaattatgtgattcttatctcagatgagctcttcccaaaagcggagggattccctttacagataagtgtgattttcacagacaaaatggcaaaataaataaagagggagagagaggggaaataaatgagaattgttttggattttattatctttagtagtataacgtgtgagcagctagtttggcatgtcatagtagtgaaatgaaccaaaacattgaagattttacaaatcacccttgtgctgatactgacaaagcttatgagatttgtctcgtgaagttatatgttttttatattgaaatagaatataagaacacttgaggaaaatgttgctcagttaaacatagtaatagaaactgaccagagagttctattcttgatttgccaccttcagcagttactcctccagcccctactgtgggtatgacagtgacatttttgcttctggcgaattcttaaggatagtgatgtgtatcggtgcctgtttactatgaacttgtttgattttgttctcttttttgtttattcctctttatcactatactcttatgccttcaatatgcatttttaatttttgaagggacatttatcctcagcaattcctaatttaattttcagcattacatccacagtcccagtatttatccacacatttactgatctgtcagtctttttctacaggcttatgcatcatttgtttacatctcatatacttttctgcataatagaaatcactttttttctaaaatttctttattccatctataaggcagaaggaagtttatccatttgaatgaataatcagcttcatttaatttcaatttctgtcatagagtgtccttaattcaaagtctgatattcatgttcttttcagtttggcacatatttaaggcttttgaatgtttttttgttgttgttctattctactcttcttacactttaggtaaaaagatatctttcttttttgcaaatttcagtttatcctatataaagatagcatgtagaagaataggatttagaaaatccgggttctggttctaactcttctgcttatgatttttatgaccttaggcaagtcatttttctatagaatcatcagttcaacaggcataatggtatttgctcttagacctagcagttttgctatgaggaccaaatgaggaacagcaaaacattgccaattgtgcagacttcaaaaatatcatttcgcctcaccagaaagtttgagtttgtttgttcagggtgggatttggccattagtttccaggaattttaactgtacaggtgtgtttgagaaccactaaggtaaagcatgttgacacatttagggatgtaagttagtagcagtagtatgagatttagcacaagaccatgcagtacatgaccttattgtactgaaaagaaatagattaagttaggagaagttcagcttgctagttgagcaggtattcatactgaggtagcttcatcaaggtggccatttgttgattcactccattaagattcccatgattcaggaacctccttcttttcacctgattttcttagatttgttggggtccatcaagttaaacttccccaggtaaagtgaaaccctgaatgcagtgctttccttttgtgctttttagccattattttataagatgtttgttatattatcctatgcctatatatttccataaaagtaatgactttataccctctgaacaatgagcagcaggtgatgggggggacatatgtgtatttgccatgtgaagaatacatttcaaggccagcctcaggaaaaatgaaattccttctgttttacattatattatctcctgtttgtagaacccaaataacaaacttggcacaagtatataaaaacagtagttacaaaatgagtggatggtccccaaaactttaacttttaatgcatgaatctatttcccaaaattataacataagtgaatttcctgcttggggcttgaaagaatgaaccactcagaacttaccaagattaaaataagaagaaattgaaagtttaagtagtcctatatttatttttcaaatagaatttataattggaaaccttttcacaaagaaactatcttagtccatttgtgttgccataacaaaataccttagactgggtagtttataaataacagaaatttatttctcacagttctgaaggctgggaagtctgatttcaaggtgccagcatttggcatctggtgagggctgctctccttgcttccaagatggcgccttgttattgtaacttcacatggcagaagggatgaattatgtgtccctgtgtggcagaaggcagaagagcaaaaggactagctagtcacctcaagctatagctagttaccccaagctttcttataagggcaccaatctcacctatgagggctccaccttcataatttaatcactcactaaaggccctacttcttaataccatcaccttggaggttaggtttcaacacagtgaatttggggagaacacatacattcagaccatagcaaagccatgagacctagatggcttcaccagtgaattcctacaaaagttaaagaagaataataccactatactagagactagaaagacagtgaacacattccaatgttgggaaatagttctcattggctctagtactatttgttagctccaagcatttgagatctcatggaattctcatgctgagagtataaataaccatcactttggaggttaggtttcaacgtaatgaatttgggggaacacaaacattcaaactttctcatggtgagagcataattaatttgaaaccactttgtgaaatggtttgcctattaaatgtgaacatgcacataacctatgactcagcaattccattccaaggtatacacccttcatgaatatgtatataagtccaccaaaagatttgcaaagcatgttcttagcagcagtattcatgatagccccaatctggaaacaacctaagtggtcatcaatggaagatggatatgtgaattgtgatatattcatacatgaaataatacccagcagtggcaaagaaccaacctctactatatccaacagtgtggctaaatctcacaaagaaaatgttaaataatgaatgaaataaatcagtgaaatagaatatgattccttacttacaaaattctaacaccagcacaacttatccatgccagtagctttgagggtagtgattagttggagggtgttatttactggaaagggaaacaaaggagcttattggcttctatttcttgatcagagtgatggttacacggatatgttcgtgtcataaaaattcatcaaactataaatttatgatttgtattttttatagcatgtattttatatttcagttttgtttttgttttgttgttgttaagtaaagcactcagaaaatatactaagtatgaataaagtagcctggaacaactttaagggagacactgataagcaggaacttaaatctttcatttctgtattctcagtagatttagcataagttgtgagtgaagtgtggttcacctaatctcttaccacactgatctacatggttggtttattttatatatatgagagacactaaaaaaaaatctcccctttcctttaagggatgaaaaaatagttcctttagggacagcttatggaagtttataaaagaatagtaataacttgttcaaatctgtttcattgttttaatggcatgcatttaatacaatttgtggtgattgaagggaactctatccatggaatgcttatgaaagcttaattgcagcaaagtaccctcaacctgatgggattttcttttttcttttttctttttctttttctttttttttttttttgagacggagtctcactctgtcacccatgctggagtgcagtggcgcaatctcggctctctgcaacctctgcctcccaggttcaagcaattctcctatcatcctcctgagtagctgggactacagatgcacgccaccatgcctggctaattttcatatttttagtagagatggggtttcaccatattggtcagggtggtcttcaactcctgaccttaggtgatccacccacctcggcctctgcctctcaaagtgctgggattacaggcgtgagccaccgtacgtggctgatgggattgttttcattagatatttaatagaggtcacggggccttaaaattattaaatattctacttttcttattgatagtatgtgttcatactgactcagtagccttctctattgctgtcatggtgagctgatacaatccattttctttgtaggtgcaggtatttggactgtattctggagaagaatttcacgagacttttgactgtcccattaaagtaagtattcagcaagttttactttttctaagggttttctcaagtaaggcaatatggattacagtaatttgaacattaccacttctgtattaattttgtcagtaagtgtctgttcaacacttcagatgtactggatactatttagatgctgtgaaagaagacagaatgtgtattttgtgactgtgatctcagtctgtcttcaggggtattttattatagtgagtgagatcactcacacacacatacacacacacacgcacgcacacacacacacgatctgtggtaaaagactcaaagaggtaggaataatattaagcgttccaaagctgaaaggaatcacttttagctgttcttgtcagtgatggcttcattggtggagtgatgtttaacttggctttaataaatggagaaggactgatgagagaagctggctttccatgtggaagaacaacataatagaaatggagaggctagaaagttcaccttgtgttcaggaaatggcaaattgtccaatttatttggtacataaaagactgatttcacaagagaatgtgaaggaagattgggctggctttacattcaggctgaagaatttggactccatttggtagataactagaaattactaaatatttaagaacaaagtaaataaactgaactaagctttaagaaaattaatatggtgactgtatacagtattgattgaaggacagataagagtcaagaggactagttttagataaaaattatggtagttgaggtgtctattatagttgttgaaggaagaggtcatttatttttttcacctgtttattcaaacatttattgaccagcaggtaaaggagagatagggtctgatgtatgttttaaaaagttgaatttgccagagtggagggtgatttaaacaggagagtgattggggacaaaagacaatttagaagcctaatataatactctaggcagggcattacaggatctcaatgaaaagaatgatagtgagtgttcaagatggaaaggatgaaatttatttggacagcctgtgctaaatagacttagcgagccttagtgatggcttggatgagggtgatgaaagacggaagagctcagggtcagttcaggttctcgctttggggatggggtgtgggatgccatcagttgcagtagggtatgtttgagtaaggacatggctaggctagtttggtcctgagtttagataagtgtagtacatcaggtggggacgttacggaggttttagaaacatgaatatgggcctcaggatggagattggcccttaaacacaaacgtgataaccatagttgaataaggtgaagctatttttaaagatattatccaatttagagctgtagagtgagaagagaagactgatggtgaaattctggaacactctaacttgaatactcaggctgtggaagaaaaaacagcaaaggagtctaagaagaagcagttggagggactgtaaggaatcccgaagagtggtgtcagagaagccaggggagagagggtttctacaaggaggaagtggtcagcagtgtcgaatgcagtgtggagattaaatagggggaaggactgaaacaagggcattctatgtggtgattttgaagttactggtgaccttgctgaggactcttttcagagcaggagggtcactatacatgaaggaataaattggagatgaggaagtagaaacaatcagcagagactcttctttaaagaaatttagtaataaagaagagagatcatctggtagagagaggggccgtgtcctgggaaggtttttgccgaccatgttttggttcatggcaaaaaccagtaaagaggaaaagattaaaaataaagagaatgcttcttggagcagcactaagcaatgagatcaacagcttaggtagggaagataatcttggaagagtcctagaccctctgcctgtgaaacaggcatgaaggaagtggactgagcctagctattgcaagttagacagtgaaggaggagcacttgtgggcaatgaccctgatggctttattttcttacatctgaagggaagaaaagggtaacataatgtgtttgaggagcagaggagatgtttggaatcagtccctgatctacagttatgcattacgagagagctagggggagagtttaagaatgtgaaacaatagaatgtgtgaatccttcactactggtattgaggatggattaggaaagtgttgaagggaagaagggctaacctgggaggtaggagtgtttagagcaatgaaggatcatatgctaatccttaaaaatgacattgtaggaagaggaatctattccattgtaggagggaaatgtgtcaattaatacaagtataaaatatgtttaattgaaggtatatagaagtaaaattgtgtgagattttgtgtgtgtgtttacctaaaaaaaattctctatgttaaattagaaaaacacaaaattagttaagttggtgatttcatgggtggtttggggataaagagagaaggaggtggagtctatgcaagcttacagccacaacagatgagctccaaagatggaggtgcactgagtggagccacgagggcttttgttttcatcccctccccaagatgttaatgatgttatgtaatcataaagcccttgcaaatgaaggaaacagtaacaagggtggtggagcaaccttaagagaaacctgggtagcaaggggctggagaaagattggatgagtgggaagcagatgagaatcaggggaacaggttgtatctaaaaagctaagtcctgaacggttagctctttgggcctgtagctctgttctctctccattgatggggtcttggtgtaagtgggctaaacgtctgggaggctgcgttgccacttggtgccgtctatcattgagagtcatcttggacaaggagttagttggcttctttctgtttttttttttttgttttgttttctgtaaattgtatccagttagaaacagttgtgacatcttgctaccttgaccaacctcccttgacctcccttgctgcctctatacaggtgacatccacttataggggtcctcagccagaaactagaactgacttatcctactctttgagctttgacctggcttcagagaagaaatcttttcacgtaagaagaaaactcagatgtcatcagttgttgtaaaatatgatttgaatatattacttcctaccaaggtttcaggataatttttagatcatgctgcttgaactgtgtcaggggttttcattctgtgcattggccatgactcctaaaccagagttgggttctgtttctcttgtagattattgctgtgcacccacatttcgtgagatccagttgcaagcagtttgtgaccggagggaagaaggtaagtgctgtgtgtctctaccttgatatgtagccttgaggggtgttgtgtgcttactctgtaatttatccttaatgtttttatgtctggctattcattaggagaaattcgagaaagacaaatgtaatgaaatctgatgatcatcatctcttgggggagttgtggcttcagtgtttctcactacattgctttttttgttgagacggagtcttgctctgtcgcccaggatggagtgcagtggcgtgatcttggctcactgcagcctccgcctcctgggttcaagtggttctcctgcatcagcctcacgagtagctgggattacggatgcccactatcgtgcctggctaatttttgtatttttagtagagttggggttttgccatgtctctactaaagacatggcctggctggtcttgaactcttgacctcaggtgatctgctctcctcggcctcccaaagccctgggatgacaggcgtgagccactgcgcccagcctcttgctacatttctttgaagtagatataggacaagaaaataagagagctgttacatctagagctttgaaacattgcccctcccacaaaaaagaggcagcatttaaaaataacaaaagcacacttaaactactgattttttttttccgattttttttttccttgtagaaaatctcttgcgggccttgataaacttttagagcagttatggctactcttcgctgacatgttcatggcacattttattatctcagtgctatttaaaaaataagagattggactgggcataatggtggctcactcctatgattccaacattttgggaggccaaggtgggaggatcacttgaggctgggagtttgaaaccagcctgggcaacgagtgagaccgactctacaaaaaaatgaagaaattagctgcgtgtggtggtatgcctctagtcctagctattgaagaggctgaggtgggaggatcacttgaacctaggagtttgaggttgcagtgagctataattgtgccattgcactccagcctgggtgaaagagcaagaccctgtctcttaaaaaatgtaaagagaaataagagagaaaaactttcatatattaacatttttctgtttatagatgtagtaaattctcaaattaaagaatctgtctgcttatagaataagtcaaattagttttttttctgtttttattacttagagatattttaaagactatttttatactaaatgctatcaccatactggaactccgaatattatttactattcggtttggagccagtgaaaaggaagtagtctatagctatttctgtagtagtatagagctatggaatggctgctttgaggcccagctactgaatgcttttaaatgttttatgatacttatctgtcattttcccttggttcaatagttaatagaatgatagggcgggaaaaccttctggtcattacatgactcgttgtaatgagtggcaggttggtagatcctgattccattccacaacataaagccaagatcacgccagttctgatttctgttagagagcccctccttcccccatctcacagcccattgttattcttaggctgtagttgcattcaccttatgttaaaatgtccaggggactaattagtgggaattacagacctaatctcacattctctagcttaggtctgcagctgatccactcctgaaaaaataactaccttacttgtctttgtctttgtcagcctcaggaaagagtagcattaacattcctctcgtatttcttcactaaacactttttgggttaagaaattttgtgtatgattgtattagggttctctagagggagagaattaataggatagatgtgtgtgtgtgtatatatgtgtatatatatatatatatagtagtttattggggagtattaactcacaagatcacaaaatgaggtcccgcaataggccatctctgcaagcggaggagcaaggaagccagtctgagtcctaagctgaagaacttggagtctgatgttcaagggcaggaaacatccagcaagagagaaagatgtaggctgggaggctaagccagtctagtcttttcacgttcttctgcctgcttttattctggccatcctggccagattagctgattagattagattgtgcccatgcagattgagggtgggtctgcctctcccagtccaccaactcaaatgttaatctcctttgggcagcaccctcagacacacccaggagcaatactttgcatccttcaatccaatcaagttgacacttgttattaaccatcacagtgataatagcataagttcacatagctgaaatttaaacccaggtgttcttattaaaaactcagtaagaataaataatttttcttttttttcttttttgagacggagtcttgctctgttgcccaagttggggtgcagtggcatgatctcggctcactgcaacctccacctcccgagttgaaggaattctcctgcctcagcctcctgagtagctgggactacagatgcccaccaccctacccagctgatttttgtattgttagtagagatggggttttaccatgttggccaggctggtctcaaactcctgacttcaggtgatcagcccacctcggcctcccaaagcgttggtattacaggcatgagccaccatgcctggctgaataaagaattacattttatttaattctcactgggaatggtcactgctttttgttttaaatgacttaaaacaacaaacatttattatctcatacttagaaaattcaagagtggcttagctgttaggccctggctgaaggttgctcatgagggttcaattgggatattggttggagctgcttgaccggggctggaaggtcaggttctaagatgtctgctgccttcttaataatctgctatacacttaaaatattgataaatcactttggtttaaatatttccctagcatgttttgatgcagttttgattttcaatttccaatttcaagagttagagattttacagttgtcccctatttcttgaaggtattagaataaaagaacataccagagataatatgagtgttgatgtccatgtggtaggactgaagatttggaggagagattttgctgtgttggtttatgtttttttgtttttgtttttgttttttttgagacagagttttgctctgtcgcccaggctagagtgcagtggcgcgatctcggctcactgcaagctctgcctgccgggttcacgccattctcctccctcagcctcccgagtagctgggactacaggcgcctgccaccatgcctggctaatattttgtatttttagtagagacggggtttcactgtgttagccaggatggtcttgatctcctgaccttgtgatccatccgctcggccttccaaagtgctgggcttacaggcatgagccaccacgcccggcctgtgttctttaataatcagtgtattcgtgaagtttaataattgcttttctgctgcaagggatacctgtagtcttatcaagtttgccacattaattctgctgcatgagtgtcttgtctccctgtaggatgtctgggttaactgtcagtaacatattcttcatccttttacttagcatttgatatcatttgcagacatccgtagaaaggacagtgtgcatgcagcagtctgggtcagagtccattgagtagatccatgagcagtgcaggaacaacagagtaatctagcatctaattgttggtaagataacatgggaagagcttggaatttatagaaagttggacattgtgataagcaataagataagtagaattcaaaaaatgctgaacaggcagaacatcaggggtttggtttgtctctttggttgtcactgactacttgacaagctgttctatgttcagttttctatgagagagtaatttttttttcctattcagttctccaaaaatgcatctgttgacatctcgttccaagcatacagaaaaaaagtttatatgtatataacatgagagtaaaataaaaacagttaaggtcatctggtgaaaaattgaattaaaaatgattttattattaacttagacatttgggactaaaataatttaaaagaaaacatacactgaagagcttagtgtattgtatgtaaggcttagtatatggggcatgagaaaagcacatgtatgatattttaaagtgaggaatcccgtgattacccatgtcagtgtaagtaattggtattaagtcattatttttttagctgttttaaaatagttttattgatacataatttgcataccatgaggttcaccagatgatagtgtgctgtttagtcgtttttaatatatttacagtgctgtgtaaccatcaacgtaagctaattttagaacacttccgtcaccccaaaaagaaaccttgcacctattagcagtcactccccatcttccttcctcccctcctctcatccctaggcaaccactaatctattttctttctctataagttttcctattctggatatttcatataaatggaatcatgtaatatatggcctttgtgtctaacttctttccttatttttctaggtacatcaatgttgtggcatgtatccgtatttcattcctttttatgtccagatgatatttcattgtatagatctatcatgttttattcatccgtttgtcgcttgattgacatttggattgtttctactttttggctattatgaataatgctgctatgaacatttttgtacagctttttgtggctgtgtgttttcatttctcttgagtatggaattgttgaatcatatagtaactctatgttggacattttgaagaattgccaaaccgtttcccaaagtgattgttccattttacattctcatcagaaatatatgagggttttaattgtctacattctcaccaatattcattttattttctctttttgattataatcactctggtatgtgttaagtgatatctcattgtggttttgactttcttctaatgactgatgatgttgaccatgttttcctgtgcttattggccatttgcatatcttctttggagaaatgtttattcagattcttcgcctattttttaattgggtttttttaattatagagttataaacttcaaaaataaattctgggtagatattccttatcagatacatgattcgcaaatattttttcccagcctatgagttgtcttttcactttattgatggtatcctttgaggcacagaagtttgtaactttaataaagtcacatttatcttaatttttttgatacttgtgctattggtgttgtatctaagagatcactgcctgttgcctcttccaaggtcatgaagattaatgcttgtttcttttaagacttttgtattttttactcttaaattaggtgtacaatatattttgagttcattatgtatgatgtaagacaggagtccaaatttattcttttgcatgtgaatatccagttggcccagcatcactgttgcaaagactattcttttcccattgtgtgggccctttgtggaaaattggttaaccataaatgttagggtttatttctggattctgaattctaccaatctatatagctatctttatgccagtaccccttttaggtttcaaagccactaatttttctgtaattagttatgggatggcagatgaactacaaatgctcctcaatttacagttgaggttgtcctgataagcctattgtaagttaaaaatattgttaagtcaaaaatgcatttgatatacttaacctactgaacatcacatcttagcctagcctaccttaattgtagtcagaacactacagttaggcaaaatcatttaacacaaagcctattttataataaagcattgaatatataatgtaatttattgaagactgaaagtgaaaaatttaatcattgtataggtaccatcataaagttgaaaaatcattaagtcaaataatcataagtcaaagactgtctactcttaaaactttggtttggggttctttccctttaaaaagccattatatatcatcattctttaaggaaaacctgtttttattcccagtacaatcaaagcaccctagggtaatacaagcaaattatttccacttactacagaagatatatatatatatgaatgagatatatctatctatctgtatatatggaggggtgtgtgtgtgtgtgtgtgtgtgtatgacaaaacaagtcttttaaaagtgtgataatagtttgtgatttagaataatttatttaaaaaagccattataatttattttacttatgttaaaggctttagaaacatgtaactgtgtccgcaatttaatgacttgtaacatacaaactttgatttatttggatccattaaattttatcatgtaaatatgtatttactaagtactaaaaagtaccattttcttgataaactataatgatctgtttgcatatggttaaatggagattttcaaaatgtgtatcagcttggtgtggtttgcagaaatctccagagaatttcctttttctacatgttgtgtggtatgtacttgtaaagattatttatgcttcatgtttttgacattagcgtgttttgtttgttttgaaatagatttatttagttgaggtattttaggatgtatttttctaatttcattaagaaatatatctgatgttaaaaactaaaggcatttagaaggttacattaagaaaggaggacttgtgaaatgatcactttcattttgaaagtgttcgcaaatttttaggaggagctgctctttttgtaactgagttatagaggtttatatctttgaaaaatgagataactacattggctcagtagctacttcaatcctttcagctgcaattttaaactagcagcagaaactaggcagaacaattttgaaaagcccaacatttagcaaatggttataaccttgcaataatcatgttatagatatcaagatccctcctctgttgagaacaggtggcagatcacatagggggaaaagagaataaagacatatgtcagataactgagaggttatgactttctgcctttaagaaataatttaatcttcaaaaaattggagcaaagactagccaaatgaaggtgtaatgtggaataaagacattcttaacccttaagaacagtgatctctagactgacagccaaataaatcgttggaattatatgccaccttctacaaacaatgggttaaagtggcacagagactagaggaactaagtagaaaaatagaggaccactatgagatattcgtgaagtcataagaaaatttgagagagatgtctattaatatttaatagttctttaatcttattacaatttttgattcctataaaaattattaaagtaattagaacatacttttcaagtatgcaacatacattgcagaacatagcaatgtaacagaagaaaccctgaaactgtagtttgacagctatttccttttcaaagttctggcttcttaggtgttcagagatagctctttatccaccagggactaggactaggaggctatagttctgtctggcataaacttttattttaggttttcaaggtatcttcttagtagttgaatgccatagctggatttatggactccagtgcttgacacatgagcataaaaagcttattccatattctgttttgtttccatcttgaaaaaaaaaaaagagaaagcacatctcttaaaagtgccattggagagagctttcaaacacgtgaaccaatgaattttttttgtaagtgtaaccttcttgtgtagcaagaattttaatacaggagcatggcaaatgaagtttctattttagaaataaatctgtcaagtgaatgttgtctggatttttttttttaattgtccagctttccctgtcagcaggtaagctttagcttcataggacctttacttttgaacactgaaatacactttataataactggttctactactttgacaaatcattaaattgtcgcgatgctgtttgcagtggagttcatttttagaaatcagatagtcagctgtttggcgttacggtgggatagaatgaggggacctggccgcaggggcaagttgctttgtaagctggaaaatgtcagtcagcaaacaaggaaaggactggagtgaatgaaatgaggaaaatttgaaatggcaaattttacctgaaggacagagatggtagtgtcagccagcttctataagcttccagcagtggtctgcaaataataaattggattttgaatcctttttgagggaggattcaatatgggaagctttttataaaactgtaaatatttaaaaaattattattaagattgtttttaaattttatttcttttgcccatgttatcaacatttttatttttttctagctttattgaggtataattgacaaattaaaattttatattatatatatatataaaatatacatatatatatatttttgtatttttagtagagacggggtttcactatgttggccaggctggtctcaaactcctgacctcgtgatccgcctgcctcggcctcccaaagtgctaggattacaggcgtcagccaccatgcccagccaaattatacatatttaagttatacaatgatgatttgatatataccaaatgtatttagtatttattgtgaagtgattgccacgttcaagctaattaacattatcagttgcctcacatagttaccatttctttggggatgagaatacttaaaatccattggtaaattttaagtatttaatatggcattattaaatatagtaaccatagcgtacattagatccccgaatttattcatcttagaactgaaagtctgtgcccttttggccagcatctgccaatagctcccagtcccctggctacaaatctttttagaatctagataatccggtgagccttttcttaccactgccatccctaaacatgaagtgtaggagtgcttcctcgtgtgtttgttcatctttgggtcagattggagctggggttttggtggctagaagggttttgacattagcagttcctctctgtctcctgtccagtgtttggatctctaggatagtatttccgcaagttttcagatgcttgattgtagccttctacctgaaacttcttcccacattacttaccattgtagttttcaagtgaatcgtctgaacatttttaagaattaaaattaaggctccctagttaattcacagttacaccacaggcagccaccaatctaacggttgcacgttgaggcattgtaaatacatacctttatttattctaggtactgtgttgtaaattgtggtctcattcctagaaatgtatttcatgctgtcatcaatgtaccaaaattgattaaaaaccattgattagcaggaagtaaaacacaaatgtaaccttcacaagcatttttttagatatgaaaaaccaagcaataaaatagctctactgtttaaagtatttttcggtgagttttcctatgtatactaagctatctgaggctaaaaatagaaatataatgcttaaataaaaatcattttcagtcggaaaaacaggtgttcttcattgctgattgcttttttgatgtcaatatgtaggactcccagagtatttgaatggtatctacagcggtcagggtgggagagttgggtccatagcaacttcattttcctttatgattcccattgtctcatatccatcaaatgcctgttaaaaaatatacttttttctttaatgagttcagctaactttttcatatatttccatactgattgtagctttcccctgaactctgatgttaaaactaccatctctcttccttataaccatcttttgctccttgctgataatatcttcttttgcatatggagagtcctgtgcttattcttaagtattttgagcaaggactgcaagtgtcattgccagttcagaggtgttcattagatattcttgtgggatttaacatcagctgattcattaacacagaggttctctttctctcttttgctttaagagaaggctgtataaagcaaggggtcacaattgcagtcattgttagttggtgtcgtggtacaaactaaatcacagtcatttcacaggagtatttggtttgaatctgcttcctgaatacaactttgtgtcatgcttcatgttaggtgctgtgtgtacacaggatcttgatttcagaaatggtggtaggcttccaaaagcatatagataggatggtgtaggtagaatatagttaataagaccattagtcagaatagtgacttgacaggaaaatgagtgtatttgtatattcacatacaacactatggggtaaatttacagtcctttatttgtctttaagccttttggatccccctcgacctgtatggtttgtttgttttccttttaattttctaactcagtttcagccaattttcttgatatttgtaacagtgaaaattggtacaagctgtctaacaatagtgaattagctgtgtcagtgccctgcggccaaagatcaccaggagtaccccatatggttttaggaagatgttagaagaattgtaggatttaggctggtgtgaggtgattttggggaggtttaaggcatcagggctttgctctagattggatgctgtcatgaagcatgagtaattctacagctgggcattttgataaatcttatctagaaggagaaaagcctaagccaaagccaaagtcataactggtaaagaagcagcagtctgtcattttagccaaagtgggaggtgtttggtcattgccacgacttggaaaatgttcatgtcttgtttgcattcagacatgattatggagtggtcttgcttctgtcctggtccttcatggtcatggagtggcctcggctgatgttggttttgtgtgaaattgtttatattcatcaagagaacatcagagccctgctgtgggtgccaggctagcttctggttgtcagcttttctctttctcagttggaataaataaaattctcaacatttgttagattgcttctgttgaggtacttttctaaaatatatgtatggtctgattatccttttctgtagaaataaaattatgtatgtagatgtattcatggaaggctgtacaccaaattattaacaatatttgtgtctgggcaggattatgaatgttctttctgaccttcattggcttttatttacttttttgtagtaagcatgcattatttttataataataaaaagtaaaggaatgtttagagtaatctcaattattttagatcttgttttaacttatcactgtacatcatatgaaattccctacattattgatgtctattcttagctcagtgttattgaatagttgcataatattctatcttatggatctatttgattttcttaaccattcttctgtctttggacctttaggttatatccagtgtttggctgtcataaatcatgatgtggtgaaccttgaaatctttggcctttcatctgttcctctgaatgttttcctaccattgattcttaggattggaattactgaatcaaaggttatgataattttttaggcatttaatatgtgttgccaagtaaaattgtattccagaaaacttacaccagtttacatcagctatgtgtgagtacctattttaccacatgctcattgccaatctgatatataaagatactccatttttctattttatagtatatttgaatttttagtgattttgaacatttttatttattagctagttctgtagcttcctttgtgatttgtctgattgtattccttgctcagggcagcttttaatattaccatagaagccaggacaatgaaggctgtccacttgatatttactgtcagtttgagcacaaattattgctgcttactgaacagcctgcagccttttctccaattttggccaaatctggaataattattgttgttcccagggaggcattatataggagtctaaatgaggctttagagtagaccctgaagtgtgtagagaggatgaacatatgttaccatgtagatgtgagtctgccccaaaaccatcagttctgccacttccatgaaagctatcaatgctgaccagtgtgtccagttaatgccagtttttcatagagatggtaagaaagtggattataatgcttgaaattgggttcatttgactcattttcttctgcagatagtctcctgatttttttttttttcaacttttgggctttactttgtttttgtttttgtttttttgagacagactctcactctgttgccaggctggagtgcagtggcgcgatctcggctcactgcaatctctgcttcccaggttcaagtgattcttctgcctcagcctcccgagtagctgggactacaggcgtgcaccaccacgcccagctaatttttgtatttttagtagagacggagcttcaccatgttggccaggatgatctccatttcttgaccttgtgatccgcccacctcagcctcctgaagtgctgggattacaggcgtgagccactgcgcctggcctgttttactttgaattgtgtgaagggcttgttcaaatacataaacccgtgttttcaggtaactgtctgcattattcaagacttagcaattttgcatctctttttgatatactcactgtgcaaggattttcaccagtcatcagtgattgagattatatgtagttaaagttagagatatttgttcattgcagagaacattaattcaagtttaatcacccagtggatgacttttctgttatctctaccctgatgctgagggtgtttgaccttgggcccagcccggaaaatgtatcctcagatagctgcaaactgaaaaacagactcaacgtgtttggtatgaacagccagctctattaaatctgtgggatccatatggaagattttttttaagtggtaaaattacttagaaagtgtcctagtcatttctgaaatcgcacttgtaattatgtgcttgcatttgcagcaattgcagattagtagtctaaataggggactacctcacatgctggcttgattgccaagcccacataggtgtgtaggtagatactgcataggtgggtaggtagatctttatctagctgtcatctctagttttttaatgcaaagaaagctgctcctaaatggcacgtccgttgtttaacttattttgttttcatggaagctttgcttggatttcttggttgctgaattgatcgttaccttatgttgatacagtgttttttaaatttcagagcattggtctgtctatataggtttcgcagaattaactgcaagggcatgtccaaagtctgtgttgctaatgcaggaacggaaaaccaaataccacatgttctcatttgtaagtgggagctaaatgatgagaacacatggatacatagaggggaacaacacacactggggcctattggaggatggaggatgggagaagggagaggatcagaaaaaataactaatggatagtaggcttaatacctgggtgacaaaataatctgtacaacaaacccctgtggcacgagtttacctacataacaaacctgcacataaacccctgaaattaaaatacaagttaaaaaaaaaagtctgtgttgcataggaatggtgtttactaaaatattgtttgtaagcaagtggcatttgagtgggctctaggaacccttgtgcacagaggttttccgtcgtaccaacattttgtctatactgaactggttttaaacatgttaaattcagataaaggagattgaagcattataacttgttcagaaaataaccactgaatttaaggaaataatatatttgggaagttctctttttcttcccacatgtttatattctatcttgatggacacagtagagctgttggtggtgtttagagaagctgcgtgtttgaaactttggcactaagcctaagcacgaagcaaaacaaagacacttacctgctccatatgggttcctggtcattcattcctgcctccttcagggttcaagaccccatttgccatcagtagccagccaccatcctaggtcttctccacactcactcatatttttctcacttgccttcttgacttttaaaattttgctcatgatcttttctaatcttgaatatttaaatccttttgtaacaagactttcccattgttatcccctttgtttatttttattgagacagttttatttgctgggttttactattctctgtttctctattttattacctggatcttctgcaccttcctgacgtagcacaggtcctcctttgtgaaatatttgttttcttcaagccccttggttctccccgtgggaacacacatggtatctaagccttgaccctcggctgaagcccctgctgaatcttgcccactttcttgtctgcctcaaagctagcagtgtggtcagtatttaggaagcctgaaggagccaagtgatttatcaacttgaaagatcacaaggtgattaaaacagggccaatgatactcttttcaactccatcagggaagagtgagtgacaagtaatgatgggcgttaggtgaccagaatcggggacttcattacagcctgataagaatcttgccacacatgtgggagattctgggctccatgtccttataccactctgtagagtaggaaagcactagatagatttatcagcacaaaacagaggagaataaagtatattgctgaggatgtgagggctcatattgaaatataagtattgagagtgctgactgccagaatgtggatttatgggaaataaagccctaaaatactttttccaacaaaaaaatagacctcttggaaacagcttttcctctctatgtacttagctcccattgagcttaaattgctcttagtattgtgataatgacaattcaatattacagggtatggaagatgaaccaaataaattaaccagctgcttttaagcgtagtttttttcaatggcttaccccataaaatgctttgtagaacattcgtgctcagtaggtctgtgggcagttttatgactggaaggaaaaaatggatattattaaatgtcagtgaagtacaggcaggtagttttgaggtagttaaattagtatagaatgtttgtaagaaaaggagttcatgttttcttaaatcaccaaagcaaagctttccttggcattcttgtcagaaaatatgtttctgcttgaaattcacagagattaggataaaaaagccaatggagagtggatcatttggccattctcccttctgtatgaaactctatgtcaaatcaaagcaaatcctgcatgagagtttcagagatatagaaatgactccataattactagcaggcatttaaggttttatactatgtaggataggaaaagtggactcatgagtgaagaataaagtagggtggagaggaaaggcagaaataaatgttcgacggggccaggcaggtaacatcaaggagagaagcaggccacatgcgagagagcctggagaagtaggcgctgtggcaatccagagagccttctgcaggcctgcagacacatttcagaaattaccgttcaggccaaacgtgtggccagttcgtgtctctgaaataaaagagctgcaattacttaaacctaatagaggaaggctaaccttaaaagcagctttcaaatttttggcaagttgtgcacaaattctatctgctggccttcagcaaagggaaatagactgacattacatgcctggatatgggatccatagaagtgagccctttctaaaagcaaggctgtgttgattgtgtgaattagtcattgggttctttaaatttttgagattggagtagattccattgtgttcaaaatattttaggagtattactaactgtaaagataggctgagtaactgaaacgttttgggaaatcgtgtagctcctcctgtagcaaacacattgtgtgtatggtcagagaaggaaagaattaagactagtagactcggatagcctacttagtatttaatatttattatgcctatgggtctagcaaagtataagatatgatccttttccccaatgcactggttggggaaatgcaaggtaaacacaccaatctcagtgaacaagatttaatagttagttgtgcagtgagaaaaccagtgtgaccataaaacatatacagaaccaataaattgggggaaaattatttgacttacaaaagaattctcttaaatgatgactttccttagtatgtttatgatgacctactttatttagtatttccttagtatgtttatgatgacctactttatttacagatattttcttatttttcatccacaaaatataaagtgatagggacttaggctatttgaaaaacataagaaaataacgtgaatcctgtcaaaacttgtaatattaattagttaaaatttgtttcatttacagaggttaatttttagcccccctccatttttgagcacacatcagttgcatagaatggcatgtgcctgtctgcattgtagaaatgtcattgggagaagcttctttgctcttttaattgcatgtcagagcagggtccacaaggtttttgggactcaatcctgagatggcctggattcagaattcgtctgtccttcctttgcctcctcccctctgctggaagtttttagtttcttgttttgggaggtagagtaggaggcaaaaggaggccagagttctgccacctctgcttcctcccatagctcggagcacaccaagtataacagaaagggtccattggagtgagcttgcattttggtaggaactgcaacaagatttaattaacagttttctgaagaagttaatgttttatttgaaaagtatatacagtttatgtaaattcattctaatacatgttcaatatgcctcaaacattacttctttaagttccagtgaatttttatttatttatttatttattttgagacagagttttgctcttgttgcccaggctggagtgcaatggcacaatcttggctcactgcaacctcctcctcctaggttcaagcgattctcctgcctcaccccctggagtagctgggattacaggtgccggccaccatgcttggctaatttttttgtatttttagtagagacggggtttcaccgtgttggccaggctggtctcaaactcccgacctcaggtgatccacccacctcggcctcccaaaatgctgggattacaggcatgagccgctgcacccaatctccagtgaatttttgatattactttgttgtttcattttaactattcccctaagttttcctgattgtaaaaataagagaatggattttcattcccattaatgtattaacataaaaaattcatatatttagtgcagaataattataaaataaaaataatataaaatttcagcacgcatttatcgaattaggattactttgtcatgtatcttttagattttataatatatgtgaatacacattcacattttattttaaggacattgtattgaatactattttgtcatctgcttttttatttaatatgccctcatagctttttctgttaatgaagatacatgcataaaataataatggatacatactcattgtgtgtgctccatcgtattatgctccgtcattcctcagttgttagtccatttctggctgttataaatagctctacatgcatctttactaacttgtctgatcatttcttagcgtaagtttctaggtagcaacttcctggtgtcattttttttaaaagctttgagtccatgatgccaaatgatcctccagaaagacggtgtccaagaccgcagttcagtagtttgaagatacctctttctctgcacatactccactgtaccccccaccccacatacccatgcctgatcatatcattttgattcgtctttatcagttcattctttttccttcatctatcaattctagaaacattgctgtattgttttgagtgttgattttataaaatgttttactatctgtctggatgaatccattcctccccctaaattacttaattttttaaaaattcctgttattctctcattttttaaaatgaatttttagcattttttgaatttctagaaataatccctttggatttttttggacttgcattaaaattataggttaatttaatgagacttaagctctttagtgagaattggagtcttactatccatgaataatgtgcctttctgtttattgagttctcctttcgtatccctcaatgaaatgtttttgttttgttgtgtagcgacatgtcatgttcattattaacttttaaatctagattttccttttttttacaactttgattgtatcccataaagtttaggtttatagtatttctcattttcaaagtactctggttaccatatgaattcctcttttacccaaagattgagaatgttttttgtaccatttttgttttgtattgttctttctctcattcttcgttattaatttcttaattttgttgttacatgagaattatgatgataagaattagattttacttttaagttcttttgttttttttgaatgtcttgttattcatatggagtcacaagttggggattactccctggataatttgtattcttttaaatgcaggatttttccataggtgcctgccttttgtcagagtgcctgctttccttcctacctgggacagctacagtgctggctacatgcttggggacccaaccctttgtgtttcagagtaagactggccactccccttcgttcctgccccattacactgagtgtagggggtgttgtggcattctagtacctgcctgacttcccaggcaggctttttctgggggaatgagttaaatcatggccttcactggagtcttattattagcatattttacataatttttagcttaaaatttggagcatatttaactttttcaacacaggtgcagactgttctcctcttagtactacattggtcatttctaggtgggaattggtgagggaaaggaattcgatgctgtgtcccaccctgctgttctcccggccatcctgccaacccttcattccagcaggtgattattgagcactcactgtgcttcacccatttcggacgatcacctccatcagatccaggccacagatagaagatagacattttgatcttatcaattcatcatgtttaattgttgtggccaggcgtggttgctcacacctgtaatcccagcacttcgggaggccaagaccggtggatcacctgaggtcaggagttcgagaccagtctggccaacatggtgaaaccccgtctctactaaaagtacaaaaattagccagacatggtggtgcatgcctgtaatcccagctacttgggaggctgaagcaggagaatcactagaacccaggaggtggaggttgcagtgagctgagatggtgccactgcactccagcctgggtaacagagtgagactccatctcaaaaataaataaataaaaataattgtttttagctgcctgtctttagtggggcataatcttctctgtagcaggaactgtatgctcagcctttctccccctttcctacatttctggggtctgttctctgttttctgcaaatgggaggaagaggctgaatcacagtctggggacactcccgaaggcctctaactgtgggggtaggaaggcatggtagtagtgacttctgaattggaacctgggataggagaggacagggtgggttagaaggtctctgagaatatatctgatgggaagatggggctaagtatggtcagaagaatccctgcctccagtctccctgtggaagttgtgaagtcacacaacttcaaactgtcatagcattttaaagtaactgtactttgcttacttgtgatgatggacatcatatttaattttagggattttattttgtgcttcctctgcctgtattagtctattgagaaagatatacaggaaatacaaataaaatgtgaatttactctctttcccctgttaacctgtttcccctgcctcttttggggtgggtagaggacataaaatatactaaggtagactgaaattgcttgtagtggtaggaattttagtaattctgttatggaatctgttgtcagcatttgctttgaaaggataaacatgtgtttcaggattgcataccttaagttacatactgtataaatgtcttttcttaaaggatttaaatggaatatgtcaagaaaaatatttattgtgttcttaataatgtatgacttcctagaattacatctttattaatcgtagaggtttttgaccagttatattttatattaaaatttatccagcaggttttttgaatgatagaatcttcccgttaaaataaagaccctagatactatgaaatttctaaagaagcttaattccaattttttttttattttgtgacatgaattactgttcaaaagtcattgttcaattatttgagtcaaatgaaaaacatagactgtttctattacagtttaatctgtgactaatatcttattttcagtgaaaaacttaaaagaggttttgatttcccaatttacaaaataaattagttcccggacaatcatttgaagaacttttgcgatacaaatcttttgattaactaatgtgcattattttccatgaatcttggtgttttggtgccaccttgtggcttggccttgtagtaacttcaacactcatccattttaaacaacttcctggggagaatatgatgtgctaggaattctttccaaggtacaaataacatactactgtaagtctacattaaagacgtcgagagtgacttgtttgttatttggtcacgaggataggtaaaactagtaagtaaagaacctgatacattattttcagtttctaagattctttgtttatgctttttgtccctagctgctactgtttgaacggtcttggatgaacagatggaagtctgctgttctgcatgaaggggaagggaacataaggagtgtgaagtggagaggccatctgattgcttgggccaataatatggtaaaaaatatgcctctgtcttcctaatgcttgttcagtggcagaagaatggccaacttgatagggctgtaatgaagggaaaagatgccacttgctgtggtggtgatttctaaagggtgtaaggacgattggtatcatacctaggaggttaaagaaattagattgcttttggctttcataatatagtaattcccaacatattctggaatctattttagagtaagaaacctgaggcatggagagtagccaagaaaatgaaaagctatcttaataattgaaggactgcattgggaatgggtcttgaaaatatcatttgcctgttggccaaaggcaagtaagagttgatatgaaacaagtgcagaatattgctgatttctcttttactcccagtataatcatagacagaagtatagacctgtctgtaagaaagtggatcgtaattttcagtgctgcattttaacttaaagtttacttgctatgaattggggctagtaggaagttttaaaaatggtctttttgacatctggcatatcttttgaaacatcaaggtataatttagtaaatcggttctattcagttttaaatggtagaaatctgcctagactctacctttttattctggacttttcttacttctcctgggtcacgatgaaggtaaaacaaagctgtggtctcttggttcatttttagttagctgcttgcctgatgttttcatttgagaactttaaaatgtcagatgtagttttctttatataggtggcttttcagactcaaagcctttctaaaaaacaaacttcatttttcatggtggaacgataaaattagaaatgttacttgtctgtcagtttggaaatgcagctattgatgtttgtacatttcatgtttctgttgggtttgagtcacccatgccatctaagaaaatctcctttgtccagaaagaagggtggaggtttccttgtggttttagttcccacagggtttgtgtggagcaggagcattttccttgcatgctcagtaaacactgctaatatttctccgtgctggttattggtagtatgtagcaggggctgttaataagttttctgttactttcctcctgagtagaggatgcttactgctgtattattttccagggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtggttttgcttgtctttataataagtccgtgttgttatagatccactgagggtggtccaaaggactgtgagtcttgattggcttctaggacccaaatcttttcacttggatgttattgtgacgtgattaccatttaatgctcaaattatttcctgtgcataagttttaagatgtattctttcttttcccatggcatgtaaaactatttgtgaactttttcgtgttgagaatggtgctgtctttttcaatcttcttttaatttctcacatcccagctggccttagctatttacagaacatggggttagttttgttgtttagtcaggttttcttctctttattattcttttcattttcccttagctttgacccttcacttcttcattagagttattgatagtggagagagaaggttaaaattaaatcatcctgctgcttggtaataatttgatagagtagagacccagacttatcatcaataataagatttgggcatattttctgaagtttaattatctgacccttatgcgcctgggtaaatgaaatttagctgttctgtgaaagggggcccaaagctcattcacatttattttatgcctactagtgcttctgttatattagatacttcagagccaaaagttgtttccctttaaaaaatagacagcttaattcgaacaaaataaactaaaaattagtggaagtataaaaatggcatgagagagtatcccagcagtagtctcatggaagagctcaggctttgaggccagacagacctgggatcaagtccagcttctccattttcctttgggatcctctgtgagccttactgtcctcatctgcaaagtggtagtgctaattgttctcacatcacaagttttggggagaaataaatgagccaatgcatgtaaagagttttgcatagaatctgatgtaattgcttaataaatgttagctgtcattattatataaagttctagcaatgtcatgaaggggacgtagctatttaaaatgtactcttctctggaaagggaaagtggaaaattattaatgtaatgattgttattagcaaaacaaacattgttacacttcaggccctcccagccctcatgttgttatcattcaggttcttttttcttcatgtgttacatgaacacaacctgatttatatttagggtaacaggaaggaaactgtgcctatatcgtaggatggaaaaagggattccctgggctccctgtcccacgtgtgtggttactcatccaataaatttatattcttagtattttaaaaatcccttaaatggaccaggttgcttgttagttttaaagttctgattttcttttcttatggtgaaagacaaggaaaattagcctgtagaaatatgtaacaagtttactcattactcccagaaattctttctctggtatgctgaataatggccccaaggatagcaagccctaattcctagaacctataaatgtttctttatatgacaaaaaggtaaatattactttatttagcaaaagatatgattaagttaaggatcttgagatggggaattaacctacattatctgggtgggccctaaatgcaatcacgtttatctttatgagagggaggcagagggagatgctaacatggaagagaggaggagaaggcagtaccactgtggaggcagaaattggagtgaggtggtcagtgaatggtggcagccaccagaaagctggaggagacagcagattgtcccctagagcctccagaggaagtacagccttgccaacaccttgattttagcccagtgaacccaatttcagacttgtagcctgcggaactgtaacagatgtttaaaacaacatctctgttgttttaaaccaccaagtgtggcagtctgttatagcagccatgggaaacatataccctttctttatgcccaagttaagatccagcttctatacaatttttatgtcaaatatttcattttattggaggttccttttcttcaaactcagttctatatgttgagcacttctcagtgtagactcttagtgagttctgttgaaggaagaggagataaggacgtggtctttcttcagagggacagcaatcttgttggggagaagcaaccagaaacagtaaaataaagtgtgcaattggaccttaccatttacttcattcattcatttgcccaacaaacgtttaccaggtgcctgcagtgtgccaggcagtgttctagtgttgcagaacacaaatatacaaatgaatgagttccttcccttgggaaatttatgttctagtgaggaaggtggacaaaaacaagtaagtatagcatgttgaaggtggcaaataaaaaggagaacattttaacaggataataggaaaagggattggggtaggtaccatttaatatagggtggtccagggatggcctgtccaataactaatatgttgtttggtcagagatctggagagaaaagttatacagctctatgggggcctggggtaggaggtgttagcagaaggagcaggagtgcaaaaattcttgaagcaggagtgtgattggtgtgcttttgaggaacagcaaggaagctgtttgtgtcagagtgagtggagcagatgtggaggagagggatgtaagtgggggtcggggagggtgtggtggaggagcaggtgatgttggagcccaggggcccttgagaagtctttggcttttaatttgactgaggtaggaagccagcacagggctttgagctgttgtggagtcagttaagtgatctaacttgtattttggaaggatctctggttgctgtgtggagctaaacggcaaaggggcagtcaagaggggagaccaattaggctaccgcagtcatctccataaaaaataatgttgtctcaggtcagtgtaatgcagctggtgagaaatgaccagatcctggatatattttgatggtagactctgcagtatttgttgacagttggatgtggggtgtaagatcacagtcacctaacatactggaaggtgaaactaccttttgctgaaatgggaaagactgttgataaagcatgtttagagtgaaaaaggcaagagttggttttaggtgtgtctacttgagagatgcctgttatccacccatgtggagaagtggaggaagcagattagagttcatgggcaagaacccacctatcagtggtaaagggctcttacagtcattgatttgtgcttatgcaagacatgagcttaaggtagcacttacctattcacccacctttacctgccacttcctacctatgagacaggtgctgggtgagcccagaccacagagctgaggagtgcagtagagccatgcccagctaccagtagtgcaatgcatccttgttctcaagctgtggcatgaccagcgagataccagtcaggccttggtgtgaattccagctctggccaggcagtctggcatcactcacagagcctcagtgtcctcatctctggattaaacataataacattgtctttcaggggtgtctgagtgttggaagactgtcagccctcaagttctgtcaatgtctctcaaatctctgcacttcatcttcctgtcaagtctttttggtgctggttttaccccccctaaacctatcctaaacagtatagctagaataatctaagtgcaggtcagatgaggtcagtcccctccttgcccataggataactgatcataaacatgacttccaaggttctttgtgatctgcctctccgttactctccagcctcaactctgtccccttcttcccccatgcccttcatttctgtccgattgagcttccagttgaaggccctatgctgtcatatcaccgtgttctcctgtgttgtctctcctgcttcaacttacatgtcacttcttccaggaagtcttcctgccctagcaggagatgcccctgctctgtacttccctgtcacacttcagtaaagtgccttatttttgtgtctcccccactgcaccataatcttaagaaaataatgatatctatttcacaaaggccttaactcaggagcactgccagtaactgcccaaaaaagtgttcactaatattgccgatacatttgcttttttattatacttcaagccatttgaaagactgttcctcatgtacttatatcagcacattaaaacagttgtccatttggcattgtggaatgtgccattagatgatttagtagtttccctagtaagtgtgggaagaagagtggataacttataagctcaaaagtctaccagaagggaagaaaattggagaagtggacaggcagttatatgaaacggacaagagacaaatggcaaaaagcaatcaaggaagaagacagccggtcacttctatgtggaggcttctacctctgcagccatgggttcaagccccgcctgagggaaagtgggcactctgcattcactgagtcgctgcagtgttgctgggcagcaactcagtatactacgtatattaaaaaacaaaaccttacaaaagtttatgtacccattggtatcaattctacttctaggaatttatcctaagtaaacaaaagtcctaaagttttatatataagtatgttgattgcactattgcttacaatagatataaaaacaaaaaaatatgcccccaaagggggttgattaagtatagtacattcatgtaataaaaggcaatcatccctcagtgcctgtggggaattggttccaggacccctgtggatcctgggctcctctgatgcttatataaatgatgtaacatttgcatatataaaatgatgcggtatttgcatataacctatgcacatcctcctgtatactttaaatcatctgtagattacttataacacctgatacaatgcctacacatcactgcatttgcatagacttaatgaagtagttggtgtacagcaaggtcaagttttgctttttggaattttgtagaatttttttttttcctgaatatttctgatccttgtttggttaaatccatgaatgtagaattcatggatgcaaaacccatggatatggagggctcactgtattataacaactttacagaattatgttgtagaagaatctttaaataacatattgaattacttgtattaaattgttaggttaataaaagtagctttcataaaaaagaagattattaatggtgttctctttgtgctggaacaatgactaatgcttgttttcccctttgagtttttctatattttagaattttccataccatagttacagttaatggtagcagctataaaagaacactatgtaaaagaaaaaggaaaaatccctgatcactgacagaagttgtacttggattagtacttgacttcaggttcagtctcaccaggaaagctgaacttatgtgaatcaggctttattgaggaataaagttggtgaatataaatagtgattgctatatgtcatttacattaatttctgtcatttaagtcatagggtagattgtactccatctgcagtgctacaaggttaatttaacaaagataccatatactgaataaaatgttatgaagaattttccatcaaatgaataaaataacctgcgaacttattttccaggtgtgctcagtgaaggaacggcatgccagtgaaatgagggatttgccaagtcgatatgttgaaataggtatggctccaacacttgccttctgtggatgtaaaacttcattcaaaattttcgtcttcattaatctcacccagactgccatagtcttttgcctggatccctgcagcagcctcctaactggtttatcttcttccactgtgaattactgtcatctgctgtccccactgctgtcaaaatacagatcagatcttgtcatcatccttcagttcctccacatcgttctcagagtgcagatggaactcctcagtggatcacggggatctgtgttggcccctacccacctctccagctgtagcttatgccaagcttctccttggtctctgtgctgcagccacactgaccttttacctgtccatgcctctctttccccttgtctagcacagtatttggctagagtgttgctttccagggaaagcactgggaaagccactggacctccctgactgagtcaggtcttcccattttaggcactacagcactgcaggcctcctcccctttctagcacttgtcacgggttccagtgatcctgtgattatttgatacatttctgtcttttctacctgactgtcacctccttttgagcacacacagggtctgtttttgctcaccatttgtatcttgaggacctggcacaatacttgcacatagaaggtgcttaatattgagttgaatgaatcagtgactctgggaaacagctgttcaggagaagtatgccctggatgatgtaccatgacttttataatttagtttgaaaaaattattctgagaaaaaaaattgccatattatgagtcagctgaaaagttcatttgcccatttgcttggtggatgggtaatatcaatttgatgggttattctgccaaggtgaagttgaaataaattatttgcacatgattgtatttctgtaaatagaaagacatacattacccacatgactaatgtggttataacatttaaatctgggctattttgtacttgaagtcagaagttggtggtagagttttaatctttttttttaactttaggagtataactacatagttcagattgcttagtgtatggacagtaggtatatgaagaatgtagcagtgctgagaaaaactgaggaccaagataagagacaagatttatgactagactatatagataattgtttcaatatctttttcttctttccttgcctactagaaaataaaaagaaaaacaaaagcctctcaacatctcaatgcaatgtcctgagagattagtatttggatatttttaattgccagagaggtataaaaatgtagcaattgtaatcttctttccttagctgatacttattgatcatgtactaggtggagggcattgtgctgcttacataaactgcagtaactcactttatcctcacaggaactctttaagtgcaggtagtttgctttttattctatagatgaagaaattgaggcttaggaggtaaatgacttgtccaggatcttactactatagcgttaaaaatggatagaatctaactctacagaaccaccagaaagcttccagggaggcaaggaagtttgctgaagtgtgtgatcttgatgaggttacttaaccttcttgaccatccttttctcacctgttaaatggaggtgataatatctatcttttaggatgggtgtgggaattagacatggcataagaaatgtgcctaacatggtacttggcacacagtagatgctcactaaaccatgatggttattatcactatgcagactttcatcccaactctgtgactgctgatagctggctcagtggtggccctattagcctagaaccctgggatcacattattgcagtgtggttcatctgtactgtaatttacgtgaaatagaccatatgtggatactaacagtatcacattactgacattttactactatggttaatggttaagtaccattttttcccctcttaagagtaaacctttaagaatataagccatttccacagcaggaggcaaaatagtttggataagagtccttaagtaggataacagaaagggaaatattaggaggtctggattacaatttcctttagccctgaatagtgtgagccactgttctttggtaaatgaggtgaaaatggcattaagattaaagaaatacgtatggctgtacatttcttagaagccaattgtttataactctttctgttacaactcagactctcaaaaatagcacgaaagttattcctatcacataggctgttgatttattctgttaaatgaaaaataataataatataatgaagattaagcttcttggccaatcaccaacacatgaagagattctctatacatagggcttttgggacatcatattttctttcaaattgcattgttaaaaatagattatggtttgtgcctagcatccatgttttaacttcacttgcatctcttgtattctcacaggactccctgagcctctggtacttttcaccaaagtcttccatgatctctgtggtatggtagttggagagctgacatcatgatgttgggaaatgaaaccaatgtttgtgtgtcattttctgggagttttctgccaggggtagttgacttacatgcaaggaattaatgattgacttcttggtcttaatttcatgtggaattttgtttaattgagattaaacaactatatgagaatctatatagaatgacaagtcaggaagaaagggaagagaaaagaagggaaatcttttttactttcagtattgtctgtatcttcattgatcatatactgtggtcttagaatttagcacatcattcttttttcagtcttttaattgactgaaaaaacagtgacctgaaaattggtgatctgttttcatagtggaggagagttgtgagataattctttcctagatctaagtatctctctttatccacctgttaccattttgattcagctatatgggttacagtagtgggatctttgtgtgtgtgtgcccaggagtgatgtggtttcatctcttagtctgagtctcaatagaaatgatgacagctggcattcttcaaggtgtttttacttgaggatctaggtatgtatggttttctgttctgttatagatagttcagtataaatttctgtaataatctgttctgcattgaattttttttctaacattttgttatgaaattttcattaaagaaaagaactttgtagtgaatagaacctccaggattctgcagttaagattttactatatttgctttattacgtatctgttcatctattcattcctccttttgggagggatgtaacaactctttccccgctcagtagtgtagactcaggtttttgttgttaggagtggaattaatgaagtttctccataataagtaatggtaagaaatctgaagcacctgaagtaacaaatatatattgttccttatataacaaccaccaccaagcacagtgctgaatacattgcaaacagaaggtcatctaatcttcccagtatgcgagtgggtagcggctactatccccatggtgtaagtgaagaagctgatgttcagaagggttaggtaacctgctcaagattattcataaacaaggcagtttttgcacttaggtgtgcctagccgtaaagttgttgcttgtaatcatggtgtcacacagtgcttcccatgtttcctctacccagcccctggcctttgtttacagagtcttgttccagacattcagatacagaccactgcagaaatgctctagaatctgaagaccctttttctatatcagtgatgatagctgctcaccttttctaggaactgccagatgaaatggaaatgcagtagatttgtttttttattttggttcagagaaatatctcatttggagacttagaaattatattttcacttgctttatcctgagattgagagcttttcttcattgcttctcctccacatttttagataatttatagaacctgattgccttgggtgacctttggaattgtttctaaggaaagggaaccaaacttagattatgcttctttcagcccttttaaaaagaagaaaagcccttgtttgctattttttagtgtttagcttaagtttagttgatgcaacaaggtagttttatatttataaaataaagtgtaacatttggtttgaaccttgtgattagcaggtcattggcaatgcctttccttttcttttgtctaagcaatgtgctgtaatatactcactaaatattcctcatcagtgctgtttcaggagactaaaatttggtagatgagataatcctatcagcttagtgttgtcatttaattgacaatagtttgctgaatattgattataaaatacggaattaaattgcaaactaaatttgttttcagcagttttttatctgtgtgtactgttcggctcctgtctgatttgaatgtttttgttattttgtccattagccattcttttcaatttcacttcatgtatcagatcttctccataatttgctgatgtaaagcattgtgaagtcagttttactttaatgtgtctgcttcttagcacagcctgaagctgttgaagtgccgttatttccaaatgtattttcagtgataagtggtcatgctgacagaatgtctaaacttattgaaaagtctgtgggtattacatccagttgattataaaatactaatatctggtgactaaggggccagaatctcttgggaataagacactatctatcataaagggccctcaatgcattttcataaatgaatataagacaatgaagggtaattgttcttatttgtaaattgcttgacacacatttttgtttgtttctttaagaatcatagaagctaagatctatgggatgtcaccttatttaacttcaataaagaaatctgggtagcatttagctaatggacatttggggaccaataagggaataagaaatgggggaaaagaggcagtgcaagttctgtgtactgcagcgctttagcccttgcagcagcactgcaaattcaagagaggggctggggcaccctgactgcatgcagcagaatcaccagagagccctcacttctgttcttgccaactgcagtgtgctttgaatctaagcatctctgtattcttatattcttccccttcccctcctccttccccctaactccccccctccttctttcgatatagggtcttgctctttgcccaggctttagtgcagtggcataatcacgccttactgcaacctcagcctcctgggccaaagcgatcctcccacctcagccttctaagtagctgggactacaggcgtgcaccaccatgcctggctaattttttaattttttgtaaagatgtggtctccctttgttgcccatgctggtatcaaactgggctcaagaaatcctcccaccttggcctcccaacatgctgggattacaggcgtgagccaccatacccggccctgacttacattttctagagtgacttatggttgggaaaaataggacttcagattcctacttctcttatcttccacttaagtgactttagtcaagttacttaacccctctgagcctccttccctctctaaaataaccatagggtggttgtggtgaaaagcaatattgtatgtaaatatttagcatactgcctcacagcatagtaatgttcattaaatgggagctattattaatattagtattatatttagttacagtgagagagaaaaatagtggtttcttttaaaatcagaagatctgaaaattgtgttttataaaatttgtaatttaaagacaatttggggaagatgtaaataagggtttactgaatgattccgaggagattgataatgttttataattgcatttctcaataaaatgtatctataaacatatatgacagaggtacaagtaataaaaatattgatttaatgttgtctcataggtttgaatacacagataagaagtgagataacctagttgggaattattggaggatggttttttactttaaacaaattttgatttttatcctttgtaatctaatatccattagggttttaaacagttttttttttaaatgaaacgaagaggttgttttctctcatgttatccacaccatttctggcttaaggggcttatggtcatgattattgctgctgtttccaccctcatctgtacctcctcagaagctaaattttcttgcgctgtgctattttttgttttacacctgttcctgtttttgcacatagcatgtggtattttaattatctctttttttttttgagacagagtttcgctctgttgcctaggctggagtacagtggcacaatctcggctcactgtaatcgctgcctcccaggttcaagcaattctctgcctcagcctcccaagtagctgggattacaggcgcctgccaccacgcttggctaatttttgtatttttagtagagatggggtttcaccttcttggccaggctggtcttgagctcctgaccttgtgatccacctgccttggcctcccaaagtgctgggattacaagcgtgagccaccacacctggcctaattatttctttaaatattcagactcacaatctcctttaagttagggtcaggtcttagtcatcttgatgcatctagaagactgtctcgtgtaattgatactcagttactcttttttctttttttttgaggcagagtctcgctctatcacccaggctggtgtgcagtggcaggatctcagcttactacagcctctgcctcctgggtgctcgcgggttcaagcgattctcctgcctcagcctcccaagtagctggggctacaggcacgctgtcaccactgccagctaatttttatatgtttaatagaggcggggttttaccatggtggccaggctggtctcgaactcctgacctcaagtgatccgtccacctcggcctcccaaattgctgtgattaaaggcgtgagccaccgcacccagcctcagtcactcttcattgaattaagttgtaaccctcagagattatgagacccaaggaatgagaaagttctttcttgttaatttttataccaatcatatggcattcattatgcaactgatggtgtgtatgctatcgagggccagacactgttgatctatttgtgactctaaccctgaccccattgccctgggcaatgtaaggttgatgtattaaaacatgtataacagcaatatgtgaaaattttgtggttagaagattctgggaatgtagtggcagtggcagcataatttttcaaactacctagtcctcccataaaagcagaacaactaggtcacaaaaccaaaaacccacagacaacatttacaacaaaacttagtgacaaaggtagtcctgagagccccaagacacaaattaatgggaaaataaaacactgatcgctgcagggtgatatcagcatctgtgtgagagaaagcagaggggagcaagtggtcatctagcagacttgaggccaggggaactccaagatagccagttggcattcactggaaaggccaagaggctgctctgagaactgggcccaggacctgcagttaggtgtgagaggctgggcagcccagctacccctggcaactcacactgtggagcagccaggcctcctctctccactgaggagacactgctgggagcagaataaagcctgaatgagacagggacaatagaaacaaaagaaacaggtccagataacaccagggaggagctgagccaggaaatctcagaaagcaagctgccatatttttcatatcaaatggaaacagcagaagagggagctctaagagttcaataatggtcatttcacctaaaaagcaagcaacgttaaatccataataagttttaagaaaaagtgagtaagaagcagacataccagaaagacacacctacgcaatagattacaactgtaatttccagtttcagaggagctataagacatctttaaaaagtgatgtaagaaatcagaatttgaaaatctcaaattaggtgacaggcttcaggaagaattaataaataaaagctcatttcagaattgaagactgaacctgaaggaagacaagaacaaatagatgcaaagataatgttggtaagaggaatagaaggggagcaggaggaaaattgtaaaaatcacaaagcaataagaacaaaaagattaaggttaagtgataaatactgaagacaggcaaagataattcagtctaccaataaagagtccctgaggaaaaaataaaactagagaatgggacaaatactatagacaatgtcaagaaaaatttcatgaaaatgcagagaaacagaagttgaaattataaattaaaatagcacactgtgtatccgaaaatagtgacccataatgagcaacaccaagatatgttctaatgaaattattggactttaaagcgaaaaacttgggcatctagacctgcactgtcaaatgtgataaccattagccactgtagctgttaagtctttgtggtatggctagtgtggattgatttgtgctacatacagaattccaaagacagtctagaaataaaaggtaaaatatctcattaatcactttttatattattacatgttgaaataatattttaggtatgttatgtattattaaaatttcacctctttttttgaactctttatcgtggtgtagtccattcttgcattcctataaagaaattcctgagactggataatttataaagaaaagaggtttaattctcacagtcctgcaggctatacagtaagcatgatgctggcatctggttggcttctggggaggcctcaggaaacttaaatcatggtggaagacgaagtgggagaaggcacctcacatggccagggcaggagcaagaggcaggggtagatgccacacacttctaaaccaccagatcttgtgagaactcactgtcgtgaggacagtaccaagaggattgtgctaaaacagtcatgagaaatgaccattcatgagaaatccgttcccatgatctaatcatttcccaccaggcccctcgtccaacactggggattacagttcaacatgagatttgggcagggccacacatccaagctatagcacgtggctactgggaaattttaaattacatatgtcatttgtgttttggcccacattatatttccatggggcagctaatcaaggggcctctagcctcccttttggatgaggaccgtgtacagaatcgtattcatctcatcctcattctggatctagaagaccttgctgaatagaattttcctgtgaatatagtccttttgaacctctctttcttactctgctagaatctctgtcttttttcttgagttatttctagcatgtctaggaatgcttttatcctcctgaataaagcagaatgcagaagtccttccacctccatcaggaggaggaaggctgtgcctcagctgtaatgcccaccatagtataaggccatcatctaggtgaacatagcgcactccctgcagggcccgcgagctgagcctcagctggctttctagatgaccttgatctgaagtaaagccactgtcttttgtggctacctttaggaactctgcctgcatttttcactccaaaaaaaaaaaaacaaaaaccaaaaaaaaaaacaccctgtccagcttttgctccctgttttcatgtatttcctctctagcagaatttatgtttattttctttgtgatttatcttttccagataatcaggttgaaaatgagcttctgtagtattagaactgacagccacctgtattcaaactgagtctcctttaggagaacaaaatattttatttaaattaatagagtcatttttacgtggaatagaatagaattttagtgaaagtaaataaactgaaacttccattcgtccactgaaaatttgaaatataaagtctgtaattacttgaatatattttacaaagtcagtccataagcttttatatattttatgtgcattttttacaagaatatatattgtcattcaacatttctttctctaaatctatatgaagaatattccttataccttcatgttcattttgacaccactgtctgcagccagcccttctgggactcagcatcgctataaaagataaacagaatcttgttaaatctaaaagcaattatgtttcgctgcattagtaaagactaatggaaaaacaagacaccaccatttattctaaaatgtcttactttgtggcagaatggctgcagacatttccctaaatcagcaactcacattagaagtgagttcttttttgcatgatatcattaccagtgggtattaatggagatgaattgctgagtgggagagtactcgaaaccagataaatggccattattttggaattcttaatttgagaatcatgctgagtattactataattgcaattttgttttctataagagatttttgttggtataagggaattactttaacaaaaagaaagacataatttagtttcagttttatccaaatgttgattacttgcttacctgtgcgtctggaagtcttgacaatattattttcatgtaccacatcttttctttatgaataacatttttgtcagcttgtgatttagccactgcatatagtccgtgtccaaattattaattctcaattagcaaaatttggcaaggtttagtacttaacaagtaagcgtttattacaacatctggaattgagaagtgaaatagatatgtgcacctgcaatttttctttgttttgttttagaacacattggagtttctatcatgttcttaattagagaacaggaaattttctgtcttactcatacaagctattgtggactggggagttggcatgtagaggaggaaagatttgggtaggattatttcgtagtttctctgttctgtatcttggagctcattctcaagaaccaaggcctttgatgtatatttggttacctttaggagaaacactgacagtgtctgtcagtgagactaggcagcctatttggcatcccaagtggggagaatacctccttctcccaccccttcttttgtgattaggagacgttttcccttaggtgtctgtggcagacaagcacagcaaagcctgtgatttctgtgagaatctctgattctctgctcttcacccaagttgctggtaagggaactgtatgtgtagcatttcaaaaatggaatgtgatttagtaaaacagaatgcaagtccatttctaccagtcagagattagtaacctcaggagtgatgacaaccaaaacctcttgttaatatgtcttctaaaatgtgaaactgccatctctttcatcactgggtcctttgtggccccatactgtttaatatcatctgtacattccggctctcccctgctccctgcttcaccgcccacgtgcatgcacagcactgtgagcttctctagaaccttccgcagcctggttacgctagaaacactgtctctgcacatgtggtggaggttgaggtggttctccatataagctcttttgtgaacatttatcacaattaccactttaccaaaactattcttaagtatctggataaacacatttggttcaagcccacagagattaaggaaaaaatgtgttcctggcagaactgggaccagagcacttgcccttggacttccattgtatggtactttaattgaggacaaagcagatgaaatattatctttttataagtttatgttgctaactattacatctttttggtcatccacaattttattttggtgcgaaaattaaattgtgataacagctgcgtaaggaggatcattaaaggtcagcagagacaaggaacactaagtaatctgcaagggaaagaaagagggggacaaaggaaaattcagtatttcatctgtattatgaattttatttctactgtcattcctttctcttatagttgggaaatgttaaaatgacttgttcaagttcaatttagtggaagttataacccaaatttccttactcagcattcagtattggttccagtatgatacattgaggtcccctcattgggaaaagagtgtggaagttaactaaatctgcagctaataccacagaaccgtggagatgatctgaatgaagaaacttagaaaatgtggtgggtcagaacaagagtttactcccaaatgaatctgtgaagtgtagagtatgatttctggaaggatctctgtaataccactactgtatcagttagcttctgctctgaaacaagccactcccaatctcagtctcttaaaacaatgatcttttatattttatagcagctaataattagaatcatataataataatatgtgtacttctgagctttctgtcagatctttggggtccagtgcaattaaagtcacatacttcttaagtgatgcaatatgtcttcttgattttaaatggatttttttttaaaggaaagagaaatttattatttttctctagcctttatttcacttaagaaatactgatgtttcatcataaagtaatctgtatttatgcatctttttttaacttcaagttctttaaataatatccctcttctccaaaatagtgtttcataattacagataacattctttgtgacctttgtactactataatgccccaattgagaaaaacgaactcaggaattttaaaaaattattactgttactaataatggtttatatttctttttatgggtttcaaagcatcttcatgtagtctatgtcattttaaactacctaagcacagtgtcacccttgaccattcatgctgctattattgttggattcatttttgtttgtgatgggaatttgcaagtctactttcccacatattcgtttccaggattgatcgttgtgaagcacttgcagtgctgagttatgaaagtatgttcaacggtgtcccctttacgttagcttttaaaaaggggtccactagcattcacagtcattgtgtccctccagatgtgtgctgctgtttgcccctgttgatgatgactcctgtatcccttttgtttgcagtgtctcagtttgaaactgaattctacatcagtggacttgcacctctctgtgatcagcttgttgtactttcgtatgtaaaggagatttcagaaaaaacggtaattattttctccccagatacaaaggcatgtgggggttcacttttagcattacacccagatcaggttgttcatcagtagcatacgctataatctgagcagaactttctgacctataaaataaggttggcagagattaccctttagacctgacatatttactttccggaaactctactcattgcctgcctttgttcctattgctgagccaaaaaagagtcttttttttcgacctctcttggtatattagtcaaaaggaatgaaggattcctcttgctgaaaggggaagaaactaagctgacactgtgcattagcagaaatgacagcaatgaagttgatcagcagcaacaacaggggtccctgtggtcagagggaattacagaaagggcatttcattattttctttggtccagacatatttgtttacttcctagtgggctggtgattctaagtagcttgattatggctttgaaatggattgttgtgaaatctcagttatcagtgcaaataatggtacatcaaaatctgtggctaataaaaagcagcagatgatctaaattttgttgtgcgtgtctttggaagaagcttatatattgcccagtggatgggtatccacacccagtctccctttgaagctgaggacggccccattcccagcttgtctttattatgagagtccaggggtcctgccagcacaagaataggggtggcttcaaggcataaagaaggaaagcatactgtaaaggattttcttttggatgctgtatatagaagaaattgtaattgattctctagtcctttacagtaagtaggcaagtggactatccttgtttgtatcctttttttttttttaaatggcaagaaataaaatgggggagaaaaaccctgggagccctggttttgaagtggtagctgctcttgagcgtttctctgagcaagcacttgcattaggaagccatcactatagtaacctgaagctctgggtgcccatgttgctaggcaatgaaatgctatagacttaagtgaacactcagacctactaaaatcaatagggttggcttctagccctattgcaggacatcagtttgctattattttatttattttttgaaaataaaagcagtggctcctgggggagtaaatagaatgctttttgaggaggaatgcaggaaagattgagaatgtgattggaagaaataaagaagcagtaaaacgaaaaaggagaagcctaataaacaactgagcaaagaaagaaaggaaacctttgttaataaaagagtatttgaagggaataaatgccaaagataggccaacctcatagagcacgtagaaaatggactttttccagaagaagaagcgagggttttggagatgactggaacatgtttatgccagtgtatgtagatactcattttatagaacattaaagtacaccttaaatccttaaacacagaataaactcataaaattaaggcaaaaggaacaaagaggtaagctcccttccccctttattttttcatactgaaaaggtggtttagcgacattgaatacaatttgttttatatcattcagtattatcccccaaatagcccccagatatccacgtgatacctttcacgtacatgcatgttttcacatagttgcagggatagtcacatgctactctgcattgccctgttttcatgggcattattccattttccctgcgtatgtctgtgtacttgccaccatcattgtgtttagtggttgtgtactattccatctgcttggtacactttaatttattaaggtgttctcctagtattttacttttctttcattcattgataaagcacatgtgtgttagaaattgtgctgggcactggagatccaagatcaacaaaaccagatttctgctcttagggagttcacaggcaagggctgtttggccagggaacgaaagtataaaatgagattcacattgctgatgcttttcttatacatataaaagagccttttctatggtctagtgaagtgattttctttttattttgttcaaaatatttttttattttgctattctgattttgatatttttattgttacagtggtcaatttttaaatatatttcagttttctccattttttttcagttgtttcaaagtttagcaatttgtaatttctccacagatctgatagatttttcttcactagttgatcttttatagttgctattttatttttggaatgttttctgattgtaagtttcctgaggcctttcccaccatgcagaactgtgagtcagttaaacctctttcctttataaattacccagtcttgggtatttcttcataggagtgtgagaagaaactaatatgtatggctaactagaattaatttgtatgatatatagaaatgtaatttaaattaatgtttctctcttttcccccactaggaaagagaatactgtgccaggcctagactggacatcatccagccactttctgagacttgtgaagagatctcttctgatgctttgacagtcagaggctttcaggagaatgaatgtagagattatcatttaggtaagagatatgaaagatctggctgatatgcttttttaatgtttttttctcccccttcctacttgcaataaatggaatttaaattaaggtgctgaaagaatcttaagagaatacctgggtagactgtgtgtgctgaaaacaaggacatttggatgcagagatgttgcaaaacttgcataagctcctatagtaaaagggaaggctagagttcagaccaggacccgggggaggattgggccccttgttttttgttcttgtattttttctattgtcctaactatttaatgtgacacataatttaatgtcaagctgcatggctccgtggttgtcatatcactcccattttatgtgtcaggaaagttcgctctggggtggcagagaagttgtctttcttgtttgtaactgagtgctcagagcctgaaagacttctggcacattttaggtgttcagtgaatatttgttgagtggacagagaaatacacttagtcactgctcataaatacagggagaaccattaatatttagtcataccagagacatctgtgtttggctgttatcatacccttgtaaaatatattaatgaaaatagaacagttcagctttgtaggaatgctgtactactttaaacacaattgacatttgttgagaatattttcagttctcattgtggccaaaggaaatgaagaaatattctatatatgtttaaactttcttatatgaagaccctaatccattgaaaaacataagagtatattctagacttggcaaaaagcaactgtgattcacaactgaaagtgtccaatctaggtatttggctcagagcaaactctcctgcacacttagaaacccttcagaacaggttttataattgaattctgcaggaaaccctcagattggcattgtgcacaacatgctgaaatgatagattatgtccctagggcttgggcatctgtcatttatgccttaggtggccttgaccttgatgaggaggaaacatttatcgctgaccatggggtgtaattgttctgtaaaagtagaacaatgctgtaaatggccacaaataaaatttatatacagtagatgaattctaatatgcagtagacatagagaatttttaacactttttcagctgaagtcagagtgttgatgtattaaacgtagaattttaaactcaccttatttttttttcaagttttttagtatgtcattccctccctttctgtccttctccttccctctcttgctttttggtcaagtatttttacacttaaatatttttaaaagcactgaaatacgcttctgtcattctttaccctgtctcccacacttaccttccagcagagccaaacacacaacaaagatagacacattttctgttcgctcttgggttgggtaacctaaccaggtcctctgaaaccattgccaagttttctgctgttcagtcaccaagtcgttcctctcttttctcacctacagaatactctgaaggggaatcacttttttacatcgtgagtccgagagatgttgtagtggccaaggaacgagaccaagatgatcacattgactggctccttgaaaagaagaaatatgaagtacccttgattttacttctttgaaagtattgactcatctacagcatagagagagaagataaaatgtttttgtaataaatcttttatgtagtcaaagtagagtttcccaagccaaaaatatgtaggaagttaataactttctagtacccccttcagaaattagggaaccaaaagattgcaatggattgactggctttcctgttaagtgggggaggagttgggagtggagggaggaggtgagttagatctagactgttggaagtttcattttttgattttgttcaaagaaattagagatagtatttcagaagtgtctatttagatttaatgaaatcgtttattttatacttatcacatttttactcacttaggatggtttgaactatcagtttggatagaatgatgttgtccacttcattgaggtttggcttagattaatttgaatagataatgcccaatatcgcttaaaaaaaaagaaaaaaaccatttttcaactttaatagctacaaagttacgttcttagatgggcttatatactaatttaaaacaacatccacaacaaatagtctacgtatttgttgtactaagtttgtcaccatctgaaaggatttggaaaaaaattttttttttcatttataaactatttaaagtccaggtatcgatacctagttcataacccagtaattaccatgttactttaaatccagtagtttctcaaagaaataattgtatgttttaaatatttatgttaaagtagtatttgtaaactttccaaaataaaaacaaaatcagagatttttcaaagacttaattttagatatacataaacatgcgtatagttcacttttttattgaaacataagggaaaatgctcctttatcaatatgtcataaagatctagaagacagctgcctttttttgtatggagactaggagactttgttgtattttgatttgtgtctgaaatgtgattccattgtcctaatgaggaaatgaattcaaatggaagtgggagaagtcttcattttggttgactgcctttgagtttgaattcagtgaggttcattcaaccatagcattaacaattccaatgcttcaagcaaaagccatgggaaaatggagctttattcgtgtagtgcagaatgctaaaccataataactatagtgtttataacctcaatatctttctctcccaccttctcccattttccctccctccttttctgctttttttttttttttaaatcatccttatgtttggaataaaggaagcattgatggcagctgaaattagccaaaaaaatattaaaagacataagattctggtaagtgtgcaatttgttatttgaaacataattttatctttcaataagttatagtgagactgaaaataatttgaaaagaacaggtttttcctatcttttgagaatttattttaaactaattccctaacctatgagatcaaaatattttatcaaatcagtttctgcttgtaaacaagagacttgaacacctgctaggaggcagttttaggtaatttggaaactgtatctgtggaaaacactttaaatacagagctttctagttatgtgtatgaaagtttccctaaatcgtaggtaaaaatcacattatcacaaaatttatcaaaaaaagagaggtttcctaaaactgcattgctttggtgtttccataataacagactcaattgattttgttatggaaactaatctagagcatcaaatacatttttattacattttggactcaggaaaaatagaatgactgaaagcccctttccttgttaactgtgacagtgaatgtgcagatggagagcagaggaactcacatcctgcacatgtgaagggtccttggagaccatctagccgagttcccttttttacaggtgaaaactggaagctcagtcttttatgcctatttgggtttcagtacaaattctttctgcctacattttccctaccgtaaacttctctgtaaaactccacatgaaagcctgaattgtcaaagagtgcagaagcaaaataatttaggaataacaggagaatagaaaaccagagcatcttaaaaaaaaaaaaaatccagccaaaattgtggagaataagcaaggattctctagaaatggaagagaatgcattccggcccttagagtagttaacatatgtgaagaggcagagaggtgccacagcttggcctgcttggttatgtgggcagttgaaggcttttttttttttttttgagacggagtttcgctctcgttgcccaggctggagtgcaatggcacaatcttggttcaccgcaacctctgcctcctgggttcaagcgattctcctgcctcagcctcccgagtagctgggactacaggcatgcgccaccacacctggctaattttgtatttttagtagagacgggacttctccatgttggtcaggctggtcttgaactcccgacctcaggtgatcggcttgcctcggcctcccaaagtgctgctattatagacatgagccactgcacacagcagttgaggggtttactacataggtagcaaaggtcagatcctgaagtgccgttcgtaattaagagcttgcttctctcttggaacatctagaagtcaatttaagctttcagacatcagatttccctgttagaaagattctctgatggagatggggccagaggagggccagctgagatggagatcaatcaggaggcttcctaatccaggtggaaggtcatgagacttacacagaatcaataggattggagaggtgaagatagatggaagatacagtaaacttttaatctttgggatgtggtaactgactctgtgtggatgaaagaataagagtaaaaatctaggctgactcccaggctttgggcttgggcctctggtttggtgctgccatttactgattgatagagataccctgtggaaggagaagcaggattgggagaaatgatgaatcctattttaaacacattagttttaggaatctgtgggacatcgtagtggagcccaggaaagaaatttgggctgaaaagttgagtctcagtttctgcacaggacacattagggtcctattagcactactgactgtaacctgtttatactcttagcttgctttatgtaattatgcttgcttcttaagcatattcatatttaaatgtatttatattttcatacattttagagtgagtgtcatgaacagaggaccatgaatggaaccatcaggaatgctgtcattcaagggatgatgcatacatagtagatttggaacagccagagcaaggtcatttcatgggagctgagagaggagagaattccagggtaaagagaattaaatgcttgagtagtggaggtaagcaggtcagaagggtaagacgaggtcagctggtcagttgtacactggatttggtgatatgaaagtagtgaattttctgtatgtgtattatttattctgaacatgttgtagggagtgaaaagtgaataggagattataaagtacggttctgagtatagattatcaggttagctgtgaaggggaagagagtgaaggctgtagctgaggctgtagctggggctatggcatcctgggatgatggtagtttttgggtattttgtgtaagagaggcacttaaacatgcttatgctgagggaaaagaggtaaaatagagttgacataaaaggttgatataaaaggaagaggaggagtgcaggataagctccacagtggagaagcatggacgtgaggagaaaggttggaaggattgactctgaaaaggagacattctttctctgaaccttgatggaaagaacctgtgtagaattgttacgtgtgatctgtttccagaaaaataaggaagttagacactctttcttcacttctgttcctatagacttgaaatatgatttctcacatagtagttattaaagtaaaaatttaatatactaaaaatgatgggtattttgcttcactcttgaaatgggcatgtcctgtacattagtcctatacattagttatgaatagattatttttctcttagcatgatgtaatttcataccaaacatgcagagaagaaatgggctcctgccatttttttttttgccatccaagaaggtatttcttatgcacctttttgtacataaagtagaaatcaacacccaacgtttcttatatatatcaagcttaagcttctggtgaaaatacttttaggtgcaaatagtatatgagaagatgagtcatggggagatcaagcaagagctgtcctcccatgcctctggtgatgttggccaccccaaatcctttcagaacccaggtagaataagcgaataaacatgaatactctgaagccagtcacttccctgctttcagcccaatttcttctgtaaactgatgggtttgaatcacaggtttttctgagctcatatcaactttaatattccctatttcctttagtatgatagtcattatttcatttttcttataacttctcttcagacttggggtagaagaagtaggtagcttgcattctacagatgaaggcacaggaaacaattttatatacattaacagtgtggaattgttcgatcatgtttctaatatcgaatacctcctttatgaaaaaatgtcttaaagggggcagattaggagcctttaaaatactaacattatttactttttttaatgacctgacctgtgaattctaaaatgtatgaaaatataaatacatttaaatatgaatatgcttaagaagcaagtgtaattacataaagcaagctaagagtataaacaggttatagtcagtagagctaataggaccctaatgttatgccctgtgcagaaaccgagactcaacttttcagttgtttcagttaaattttgacatttcttcatttggctttctctaggatattggcttggcatatataaatcacctggtggagagaggagactatgacatagcagcacggtaatgatgacattttcacaattatttgttaatataaatagaattgagcattgctaacagtaaaaataagccattctttgcagttgacattttatttttgtacatctttctaacgagggtaatttttgaatattatttttaaattataatttttgaatattaatgattccaagcacagaatcagtttaatgtttattattttcccaactatttcatttttaccgaaggagaattttttttctcattattaatgagaaaggtatcaagaaccatgaaggatctcagactttacctatttacagtctaacaagttagcctgtcatttccctggttgctggcagaagacaagagactcccaggtcagagctaaaggactctgtgagcaatagtaccagccaaggtactgctacaacaatagtagtcaaatagagtgtcaacatttgccccgatccccaaaccccaattcccacaatgcaacagagggtgggcatggagatcctgcccatgcagtgggttgtgatacggaagaggacccctgagcttagggtatctgaatcttttctagtgaccaagaaccccatgtattagtccattctcacactgctaataaagatatactcgatactggataatttataaaggaaagaggtttagttgactcacagttcagcatggctgaggaggcctcagaaaacttacagtcatggcagaaggggaagcaaacgtgtcgttcttcacaaggcaggcaggaaggagaagaacaagagcccaatgaagggggaagctcctcataataccatcagagctcgtgagaactaactcactatcatgaaaacaggttgagggaaaccatccccatgattcaggtatctccacctggtcactcccatgatgtggggattaatgttaactacaattcaagatgagatttgggtggggacacggccaaaccctatcaccttgtctgccttttgtcctaaaggcgtcattttacctttattgtactgggcagtaagaaaccttccctttcctcaggagggagacactatttgtgtcgtctcatttctagagctgtttgctttataagcatccttggaagatagtccagaagaaagtgcctctgcttatgattcaaagagaattttcccaacctaaggatggcagttaaatagaagtgactagaccccaggatcctgggttgcagaggtctgtggtgggcagaacacataaatgttatgtagtggtgtgcaagtctgtgtgaggggttcccactggaactggcagtgcccgctgcatgactgcatggcagtcctggaagagtgccctcaagcctgcttctcgtctcctgaggttatttaagaaaatgtgtttctttgatgtgtaaagtaaggtttcattcatacataagcagtcctccaggttatatagtaggataggattctagttttctgaagtctgattttgtagtgcataatttaaagccatttagaaaggttctggcactttggggtatgacaagttttcttcaaggcaagaaaggtctcccgaaaccagcagtgctcctctgggtaaatgggaaacttagaacaggcagatagttgggaaagcccctagttatagtcttctgaagtgattcatctttatttataagcattttatattaacttttataagttgtgttaatttatgtatgcaaccaaatgagtaacagtaatatctttatgttcgttggtacttgagatagaaattcatcaaaactctgagaagagagatttctctaaacctctggggaaaatgtctacttattctgtctctgtttgttttttgtttttttaatatatactttctttctgcctgggatgtttttactgccagcaaatgccagaaaattcttgggaaaaatgcagcactctgggaatatgaagtttataaatttaaagaaattggacagcttaaggtaagcaaagccttatttttaactctcagtttctgcaagtagtatattaatattgcagtggaaacaaagataatagtactcagctcttttttaggacgtgattattatctcagatggaaagaaaaatcaaacttttagagacagtttcaaaatataagcctcgtgtaaaaaaaaatatataagattatatatttattacatatacaatgtgttcacttatctctttccaattctctctgtgtttagatgaagttttcatgctctttttaatgacttttgaaaataggtgtaatctcatccagtaggttataaagcataagactttttttagatttactgaataatattgtatttttcaagtaatattttacctgctgaaagacagatggaaaaaattgaccacctagctctaatgaataattttgatgtttctttttttaaatctttcaacttagtgcacaacatcctaatcaatcaataaagtattcctatatttgttttaaacatttaaaaatttttcagtatttgtggaccttttgaatgctctcttcaagttataaatatgctttaaaaattcccagttactcatcttgtcaaccgtgtgactcctcctgtctgccctgtaaatgttacacttctcattgggtttattggatggtttctggaggattttatccagtcgtgcctccctgtttactttaatggctgtgtaacttggaccttttttttgaatatcatgtgatggccgtttctccttgtatatactgctgatgatgataattcaagttaatataaatccattccttcccaaattcagtccttttccattgagtctgtgtttgtgatacacaatatacccattccccagagtgtattagctcaaagccactgttcttgattagaacatgttacacccctcctcattctgtttaatctccacttcttgtcatttttttcatgtcaataccaatcggggctcttctcttcccctgtggtaccattgccttaacttttgcctgagccatagcaaatgccttctgatagatctgtgggcagccctagcccagagttatctgcataaaaaataagtctggactctcacttccctaatacctgttgcttccctcctgcctatagaataaaatcagaattcctctcaagaccccacctccccttcctctccagcctcacctcccttcagtgacgccatctcgcatctctgggctcctctgacctccctgcacacagatgcatgttcatggctccacgcctttgctcatgctattccccctgccagatgtcctgcccctctcttattttttcctgagaaacccagggctttagtgggcatggttctcctctgctgctgcagcactgtgctgacccctctgttataacacttaccacacaatacagttattgtctgtttaattgtctgcatatctttcttctaggacttgtgagctccttggggatggtgaccttctctgtctgtccccagtaaaaagtgtggtgattggattgtagggcattatagggtcattgaacagtatttgtaaatttgacttttaacacagtactgaaaatatctgaagaacacaagatgtatttttcctaatttcaaaagatgattatgagttggtgaaggttggtaaactccagttgaaggaaggaaagatgaatagattacctgtactcctcgattacttaagaagtcgacttttttcatctctgtgactttctccctcctattatttagatttctattaactcatcaggaagaacagagagataaagattaacctaggcaatttttaaattcattcatacatgtatatacttttgaaaatatattataatttattgttagaaagtagttttcatttaaatcctgttcaaaacatttttttcagagtactgtattccctcacatttttaaagtaaaaatatactttatgttttctgcataattggaatgcagttttgttttttcatattttaatggacttttttttcccttttccttacctaggctattagtccttatttgccaagaggtgatccagttctgaaaccactcatctatgaaatgatcttacatgaatttttggagagtgattatgaggtatggtgttctgatgtggtcatatttacttgttctcgatgggaggtgttaggaaatctagaaaggaatacaatggagcaatgcctgtaaaggaaacagatttgtagtttgcatgtggcaggtgaaactgagctagagaaactccagtataactcatgtttatgtagacagtgaaaacacttagtccgtgtgcattttaaggaattccttaaagttaccttctttctagaactaaagaaaaagagctaagtgctattttgtagatttcataaatacaatagcagctgctattccatctttgatatcatcccagaagaaagagaattatgagtgttctgtgaaaatgatggagaagagtacaaacttcctttacaaatgctgaagtatgttataattttcctatttttaaagtaatgtaatttaagcatttaaaaaaatttattgtttttatgattctgttacagttattgcacatgattgaactcttattttttcatgaaacttttaaaaatcctttatcgtcaaagttaccctgttgatttcatatctggaacactttttattgagatggaaagaagcatgacttaaccttagagattgtagatgttttctcctgaatgttttaggatgtatgtctggtcagtactgttaaggaggttgtaaataatttgtttttattttcataagctcttataaatagttcatgttttaccttcccttattctcagcttaattatttaattttgaattaaattgtcacattatcagtcaaatagctgtgttccctaacaacacttttgatcacatattatgtggagagacattttgtgttgctaaacagagcactgaaggtcagattacaaaaaacaaactgtacttctctggaatattgacttgtcaatttttttctccctaaaaagacatgaagtaatattggaggtaaagatgcttcatgacttctttgtatggggtttctagtcatatgcctgtagctttgcctattaatttacgacccagcagagttaaacagttaagctttgtttaatattaacgacaaacatataagcatgttaaaaattggatgatttctgtggcatttcatttcatgagtactttctagacttttacttattatgataggtactgaggttttctataactttgctcattcaatcataacaggtcccttgttcctgtgtcctctaattagtaataatggccacagatagattttataaatatttcttgggtagcacatttattcaagggtacacaaagccagttgaacagagagaagcctaacatgaaatatgatagatgtttatttcagtttatggtggggtcatcatgcttttatcatacaagatgactggttattttgtctttattttgtgttcgaagttggcagtaccatgaggctgttgcatgatagggaaaagaaaaaatgaggccaaactttcttctttccctgagcattattattaatggtctaggggctactgtgagctgctggtattggggtagaaatctttacagactattttatcttatatagtcttaagaaaacagggctgtcacggtggctcacatctgtaatcccagcactttgagaggccaaggtgggaggattgcttgagcccaggagttcaaaaccagcctgggtaacatagtgagacctgtctataaaaaactaaaaattagctgagtgctgtgacatatgcctgtactctcagctattcaggaggctgaggtgggaggatcacttgaccctagaggctgaggctgcagtgagctgtgatcatgctactgcactccagcttaggtgacggagtgggaccctttctcacaaaaagaaagaaagaggctgtgtgtggtggctcacccctgtaatcccagcactttgggaggctgtgggaggctgaggcgggcggatcacaaggtcaggagatggagaccatcctggccaacatggttaaaccccgtctctactaaaaaaaaaaaaaatacaaaaattagccaggcatggtggcatgcacctgtagtcccagctatttgggaggctgaagcgagagacttgcttgagcctaggaggcggaggttgcagtgagccaagatagcgccactgaactccagcctgggcgacagagcgaaacaccacctgaaaaaaaaaaaaaaaaaaaaaaaaaaagagaggaagagagagagagaaaaacaaagaaagagggagagagagagaaagaaaaggaagggagggagggaagaaaggaaggacaaggaaggaaagacaaggaaagggaaacagagaaggaagaaaagaaagaaacttgatctgaaatattattttggttctacaaacattttaatgttctgattgaatccattcccaaatttctgaagtaaaatttcaatcatattaatatataagaagtttgtaatctaaatggaaaatatgtggtcttttgttctggtctcttgccatccttccaggggctactttggtagaaatcgggtggaactttaatgaaaactatattactgattcttttgcacttttcttaccaaatcctggtgcattacagaagcagcttctatcacattgttttcatttctaagtattatttaaacaaattcacagtagttcattaaagtattaatggagttatttaatagtaataatgtactattttttatataaaccaaaaagtgactgagacagatctcaatcgactttaaggtttattttgccaaggttagggacatacttggggaaaagaaacagggtctgtgtcctgtgctttttccaaagagattgttgaggacttcaaaatttaaaggggaaagagcaagcaggaggcaaaggagcaaatttaaaaaataaataaataaataagtagggggagagtaagcaatgaggcacttggtcacattccagtgatgctctgattagctcaggaaatctacgttttacatgtaaaaagagagaagtggggaaaaagtcaattatgcattcatctcttgctcagtagatctagctttgacatgagctaaaggaagcatgtgaaatgacagctctctgtttgggaacaaaaggaaggcaatttttgcatgactcagttcccttaactttccctttggcttagtgaattggaggtcctgagaatttattttcctttcacatttaataacgtggatgtttttaattctctttactgtcttatgaacatgtttttgttctaaacattgtcaaggatcagtaagtaaactgctctgtcatactttgagttataaaacatgaagtctaaagtcgggaatcagggagtagagactgagcaagatactggcccagaatcagctgtgggacggaaacaggatcaaatcggggaaccacaaaatttgagatctagagatagccaggataagagccaggggataagacttgagccaaagtctcaaattccaacataaaactggcattagaagccaaagtggaaggaggaccaagatggtgacttgttaaagatatagaatgctggacagtttcactgtgggagcagccctgtcccaagcagactgccacggtcagttgtgctggctatacagtgcacaactgcataaccagttgcacccagcagcccaggcctaagtgcattagaggactcttggtggtggggaaagtagctgacttgggtaatatctgtaagatgttaaagctgtcatccaaatgttacagttagtccagaatggggatggagcaagtccaacctaaactcttgtccatgcactttatagaaggaacaagatagctttcttagttgtacatttcgtaaaactaaggacagaagtagatggcacgacctgcctcccaggaatgctaaatggagatttattgtacaataatattccctgcaactcttcaccacacccagacccatagtctgaaaattgatgaaatatttattgaacaaacttttaatcatataattgtttggtctgttatgtgactaaaagtgaatacttttagggatggtttaaattgtttggtttgttttgagaatttaggagaaaccaaactcagtttctcatgctatactctcacaacacaacacttctgtgaccaaatatctgggtttttccgctacacaccaagaaagcaattagttctgcagtggacaccagctggatgtcctctaattcagttcattctgacactgtctacatgaagatagcatcagttcctgcaggctgagggctcaggcccacaagactgcccccacttcagacataccaatcacaagttataggctgtcacctgtacttccgactggtcaactataaactggaattcccactaccacctccttagatttgactcatttgctagagcagctcatagaactcaggggaacactttacttacatttactggtttattataaagaatattgcaaaggatacagatgaacagccaaatggattagatgcagagggcaaggtatgtgggaagaggcatggagcttccaggtcctctttgggtgcaccaccctccaggaacctccaggtgttcagctcttggggagccctccaaagccactccttttgggttttaatgaaagcttcattacttagacataattgatttaaacactgggccattggtgatcggtgtaaccttcagcccctctcccctccttggaggttgtggggcaggggtgggggtagggctgaaaagttccaaccctttaatcctgtctcagtctatcctgtgcccaaccccatccttaagttacctaggggctgctagccaccagtcagctcattagcatacaagaagacacatcattttagagattctaaggattttgagagttatatgccaggaaacagaaggaggaccaaatgtatatttcacaatatcacaactattattctgttgaatgagtgttctttttctgtttttcacctttggttagggttttgccacattgatccgagaatggcctggagatctgtataataattcagtcatagttcaagcagttcgggatcatttgaagaaagatagtcagaacaagactttacttaaaaccctggcagaattgtgagtatacttaagtgtttctttttccatatcagtctgtgttgaaaagtttttcatactttagatttggcaaactccaagtggagaagatgtattttataccattttcctacattccttcttagtaaaaacctctcataaacctcaaatgagtaggcgataaggacatgtgtgaaactgtacaattgcaatgtaatctgtttcccagagaagagaacccctaacgcacagcgcttgggagaggcagtggttaggaaacaaaagggtgccaagttttagatcactcaagcataacagtttcccaatgagcaaggctctggattctgctcttctagggtcttcaagtcagttaatttaatctctcaaatgtcaattccttatgggaaaattttaaactttaaaagagatgtcataatagaggactccctgaccctgagtcagggctcagaaaatggcagcttggttaatatttttcatatttcttgggcacattcagtgatgcaggctttgtgcgagacgcttatgatacagagatagataagatatgctctcaagtacttcgatctagggaaacaagaagtatactgcaggtctagccaagacgaccatccctgcatccacctctcctcagtgcccccatcacctcaggccactcctctcccttgttttttcttcttttgcccaaaaccaaaaaaggtataccaaaatgacctagaactctggacgtgttggattttccacaagaggaggttgtgtttatggcattctaagttgaaatgctaatcattttctcttggaaacgttgtcctgttagataccccttagagtctgcagcacgttcgtaatggaccaacagtacagcttcagttcagtgagctctcaagagctgacttagggacttaatgtgaaaaacattgtttcaatggaaaaacacatttcagttagacacagcccccttaaaatcagcttttggaatattagccatttgtcagctgaatactgcttgtaagaattggaacggatgtttctgttactaaaatgagaacttcatcctggatcctagtttctttgctgtatggatgtttgtaaaacttttgagactgagacccccaataaagaccatttttattacttgaatattgtgaattttcttaaattttggcaacatgagaggcaaagttctgagaaagaaatacttattggtcatgtatagttaaatcctattcaaaaataggaatattttttgaaataaagttaacttttctctctaaaggagtgtttccatttttaatattgtgaaccatgatctctctgtgtgtgttttaattagaactgttgatgaatattaatgtaaaaaatttgtattaccaggtacacctatgacaagaactatggcaatgctctggaaatatacttaacattaagacataaagacgtttttcagttgatccacaagcataatcttttcagttctatcaaggataaaattgttttattaatggattttgattcagaggtaatgtgctttttattttagtactgtcaattatttttactattccaaatatttaatacttagatatctatccaaatgctggattggtgaatgaatcacataacttggctttatgccgacaatctttagaacactctgaccctcgctagatgttgttattctagttgtttggcattcaggaatccttttcataatgtagttattctgtgaaagcaattcaaagttgatagagaacttttaaagttgtgtgtgtgcgcatataaagtaatttcttgctaaaacaattcatataatttatagaaacaaaccacgtatatactttgactcatttatccctcctaacctgttttccagaattttaaaattaagtgaacttccatcttgaccgacttattactattttatttcttggtgttcacgtatcccagcatgtggggtttcccctggtttgaggtgatgctcatgtccaggacatgtggaatgttattttattgtgtgacaaatttgaataacctaataataaatttacgccccctaatgagtggacccagccacagctcacattggcgcttgcaaagtgatgcaagctgtgtgtgtgtgtgtgtgtgtgtgtgtgtgtgtgtgtgtgtgtgtgtaaaagaaatctaattacaagtgctcatgacagaaataatgaggtttataaaacagtgttcttattcaaaaaattgaaattttagataaacctaaaagtagaaccctaaaggctccaaaaggattaatgcatttttcaattatattgtactgtatttagagatattgtgtgctctattaatctccaccaacttaaacttaatttagataggagctagagctacctctttttctcaaagatgctttagccctttttaaaatactgagtcaagtctttagggactacagatttacgaagaattacgtagctccaaggaagttcaggtagagcggctctgcttgtctggcagaggatgagatgcttatgtaaaaattaattacattttcctcatatctagtctcccctcatgcacccccttccattgttctccagagctcgttttgcatatgttcctgtggaaaaaagatgaatgagctgaaactaattgctattctagaatgtgatccagatgtaaggaatcagagtcttctggttagaagagaccttagggataatctactccaacaccctcgtatttcagagaacaaaagtaacatttggagcagacagctaggtcgtagcagagtctagaacagggcccccaggtgttccgtgtgaggctcagtctggtgtgctgctttccctcttcctcttgacataaactgtctagtttgtgtttcctgaatgataaaagtggctaaagtaaattctgaaagtccaaaagctttatgtcattatgaaacttcaggtatctcattctctttctgactcttattcccttctcctcataaaaccagctccttctgtctgtggagtctcatagggagactaggtcgaggttgaagtagctggaagaaaagctcattttcttgatatactggtaaagagatgctctccataactactgagagtctcatgagaaggtgtgaaggtatccgagacatcggagggcggggggctaggatatgggcagtcaagatgttttgtatttgggaagttatagcaaagcaccattttagtagtgtgcaaaacacataggcttcagattgagatgcatttgaaaatgcagttcttcacaaatgtcattttccataagagccattgtaaagccaagggcctccttaagtatacaaaataagccttccacctgtgaactgtggtaggtacactgcattgtgtttagtcttctcttcttaaataacggatttcattgactgtggcttttcttatatgtttcagaaagctgttgacatgcttttggacaatgaagataaaatttcagtgagtgtcatttgtttttatatgtgttaccagatgaacgtctgggactcctatagctgtgaagaagagagtttatcagataattttgtagctgtctttctgtcctcatgactccaccttgaaacttttcttttttatctagattaaaaaggtagtggaagaattggaagacagaccagagctacagcatgtggtgagcatggcagtctcctccttttgcccttttgattgaccagtgggtgaatcacctttcagtattggtgcgaggaggatactggagtgaattcttcaaggaggttaatattccagttggaggtttcaccacaaacaatgttctgtaattaccaaaatgcagcatatgctgtgaattcaaggtcagggattaattgtagatcaggcagttgaattttgacccacaattgaattgtgatggaaaaaagttaccaatctatctattatattactataatataaatatatgtaacataactatatatttaactataatgaatgtttttgtgttatgttgtgtctaggaataagcactctccctctgtagttgccattaaatataaccatggcatatatcacagtaaaggccagtatggcaccgcagatactgtaccaagttctcctgctaaggaaatgtcagacaaccattccatatccagaccacagagcgataaaagggcagagtctcatttcttttgtccctcaccatgacaatagctaattccatatttcttgtgtgctattggtggttgtgtaattaaggcctgttattctagatttctttggggggctacttcaattctctgcattgcatcatcatgagagtaaagcaggaatagttgttttctatgtcctttaaaagttatacaagagaaaacttagcacacttagggattatatcagtaggactatgggtatcagatacaataagtgcacttgtatctttgcccatctcattgcaccctaggaggaggcttagggaatagagcatttttttcaaaagtcagttttctgctttgaagcttttgaagactgcaggaagggaatgagaggcacctttttttctcttttgctcagatgctactgctgcattgttcatgattggaaatctcaagattatctgcttcccaagcaaggctccacattgctaaccaccttaggaattcatttataaagcagtgatttctgacttacttaagccaggagacaggattatgggcagtagctctctgtgcgacaatgtaatcagtgcaatggtgaagtggtggcacagcccacactaacatggctcatcttccctgccaggcaatgtcttgtttctatatatataaatttgactcagcattcatgtgacagggcctccctgtcctttttgcactctgggaaacagcaccacatatccccgctaacacactgaccccagtgccagtggactggcggtggtgttcatcagacctctgcctggcacatgagttcagtctactgcttgtactgctccgttttgccttaggaagaagtgaacaggaagcctgaagattggtttcttaaggtgcatgtgtccatggttaggcgtcattgtgactagattcaacagcaataacaaacatcagcgcatttacagtctcagctgcagggcggctggtgctctatgtctgttataaaccaatccacttggaaacagcaacccaaggtgttaatgctcgtgggattggtgattaagtcttcctgtcttcagtagattgtggggtttttgtttacatttaatattaactaaacattgaattgttttttgacttctgagtactgtattgatagacttaatcttgcctgtgaggagaaagtgaattactgatttcctgtgaagttaactttttttcagacagctaaggtaaggaatcagttttgaaaactgtttcagaacacctgcattcttcttgatttttactttgtatttttgtttttgatgttaccagtttaggcagcatttcatttgaagagtcaacaaagaggagatgcagaatgtatggaaatgagtttagtgcccgctacttgagtttttaagaatatgtgcttgtcccaggactctaccctcttttgtgtaaaataatttttatgatctgggaagaccactcatctttttatttctgagccaaagcagataccaatgatgatattgacaactactgtcattaacatttctgtagttcttagtgtatgctaagttcattggttctgagtgatttcgtaatggcaactcgtttaattgtcacagtaactcaataaaatttttgtagataaactgagtctcagagagattagtgacttgcctaaggtcacagttggtacgtggcagagtcaggttttggggcccttctagagaaattatcggaatcctttgctctcccaaagggttttcctttccacttctccatcacctagaggttttccctgaagactgcttctcccccaacctgtccatgggaggtgtttagagctaaaaatagcaatgttagccaggtattgcttttctcattttaatgggtcacggcttatcttttgttccttttagtatttgcataagcttttcaagagagaccaccataaggggcagcgttaccatgaaaaacagatcagtctttatgctgaatatgatcgaccaaacttacttccctttctccgagacagtacccattgcccacttgaaaaggtaaggcacagactccccgacttgtacactttggatgaagaggttgtcattgatggtaagttgtttgtctttcttctctttctatctctgttcatctgtccctttccagggggaagactgttgctctcaaagaagtaggtttttggctgggacattctgtcaagaaaaggagatctcattggattagactttggtgaagagctgaagcatttctgtgacaggtttaattggaagaacagcttaatccagggtctaggacttaatcaaccatcaggcaaaaatgatatattagaagtctcagtccatctcccaggatcagagtgacacctcagagtcaagagcctgggagggagacacagactgtcctaagccagaagcagttgctccagtcaggaatcaggtttgataaactgaggtcatagcttaggtcctgcatcctatcttctttaagtgtctaccctatgtttttctttgtttctcctacatcctacattccactataattatctgcttactagtctctgtctcctggaaattcttcaaagacaaggaatttgtcttactcattttggtaaatctagtacccaccacacattagacatttactaaatgtgtgttgcatcatgagtgagagaatgaatgaataaattatatacatgcaagatcctagttcgggctaaataaggactagtaagttttatgagactgctgtttcaaaataaactgaagtacttaactatatatgtgctaacaactgggcagcctaaaagccaacagtattatgtcctacagttctcaataccatctaccactaacatctacaaatgtgtgactaaatttggatggccagatacttttgaaagtcagctgtgtggaccaacaaaataaaaaacatatttgacccattagagatatgtgcaaagaagctggatgataacacagtttatgtacacttacaacttccgtgtatgcttccttagcccatgattattaaatgcattggagtactgtgaaccaatttagctcaatggatttttaaagtccacaattattgaaaaaaatcttgcctgcctgttaacttataaaacgacattagcattttatatttggggccctaagacattttctgaggacttaatttggaaattcattatcttactctaaaagtaaaaacagatactaccctcttctctcaacataggactttataacctggcaatagagtgagaatcttattctttgaacagtgctccttcatttgtttctcacttttcaagagaacattgtatatttcagagaggatgtggcagtctcctgaagtctcccattgacctctgagacagagaggtcacatgtgggtgattaacagcccttcccattccctaagcacaagatgcagaggcgccacccaggttccagtatctctatatctctcacacactttatgcccacctggtttaaagttttcgggtctagtagtactcagtggaagacaccctgcttcacccagtagggagcagcagaatgttgcagacctgcatgtgatgcttcctacacatatggcttgcttagagcatttgtgtagaccttgtagaatttttctctctggtccactggaaacaacatattgaatgtaaaagaactcagcacaagcatagtaaaaccaattatgttttagacacagttatttttaaaaatttatctcgtgtcccactgaaagagaattttgagcatggattagaggtggtaatggtgaaacagaccattataagataatcaagtagtaatccatatttttaggactccctaaatgggttttcatgtttcaggttactgagacttcttcataagagattatctgtttgtcaggatctattgtgggaaatctgtatatttgtagaaaacatagcactctaccctatcaggtacccaaagctgtcttaaaggagaggttcatgacagtattactaactcaagattctcactccgttttccttaaagtaagttctggttgggtgtggtagcccacacctctaatcccagcactttgggaagctgagggtgggaaaatagttttgggccaggagtttgagaccagcctggtgaacatagcaagactctgtctctacaaaaataaaaacattagtccagtgtagtggtacatgccagtcagtattcatagctactcaggaagctgagggaggaggaagtcttgagcccaagagtttgaggttacagtaagctatgattgcaccagtgcactccggcctaggcgagaaagcaaaactctctttaaataaataaaaaagaataataagaaagaattctgtatatactcagtcatcttagaaacaaatcccttttatgtttacatgtgacatgaaaagctatcgtatgtaccaatttgcgaatgacaaagtggatttctccaattaaacgcatcccaagcttgctagtaaagggcacggaatacctgtctgcctgttttgtataaagagcgactcatagaaaatgtgatctctttttctcctgaatatgaaattgagaactttgaaattataaagcctccctttccccaaagaaatttctgtctgcttccttagaatttagagattgttgagtcctattggtacaagaggattttttgttctttgtttctactttaaatgagaagtgtttaagctttcaaaggcatattcagaacccattgatccactgttgtttataatttacctctggcagaacactatatctttctaattttggttgtcttcctttactgggaagacactatatctttctaattttggttgtctttcctttggttgtcttcctttgccaacaattggctaattgttgagaggaggtgatttcagattggcaactgattgaaatcttcaagaatctaggttaaccttattttgaattgattgaaatcccacaatcaatagtatttggcccaaaactttggaaagatcctgacgtcacatcaaaagccctagttatagttatcaaaggccagagttcaggatttaaaatcaccacgactctgaaattcaaaaattaatcataaacttttatgaaattgtttgttctaaaggaaatacagagtttgtgggaatttataatatctacagcaatttttaaagataataaaaattatttgtatttcttttgtgctttataatgtatgttgtgccttcatgtatattgttttatttaatctctacaaaagtgcagttaggtggatagagtcgttttatacatgacaagccaagtcttagggagctggaaaaaagcctaaagtctagagctaataagttgagggaccaagacttagaacctggatgacttaattttaggctctgtattttttccactatgttggggaatcattttcaggtttaaaaagttaatggaaataagatatttcctagtattgcaagaatcatgaaagattattttttttaactgttaaactgtcctgtaatttacagatgtggtcatcaggcactggttttcattttgcaaatctgatttgcttgtgcctagagtggttaagagcagatcatcagttttatagttcagcagatttataccggaatttgtgatcgctctcatatctaatagtattcacaaggtggcagtatttctgaattcggaagaataaagctgagagatgccaagtttgcagattttcattaaagaaatttaaagagaagattggataaaagatgacgagatcaaggataggtagaaataattatttaatttacatttgataaggttcttattagttaccctcagttttctaacttcattctttaccttcatactaaatcagaaagaggagaattaaaatattatttttgcatcattttttactcaagttctattattattctgatttttcacttctattttcactgcattgtccgcgtgtgtgtgcgcgcacgcgcgcgcatgtgttgtgtgtgtctactttaaaaatcttagtttccctactgtttcctctagagggagcaccatggtccaggaacattcaagaatctaaatgctttctttttatactttactcaaaatttctagagatttctaaagtccattttctcatttgtgagaagaggataatttaagatactgttagaaactcatcatgaaacatctaaaattatgtgaaattgaaatttcagagactcaaattatctttgaacttggtgatactcatctgcttacattccgtgtcattcctaacttcagcttaccttcagacatttcttcccacatgacttcctttttgaaagtatatacaggatcttatagccttgctattctatggcatattctacagcaatggaaatgttttataatctactctgtcccacatagtagccaccaaccacatgtcacaattgagtatttgaaatctggctattgctaccaaggaactgaatttcaatttaatttaattttaatcaatttaaacttaaatagacacatagagcaagtggctgctgtcttggataactcagatgaggcttcaaactgcaaactcttttgtggtttgagactagcatgttcttaagcattctcatgtgcagaagaaaatgggtaatggttctgtctgaaatcttgaatggtattttaaagtgtgtaagtgaatttccaagtacagaattgattcatggataccttttaataataaattattttaagcagcataaatgcttatcattagtcagactatctttctctaaacattctccttattcagttgtattacagtgttctatttatctgtgaatggcagtcccactcaactataaactatctgtatcttaacacccagaacaaatctaggcactcagttggcttctcagtggttttttgtttgaatcccgtgtcctctgatgtatttgcactattttgctttattatttaacttcttacttatgttttttgtctctgcagtagtatcactgcaggagagtgaagagttggtaagaaagtttcatcatttacaatggtgattgacaggcaagaccatataggaataggtaaaccatatttttaatcaaaataaaggaagattttctcggtattagctaggattagattcaactgtgagtgataaaaatcccaaaataattgtggcttaacagagcaacagtttctttttctgtcacgtggaagtgttggtggagtggccctgctgagagcaccatgccgcggggtcagagaccggggctccttcctcttgttcgtccaccttgggtgaccttgacctcatgacgtaaggtagtgccatccaatagtggagagtcagggtaagggaagcatttcaggcaaggggacgcaatggagaggtgagcagaggcaggtgaagctgcacagaaattaagggctaggttgtggatgccttgtaagtcgtggtagagattctcagctttaagtctgagtggagcgatgcaatagaaagttttgtaggcagggtatgagataaggtttcccaggtgcactcattcatcatactgcacccggttcagatgccacttccccttgaagcttctcacaagaggaccacacagtttcagtgtccctcctctgtacacatggccctttgttcatgttactctaatcgtggaataatgcgttgtcacatctctgtcacttcctggaccctgagctcccgggggtggactcatgctgctaatgctcctactaagcctcctccattattctcttctttgttttcctcttacctataatcatcactaacatttttattattgtcatctttgcatctctatctaacctgaccctctagcacccagcacagagaatatagtaaatgtatcctgattaatttagaattagtaagtaatttatcaatatatagtaggtcttttttttttttttaagactaatggaaatgctctcatctgcatagttgctcctttttggatccttcttgatcatcaaaagtgttttttccttctcacctttgacagatccttgagcagagttctctttcagcccctgtgatctggcagtacaaatattcctagtaaattcaatcattcattcgttcattcatgcagcatgaattcatatttcccgagcttatggtatgcacaatactaggaaaagttcaaccatgagcaacattccttacatcttaatggagggaaacagagcttaaacaaatgactacagatttggaaggaagcagtgctgtaaggaaacctgaagtagtgtaaagagagaaagcttagtgggaaaggccctttcttttcatttggtgtcttgttttctactcttgctcatgaaatgttctgagtagcttcaaatatgttttaaattgaattgtgtagagtccagtacctctgagaggtaactgagtgcagctattctagggagatgtgttctttatttgtttgctttgttttatttttaaagaagctgtggaaaaattctttcaagtgtaagtttaaatgactttattactgtttgttcttatttggtcgcctatagtaacatttttaccctgctttaattgaaggctcttgagatctgtcaacagagaaactttgtagaagagacagtttatcttctgagtaagtagcttttattcattttggtccccataaactaagaaatgggatgacaacatgaagtaaattgtgtaagaaaggacataggttttagaccaacgtaacacagaatatgagcctatttttacaataatttaatatatgaaacagacttcacagcacagtaaagaaggaagagttgtttcataaatgttgaaataacatattggcaatgtataatcaacatatcaaaatttatcagtttatacctcacaacatagattaagttgtagatgagttgacaagttttttcattttctaaaaaattataatcagcttatattaccatcatattggtagaaaataaataatcacttttagaaatcacaccctaaataactagaggaaatgcaattgaataccatagttttggagaaggaggagagctttttaatataatctaggtgtcagtgttcctggtcttctggctcctacctccacatgagtcacaatttttgtaccatgcataccaagaaacaaaacttgtcatcttttcacattcttccaaaatgagccacgtgcatgacaacaatgtgggttgtactgaggattgcataatgtagcatataacataacattcatatttggtgtttctccattgtcacttccctgctgacctcagtagggtttttccgctttacgcctttcccttatacagcactcactctcattggcctctttgcctctgttgaaaaataatccaaatcctctattcccttttatgtgtatgcagattcatgggtgctcagccacaaacccagaactgtccagttatagcacctgcccttcttaggagaagtgcttttggggctgcattttgttacttcagcatgttcctggggttctaatcacaattttaggtagctcatcaattcactaattccaaacagtgttctccccaagaaatattttggtggaataaatttttgtcatattgtcttagaagcagtagaggacttattagggacatatagtctgattttataaaaacttgataatcctgtaaacatttttaaataactaaccatttttagagacataaactgtggaaataatatttgtaagaaacacaaaatgctgtggaaggggtatcaaatgggatatcatttcattcacaagccagcttttatcagttgataatggccgtgtgcagggggaaggattcaagatcctttactagttcctgcaagcccagagacaggggtaagggtgacaacctacaaccaggcagttgttgtccctccactgagtaaggctttcttacatgcactatattaaaaactcatggaaaactttaaactattaaaatgccataggtcagtgagcaaagtatgtaaagacaattagccaatagaaggcatggttgataaatactttcatctcatgagggttattgaaaggccttcccctgaacgtgggagagaagaaaatgaggaagccctctgatagttgagtttgcagttggcacaaagtgtatcagaaaagcagtatgcacagctacctcatgaggcagaatgactttagggcctttaaacattttaagtgtatctgcatgtgaaggtattgacctccagaatatatataagtctatcaaaagtaagtcagagtatgacagacctggcttcaaattcacagtgtactatttagtagctgtatgatcttagcaagctactaacatttctatttcctcttctataaaagaggaatattagtagaacatgcctcatagggttgtagtgatggttatatgatgtcatttatatgaggcacttaaatgagtactcagtacagagtaaatatccagtaaataggagatacttattttgctatgttatagacagtaaatgttggtgtcacatgagaaaatagccttgtcttagctttccacctatgtaaacaaattaagagatatgcaatttctttaaaaaaattattaaaataccttaaatgaactctttctcccatcttcaccccaccaaggccgaatgggtaatagccgaagtgccctgaagatgattatggaggaattacatgatgttgataaagcaatcgaatttgccaaggagcaagatgatggagagctgtgggaagatttgattttatattccattgacaaaccacgtaagcataaaagccatctctggttataacttttttttctctcagtgtaatcagttatgtctagattaaaaactatttcaagatacattgggttaaaaaaatggcagcgtacctacaataaaaataggccaggtgtgttgtaatgatttccaatactcctcctgtgctggaaaacctggagcctcatcactttgcattacctgcatgtgatgaagaacaggtggctacacagtttattaattgtgtccccatgaggcatatttttacctgctgcaagcaaattgaataaatgtcatctgggttgtgttggtgtgtttttttttgtttttagcttgtatatgggagtgtttatagtttaagtgtatagaccttaccagtcttttttggaaacatgtaactgttctggacattgatgatatttggatgtttgtgttgtagtatttagcctctttcctgcactatttttatcagtacaacacccagagtttgtatttgttggtcctcagcttgactgtttgcattgggtctcccattttggaaaggaaaaaacaaaagcagtcacctaacagaaacccaactcttttgaaaataactagcagtagtgatttgaaatttcctctttccttttttttttttttaagtttggtaggaagtctttgtgttcatgtaactaccttaatctgaaattgactttaataactatcctcttgacaatataaagaatctcacttgtaactagcaagataaagtagtagtttaaggatctcaagaggcaaagtgatgtggcagaacatatcataaacttgaggctggcctgagtgaatttgggcacattacttattagccgtgtgaccctggaaaaattaaacaccccatttcccttgtctgtaaaatggggacacagcattcctaccttgcacagtatttgaggaaagtgtatatgatacctgagccatagtcagttgtcaataaatattatttacacccatttgatgctaaaaactgtattttgaaggcaagtaatcatttgttcaactgttttaaaacagttcttatttactttctccttcatgtcttaaggagcgttagttcttggaagtttagaagattaattcttaagagtttagaaattcaaatggttttaacacttactttgaaggaaataattttttctttgagttacttttgatctaaaattgcattatatgcaaattatgtgcaaataaaattgcattataatgttgcttatatgttcattgttttatgtggtattttgtagcatttattactggcttgttaaacaacattggcacacatgttgacccaattctactgattcaccgtattaaggaaggaatggagatccccaatttgagagattccttggttaaaattctgcaagactacaatttgcaagtaagtatcctttcttggacaaatgagcatctgaattagttgacttagtactggataaatatttctagggtttatgttaggtatcagttaaaaactttcgattttatggttacattttatttaggcccagatatttagaaaactgttcaaatagagtaattagaaacatcacctttaaaattgcgttgtccagtaataccttaaaggccttaagaaggctatttgattctttagccatctccaattttcacttgtttttgagcagacattcttacatttgtatggttaatataacatggaatcgaggcgagtatgaaagcagttatagtggccattagatcgggccaccccaacatttttagggagaataagtattgtatccgtttgagggaattaacaaaaatgtttttcagtaaggtaataatttttcttgaagccattcagtagtctgttgcctgaaagctgttaaaatataggattttatttaaccttttgtctgttttctagaatagtgcaactttattatccttgttaaatcagaatttgtcataagaacagtggaactcattattttcatataaattattatactaattacaaagcatcttaatcttttccttaaaaagactctagcaattactatttttcaggatgctggtaacttctatagaacttgaattaaaacatttccttaaaaattcggactgttgttcttcctctaatttacttgaaaatgaggttttattaataatggatgaaattactttcctagaaacaatttttgcaggtaaagccaaaagaaaaggctattagctgaggagcattatgatgtgagatccattgggccaggattcaccatgcaggttgcaaagtagaggtctgcctgcactcagggtgacagccttaggtaagaggcagggtggaaaggagaagatattgcaggaacattggtggcatcaaaaacagatgtaagagatgaaagggatggcagagctgcagggacaagaggttgtgccagagagtgtgatgtcattaatgtttctgaagcggagtcatggtgtatacgtgttcaaaaagtgggatgatggtaaaggtcatttgtgtagaattagtagagaaactgaggccacagcctttctgagtcatcctaatggacatgaaggccaggaggaagaaacaaggtgctctaagccaggctccagcttctccacaggggacagtagtattaactggacaacacgactttaaaagtgaagaagtctaaagatgggggtgggggtgtgagagatcatgcagccttcactccggagagctttgtgggaaattgggttcatgggagagaaattggtattcgttaagccaaagaagtagattacctgttccgcaaaaagcttaacgatatataggcatatatttccagtgggatttggaggtttgcagatgacccaggagaaaggttattggaaggagaatgagaaagtcaagaaggaaataaaaatatgggaatgggttaataggcaaagagaggtgaggtgaggagctggcttttcatgccacgccctaggaatccagaaaggtgacgtccctgcctggggaagtcactaattttgaaggtcagattgggctttggtgaaagtgttttcagtatcagaacttataagcctctgagtgtgagtgagcttgataatgacctttacttcattgacccttaccaaccccaggcatgccaggatatgctctaggtttcaaatccacatttgatgagaagtcatttaggtgtctctgaacaaccctcccccaagggaagtagtaaataattatccctctgcctttcagctgtagtgcaagaagcttgcactaggttaaaagttgtgcctttctttttcgccagcctccgcaatgactgcaaaaccacatagtgcatccctatgactaggtcattcttccagagaaccaagctcatgggcaccactgtgatctcagtgttcattcatttttaataaataaatttgcatcattctgagtcagctggtaataaaaatgaaattattattagatgcaaaatgaatgcctaacataaaaatatctactaaagaagctactaaatattttttcttaattagagcttttccttaagatatgtaagtatgtagttcggtaatgtgttaaggaggttcagaattatttagctagtgggtccaaaaagctgtggttgcctgtgaatcccccaaccaaggggtggcttctcagagggtgagggagagatgaacagggaaggcagcagagcctgtggaagctgctgcatctggagtccccactggagctcaggcatcttgttggagaatgcagtcagaaaatgctctccgggggcaggtggttcaaagaattccaggcattatttttccctcacagataaagagtttaaaatatttttctgctctttttacataatgtattaatgaccgcttaatgtgtttcctttctctaggcaacctattagggttcactgtaaaaataaatctatccagagagcattttgcaatttccagaaggatttcacttgcatgtttttattttattctttttttattttgtattttataaaactatgttgtttttcacatactctcacctagcaaagtaaaaaattagcaaccctattcaatctgaaaatttgggagaaattttgcatgttcatcaatttccaggaatctggaagtgactgtgtgtgtgatggggctgggtgggacagtaaccccaggggctatcaagaaccattcagtaatgtagggatctatggtcagatgttggggaaatgttctcacagggcttctcagcaccttttcttgctggtatgcattgggaatctctaaagggagattgacaatagagtatacagcatttaaaacttgggcactgctttgggagatcattcattagccagttgttaattggaaaagcgggttagagaatgttgtgggaaaaacttgaaatgagtaactcttctgcttttagtttcacgttttctaaaatgtaacagctctcttcaaccgaaggttagcatcattaggtttgttagatgcctatgacatgacatagtttaaggaagtagtataatcaactacatcagcagtgtttaatttctttaactttctatgtttttatacccggctgccttgttagtgtaatcactgcacaaattttaaaagcttcatgaagtcagtaagatgcaagtggcatgtattgcacttcataagctttaaatgttcctaggcctgatttcaaggacaaatagcacttattttgatataacttccaaaacaatatggtatcaattatacttcagtttttatgtaaactgaccagtttccagtttatgctacaaatttctaatgtttttacattttctatttttaaaacattataaatttagcatgtagttgttgagcgtttatgtccatttttgtagttggaggcttttttcccttgagaatttcagcatctttgttcttaaagacttcttttgacggttttatttgacaaacatttaatcttcacaacacttctgtaggaaatatcatctttgttttacagatgagaaggttgtctctcagaaaagttaagtgatttgccagtctgggaaggtgatgaactgggtttgaacacagatcacagatcctctgactaaatctcatgccttttttaaatcagtgactacattaccttttacagccacaagtaatctctaaaaaatctgctaattagagtggggtcttagtttttttcattatgggtaacacctcttgggaaaagaaaatagcaagcatgtttaacttgcttctaaagaggtgtcatggtgcagtggaaatctcaccaggctaagcctcatgagtccctggtgtgagtctaacccttaaggaaagttgtagatgatcctgaagaagtcattgcacatccttggacctctgttttccccagaaaaataaaagggagcaggggctagattaaacgtccatcttagatgctttaggggctgcagacattcttaaggctaactggatctaaggcattgggtacaaagctgaattgcctttaggccaacacctgcctagttaggtttctctacatttctctctggagcaggatgttcagctttgggcactggtttgggtcacaggattacaaaactttcaaagatcactacagaaacttagcctttacaagatggacacaacactcaggagtttccactgtgatggaaactcctctggacttgtgttattgtggtgatcgacccccatatttgtatccttttacacttggcagaatcatgccacgtggttctcccagcaggccctcgcccctgctttgcagatgagaaagttgaagctagaagatgttgcatgatttgcccatgtcatgcagtagagccaggattccaagcctgtgcacttggtgctgctctgcctcctacaatttggcagttttaagttttcttttcatgggtaatgcttgccattactcttgcttttgatttatgttttattttgtctgtatctatgaccaagactagggttatgaagttttgtttttattttttatttttatttttttgagacggagtcttgctctgtcgccaggctggagtgcagtggcgtgatctcagctcactgcaaactccacctctctagttcaaacaattctcctgcatcagcctcctgagtagctgggattacagacacgtgccaccatacccagctaatttttgtatttttagtagagacagtttatccatgttggccaggatagtcttcatctcctgacctcatgatccgcctgcctcggcctcccaaagtgctggcatggcaggtgtgagccaccgcgcctggcctgtttttattttagttttttaaagatagataattctctccccagctaccaatctaagggaggcattgcccaacttccttttccaccaactttcaaaagtggtgcgaatgtggaatctctgcatattgaaaataaggtcaactcacctgatgagggagggaaaatccaccctgtactgttctttttcttgagatagaagctttgtagatgagatttgccactccctataattaggtttaactatttgtgaatgcttttgtttttaatccatgtataagacaaatatgtgccaaaactttttggtgctcatgctttcagttttacaattatgattctcatcctcctttctattctagcagtgtctgtgaagtgccttgaggtacttcatttatgttatctctggataaaaagggactatctacatagtgctgttgtgtggtcttccacatcatatcctgtgtatctctcactgctgggcccatttggtctctggagatgcattcattgtactggcagtttatgccagagtcacatacagaattggcatggaagacaaataggcaactgttgtcttttaaagagcggtggacatggtatttgcagacgtgggctcctgttctggctttgccattaacaagcctattgagactttggtaaggcacttcagctttctggagcttggcttcccagttagattaagccagtgtttgtgaagtctggctgcacaccagtatcatctggattcttgtatacgttacatagtttcaggcaaccagcccagatctgctgaatgagactctcttgggaaggactagggggcatgtccttaaaccaccttgatatttcttacacacctagtctggcactagtctatgtattgaaatttgagaaccttgagattagatgatctctaaaatatcttttgtttctaaagttcttaacagaggcgttttataaatatctctttacatattgaatacagctgcatatttaatgttaacttaatattttaatgtaagccttaatatttattttgggatctaataaagcagcttagatttttaggtataattggggtttatttttcacggttttttcttttgcctcaaaaatgacatttatttaaagaaaaaaaatgacaaattgtccatcccttgactcccttccctcccctgccctgttcctcccaactgccccttggattgaaccctggccggggctaggtagcaggacagcccttctcagatgaagtcagcaacactgatgggtgtcttcttaacagaggggctgtcagaggccttaatgtctcatggaatagttgttttcaaagtgccatatacttgatgacttataaacacatttattcagatatatgagtacctcctgtgtcagacagtatgttctgtgctaacagggcctccatttggtctcatagacctggggatgagcgagacacagccctttgttcatgctgctcatgatctaaattgatgtttctgggagaagtaaaatgccttaacacttccattttgttaaactacgcacaccatacacacagacacacacacatacacatatacacatgtacacacacagagacacacacatgtacacacacatacctcatccaaactgataaactgatttcagacatctccatgccttccaaagttattttcccaaatttgcatttgctgcagtccccatagtcctttatttcccatatctctattttgcaatccaaatgggataagaggaaataatggcttctttcttactaacctttttttgggcctacgtgggtttctttttgactctcagtatataagctcctaattttcttctaagagagagtttttgaatttatatgttcatgaaataaacttttaagaccaaatgagatttgttgttttccttttgaaattatttcagttttgccttatcacagcttttaggtgacataggtggcctgtgacaaccagctgtagcttttaaaattaatttggtacatccatactttgtgctattagaaatttaaatacaattgtgtttataagattgtttctgaactccaacataagaccttaggatctctttcccttcgtatttctctgcagttcatcatttttataagaatcccagccgaaagcaaagctttttcaagaagaattcaagtcccatagcattgtgacctaaaggaaggattagaaatgaggggaaaagtttctcagtctaccctgtgtcatattgggggcttttaaaaccaggtagctgtctgtcatttgcagttctaatgataagcattgcagtatgaacaaggcaatgtcagcaaaatgtttagtgttcgaagaatcttttaaaataaaaatttcagaaacttggcaacttttgatggcatttttcccatggccgctgtttctaatgaaccataataactttgctgatatacagttcttttattgctttataaaatctctatgggtctggtgttttgcttttggttgggattattatcaatgatgatgaactgcagagaaataaggagaaagggggaagataaggcaaatctaagttctcatgttgattttcaacagtcgtgttgtaaattcattcttatttaaatttacagtagcacaaaatataatatgtaacaggttgtttatagaagccatagctggttgacttcaaaatgacgaaaagggaagagtaaaggtcacgttgataaaatatgtaatttagaaaaacttagaactatggaaggaaacaaagtaatatcaagaaaacaagaatcctggagtaggatgtaagaagaaattgacccctagatttgaataatcttggaaaaatataggaaagtcctgtaaggaaaataaatctctgaaagataatattgtactttctaagctatgcctacaagtattttttgagatgaaaattaataccattatgaagttgaggaaagaaaagactggtttatcctcagtgaaattctttttgttttgttttgagacagggccttactttgttgcccaggctggagcatggcagtggtgcagtcacagctcactgtagccttgacctcccgggctcaagtgatcctttcacttcaacctctggagtagttggaactacaggcatgcgccactatgcctggctaattttttttattttaattctttgttgagacagggtctcactatgttgcccaggctgggcttgaactcctgggctcaagagatcctcctatcacagcctctcaaagtgctgggattataagtgtgagctaccacaaccatccgattgtcagtgatactctaataagagacataggttacaaagcaaaggttaataatggtgctgtttaatttaccaagtagagatatttcatagagatgtttcaaactagttttaagttctgaaagtgatatcagaggctgtccaacacagagaataagaaaccagggtaaaacaggaggaaacaggtgagaaagtttttagtgggttaaaaatgattgatctttgaaaggccagttagacatactttggaaaacaaaaactacttttggtgtgaaggaggacataatcttcaaaactgcatgcttataagcttctgtagtctataaaccttcaggaaacatcacaaaatgtatttgcaaattccataaagtttaagaaaaaggcacggggaaacaaccagcataaccgtaaaaaacaaagtccttgcagactaagttttcaacacctgaaataaacaaagaatacgagtttatatcaatatcttcgaaaactcagaagaactgtacaattttctaggaaaataataagttgtaaaagtttactcaagcaaatagaatagacctataatcattaactaaattacattggtagtcaaaatgtatagctacaataaaggcacttattccatagacagttttagagacaagttttatccttttaaaaaatagctggctggatacggtggttcatgcctgtaatctcgtcactttgggaggctgaggtgaacggatggcttgagctcagcagtttgagataagcctgagcaacatggtgaaaacctgtctgtactaaaaatacataaattagctgggcgtgatggctcatgcctgtggtcccagctacatgggaggctgaggcaggaggatcacttaagtgcaggaggtcaaggctgcagtgagttctgatcatgctactgtacttcagcctgggtggcagagcaagaccttgtcaaaaaaaattaattaaaaataataaaactaaataaaaagcagcttctgtgttacatttacttttccagataattgaatggaaaagttcctcagttccttatggaatgctagtgtaaccctaataccagcattacgtgagggcagtatgagaaaattatagccctatcttttttttaaaaacacaaatgcaaaaataatacataaatcaatagcaaattgaacttgaccatttatttaattgttaaaagtacatccatatcataaatgttattagttctccctaaaataatcatctgtatgttcaataaaattttaatcaaaatatccaaagaatttttcatggaaattaataaactggtcctaactcttaacataaaaattaagagtaagattattattcaagagggaagatatttttattagatatccaacttaatatgtgggagtataaaatgctatataaccactttggaaaactgtttgtcatttacttgaaaaattaaacatacacctactccatgacccaggaatttcactcctaggtatttactcaagagatgaaaatcagttccataaaaagatctgtacaagaatgtcctttggatttccttagtagccctaaactggacataacctcagcatgcattaacaggagagtgtacctcagggttgttgcctcttggtgacaaagtagatgccgtatcactaggctttacatccacacttcatatggcacatgcaggaagcaaggggttttttcctaatgaggctttgctttttgatttgaaagggctgctttcccaggcttgatgtttatcttgttgaccagatctatgttacatgagccccagccagctgtatatttcagctggacacacactaaatgaagttggagttgtgtttgaaaagaaggagcaggaatggtagagggcaagaaggtgtcagctgtgtctgtaatactttattttctggaatgagatctgaagcacgtgggaaaatattaacagatttgttaaatctaggtggtagggactgggtctttttttgttttcagttttttttaatatttcatattttaaaaagaaaaatagcacaaagtaatgaaagatagtgctcagatcaagagcagcagtgctcagtgccattctggtcatcgaaacctgagtaacagaagagtgtgcatgtgccctaagtatgtaaagaacatcacatttgcaagttagaagggagatggggaaggtgatgatagtctgtggttgcgaagataggctgggtaagatgaccttgaaacatagcagtcatccaaaatcatgagtgtgaaggtcaaaaagaggtgaggatgacctgcttacgccaactgctgtggcatctgacttttggccatcagtgtctttataaaaaagacactcatgggaaattccaagtatgaatttttgagggtgaaatgaatgtgaacaacagcacatttttcatgagtcactgatggagttgctactaggaatccatagtcaacataatgccttgtcctatgtctgatgttgaaagcaatacctgtagattgtagtacattataatcttgtactgtcttccttcacttatcacctttaattgcctacacattattacagatgttatagaataaatgattacattctatagaggatagtctcatattttgaaatacctgcctgggatcatataaatgaaacttaaaatgttttcctgtttttctgattgggagccttgaattttgaccaaatgaagtaggagatagcagtaagctgtatttgtgtactttcccctctcctggctgtttgcctctgaataatgaattttcctagaaaatgctatctgcaggcggacagattgtacctgtttagaaaaatgtaatcctgctgaggatatggctccttcctggtttgcatattttgctgttttcttttttagcttgtagacacagtggcctctgtctagactgctggccctgcctttctcttatataattcatgccatgggcctggagcacccacgagagtcagagccattttttaaaattgttttatctgagatgttgtggttgaaaccattactcttaagttttttatttttgtcttggaggctaagcagctttatatgtttgcttttaaatttatttaaagtttcctgacatccatatttcttagctatctttcttactgtatttgttatttttctcttctacctgtatgttttaatgcagtctgttaaaattttaatgtatttttttaaaaatccaaaaaaaattgattcctggtagaattttaaagaataaaacttcataggcagtttctcaattaatgtaggaatactaaaatcatgtaatttcctgttcatcaatactagaaatggcaggcatagaactttaatctagacattagttttgttttcctgaatattaatttgtctttgtataattaggggaaaaaggctttcggctggattcacccaaagccagtgctctttgggattttcagaggaacacgtggaccactgaggatagagggctgcagttggctgctcccttacttttcttccccagtggcatgaatttaaaacttatgaaagcaaaatgcccatctagcttgtcaagtcgagagtgacttcagtatgaagaaagccaaagtgccccctctaaacagtggcacttgcccgtgaaagacacatgcttctcagcctcagagctgggctgtggtgagacagcgctgtctgttaatgtgaacttctatgatgtgacatgtgtaactgcacataactgcgtatgataagacacatagggcccaaagggagaagccacaggcacagccccagagcgtctctgtccttcaggccttgagtttctccctctgaaaaagcagcaacaagttctggttaaaaaaaaataataataataaatgaaatgacatctggcttatgcacacctcctggagcctctcagtttcctactaatacctaagaaaacccagcaaagggtgggagctcacactgtgccccacagaatggacatgaaaggtaaagtgtcgcctgtccctgctgtgtccccacctaaaagcaggggaggatcttggaccccatcgtgcctccagttctgaaatacaacattggtaccagccagaaatgggcatcatcctccactgtgtgcttctgacttctgaggctgccaaagcattgtgatgtctcttgtcattctccaggcaggaagggaggaaatagtaaaaagcctgcaggggaataagaaaaatgtgtaaagaaacaaaagctataatgctgggatgaagaataaagaaaaggactcttatgagagaatatttgtattcatggtcatttttcaaacccctcccaggagtcaccaaatttgaaggttattatagtcagttaataccacacacacacacacacaccacattcatagcactatgctgaatggtttggattagatttggaaagaaaaagataggttgcatcctcaaggggatttaagacagagattgtatctgtttagtttattatctatacccagtaccctatacgtgatagggacccagtacttatttgtgcagtaaatagattaatttatgaaataaattgatgattttggaatagcaggttttcattctgggtaaagatctgaagaatggaatgaacacatgatgtaggagccaaagtctgcccaagaggatctgtataaggaagccctctaaagtagcaatagggttagttaatatagggccttctttgccagactttggaatttatgtttgattatacaaatgctacaggagcccgtgtatggttggaagaaatgatgaaatgacgcacagagtaatgagtggatcctggctggccaggtcagcctggcagtggtttggcaggaagagggtactgagggcaagagaatcagtgagtgccccttttgagtatttcaagcatgccagcttttggaatccccagtacagtgtcccttcacccctcagatttgagtctacttaagatggcttttcttttaaaatgtatgcattagattctgcttcgtgaaggctgcaagaagattctcgtagctgactctttgtccttactgaagaaaatgcaccgaactcaaatgaaaggtgttcttgttgatggtgggtaaaattgaaataatcatatggaaccacgtgccctgctttcagaaatggccaagcaggtataaacagggcataatccaaagtatgtgtgttttcttacagaggagaacatctgtgagtcgtgcctttcccctattcttccatcaggtaagaaggttttccccaaaaaaatcccaaacatgtattttaatgatgagtggaatcaaaattttggaattagccaactaccgtttataaaactatataactttcagaataacccagtggagagaagtgttgtggcttccatcctgctcagtggaatgctggtgctgccattgcttagagctgaggttctcaagctctagggtgagtcatcgtcacctggcaggcttattggaacccagatcgctgacccagtcagactccctagagtctctggttccaaacttccagggcaggaactgagaatgtatatttctaacaagttcccaggtaatgttgatgccactggttcaggggcccttcttttagaactgctagtctagggtaaaaacaaaatgaaaactaaccatcagcatttaaatttcaaggtagaagaaccatatacatgtctgggaaaaaaaatttataggtagcattcccttttctttagtgtttttctctgatatatggttctacatgcccaagtcatctcacatttcagtggaaacatacataatccctgccatctaattggaactgtgagtctttaaaagacataagcatttgtttatttctagttcttggcagatagatatatgtcttcatctgtaatgaaaagcaccttcttaaggtttattatgacagaagaaatttgcataattcaaaagcggaaactaacaaagcattgttaggatgctaacaaatgcttttcaaatataagttcagcataacaaagtactaaaagacctagttgacctcatgtttacttaggattaaaggattatttcatggggcagtccatgagaagttgttctacttaggttcttttctagaggaattagatttggatgtttaagtgcttctgttgaaaactgcatgggctcaggtgaagaagtgagcttccatagcatttcagacagtgttgcagcaaaaaggaaccacatacattcccactctacagttagatttaactccaaatttactctgctgatgacactaaatcttaccaaaaataagctggccacacagagcaggaacagatgaggggatctgcccaagcacaagtgcagtaaaatgcaaggtcaccacagcctgggcttgtaacccaggtccgcctctgagtcagtgtgtggtcttggcaaaggtagcaggtggactggcaaagcatttttatgaagccacagactcaacttcagctgtggtgtataatgattataggggttaggggcgcattggcacatacacttgctggttttcctacagttgtcctcaatgtagtctgggtaagtgacacagaggctaagcaagtaacctgtgaatcgcatagcaacatgattataatacctgttttgtgtctgatcataccacccctcaggaatgcttttgtaaataagccattctctaaaggcaccttattgctgaaaattaaactgcaactcgactttcagtcgggattggtttaaaatgatcttgcttgttgcattaagttctcctcctttctctgccctcctcgccagatgcagctaagcccttcagcgtggtggtcttccattgccggcacatgttccacaaggagtgcctgcccatgcccagcatggtgagttggcagcttggcacctatcaactagagggaaattaacacacttagaggaatgtgctttaaactgtaacccttcatccttatggctgtatgggttaaaaaaaaattacaatgtggatttatatcacataacaaaaattaatctagttttcaaatgtaaaaatatttagaaatgttctatgtactatagtaaacataaaagcatacccatttgaaggaattcattcaggcccagttgacagctgtcatgctgtagagatgagcaacaacagtagagagccattgtgtatcttatgtgtttctcagcctgatttgtgttccatgatgctatcatttttttagtgtcatattcctccaggtcacattagacgtattctgctgttgggtgtccttggagtcacagagtaacagctgatctagactaaatcctatgttaaccagaaataaactccagagaaaggagtgccatcctattacttcctctccaccccctgactaacgctaccttagtgtttctgaatatgagagtagaaaaagaagatcattttttaaatatgtgtttttaaattgcatttttagaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcaccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattagccaggcgtggtggtacatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgatttattaaaggatattcaatcctttttacttttcatcaacctataagggcttaaatatggcaaaataatccaagtgttagtcaattatttttcatgtgtgactagcccaatttaaaatataggtaaaaaggaaacccattcccctcgttttggggaagaacatagttgcaaagtacacacttcataagctattctttttttttttttttttttttttttttttgagatggagtctcgttctgttgccttggctggagtgcagtgacatgatcttggctcactgcaacctccgcctcccaggttcaagtgattctcccgtctcagcttccggagtaggtgggagtacaggcacgcaccaccatgcccagctaattttttgtacttttggtagagatgaggtttcaccatgttgcccaagctggtctcgaactcctgagctcaggaatccgcccacctcggccttccgaagtgttaggattacaggcgtgagtcaccatgcccagccaagaaagctattcttgaagtgtaaaacagccaggtgcaaaattattttggagtactttagtttgcttttgtttttagccaaagggatttcatactggtttaattatgttcatccttgagaatttttgagaagtttccaacagatttgtagttcattttgctgttgttacaatgtaaagctatatatagttgacccttgaacaacacaggttggaactgcaaggatccacttatacatggattttcttctgcctctgccacccttgagacggcaagaccaggccctccccttcctcctccttctcagcctactcagtatgaagacgacagagatgaaacacttatgatgatccacttctacttaatgagtagtaaatatattttcttttccttatgattttcttactattttctttagcttgctttattataagaatatagcatataatataaataaaatataaaatatgtgttaatggtctatttatgtcaccagtaaggcttccagtccacagtagtctattagtagttaggttttgggggaattatacgtggatttttgactgcatggggtgtcagcacctcatcccccacattgttcaaggttctactgtattttaatattaaaaaccaaacatgcattgagtaattactatgtgttaggaattattagaagcactttgcttatactatttaattatattaatgtatccctatgaaattggtgttattaccatcatcgtcattttatggatgaagaaactgaagcacgtaaaggttaagtaacttgtccagggtcaggtagctgatagtggaacacctagctgaaattcaaacccatgcagttgccttcagagtgcctgatcttaactggtgcatatttgatttttttgttgttaaaacatacttatttgagctgttttggtcagtggatagaaagcaaaatccactcttagaatagaaagggatttattacaaagtgttaaatggcttacaaaatcattgatgggaatcaaagaaacaataagggagctttcaggcaattcacaaagccaccccacagaactgggctgcccagggaatcactgccccaccaccatcagatcatgggctgcacatagcagtgtcagttgtcacttttaagtaaacattggtaaataaaagtgtacacgttactcagtttctcctaaagccctttctcagtaacattaaatcgtgtgtatacatatgtgtgtgggagacatttctatgtgctaaatactacatcggttcattctggtttctattatcaggacacaggctactaaaaccaccaattttggtactaaactgtaacccattcctggcgctcttagctaaatgctgatttatgaaatctggaatgaagttccttcttttctcatgcagcacaggttttggagtcattaggatcaatgcaacattcatagtaaagataagacaggagcgagaatgagaaactcagcctgcaaaagcaggtc

SEQ ID NO: 12742 - DNA, 97423 bp, Human
atccaggatggtctcgatctcctgaccttgtgatccgcctgcgtcggcctcccaaagtgctgggattacaggcgtgagccaccgcgcccggcccaaacttcttatccttgaaatggcagatattcagtgtcttcctcccaccccatccctcccccttgactgaagccccaagaaagggccatattttgttcactcctttatcccagtgcctagaaaagtacctggcccatggaaggtgctcatagatgtgtcgggtgaaccaatgactgaactaatgtttgctgcatgaatatggccagtatcacaaatcctctagtaacactgcaatacgctgtctcagaacttcgatttctttctattatttgttgcagtgtttatttcttctatttaacttttcaatctgtctgacatttattgtggtgtatatcatgggaggcaaggctgtaaacagatctccagctaaacggctaaacaatttgcagaacaatccatttcctccccattggtttgtgatgtctgcattttcatccacaagagctgggaccaggcccgctcctgtgggccagctgctgcctcgtctgccctcttgttccagaagcccagggctatgctgttcctgaggcagggctgcctagtgattggccacacaggcactggaattagacaatctgccgtgcactttccagctcaaccacttaccatctgggtgactttgaacaaaagaatttgctttttattgttgttgtccaggttggagtgcagtggtgcgatcatagctcactgcagctgctaactcctatgctcaagagaccctcccgcctcagcgtcccgagtagctgggactgcaggcaggcactaccacacccagctaattcttacatttttctgtagacatggggttttgctatattgcccaggctggcctcaaactcccagcctcaaggcatcctcccacctcagcctcccatagtactgggattacaggtgtgagccaccgcacccagcctgaaatttcatttctaagcctcaaagcccatctgtaaaatgggcacaagggtaacgttggcacacgtggtggacgctccgttggtgtcattattacagatcacggccagttgaagcacttccactcatttggcaaacagaagccagacgggcattcaccctgtgcccagtacagtgctgcgcccaagcaggcagtcagtgtccctggctccagccctcctggggtgcagcacagttttgaatgtggaggggaggcagcaggggtggaaacagcccagccaggagcggccgctctcggtgcggggaggaggtgaagtgagaactgagctgcttgggtctcagggaggctctgacttctagagggggcgttcaacattctttagtggggacttttactacttccagaaacctctgcacattggctcttgctggtcccccgggggccacaggaagtgggagctccagatgaagagtcgctggcactttgagggcagggggcagggccttcccctcatcggaatactcttggagcctacttcagtgcctgcattcagctggtgcacaataagtgcttgttactgtgccaatttcagtatgactagggctgtggtaggagcaatgctaggcgatggggaatccgaagacgcacaggagtccaagggttggctgactgcagaccctcatcataagtctagagccggagaagatggggagacgccggcctgcgccctgtgagtctgggcctcagtcttcccatctctgaaatggggaaggggttcctcggccgagcggatcggccgcagaactcggcggagtcgaggggtccaggcccaggaaggacgccgccggggcgccccccgcccctcaagcttgcgtggcggcagcgcgcacgagcgctgggggcggcgcggccccgcggcggggaggggcgggcgcgcgggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccggtgagtcgcctggggctggggccgggccggtggggccccgcggcccggagaagggcgggggccgggcggcggggccgtcacccccagccgggccgagggcgggcgcgcgcccacggctccgcgggggagagcgggaggcgggcgcgagtgtggccgcgcggggctgagcgtgtcggcggccgggcgggcgggggcggcgtgtccgcgtgtcccggggtgtgcgcgtccccggcgggtgtgcgtgtgcaccccggagcgtctggtggcgttgttggggtgagtgcgtgcggggacgcgggcatggctccccgctacccacttcccgagtggggacgacgggcggaggagtgtgccgggcgccgcagggagtacgtgcgggtctcagggagtgtgtgtgtgcacgtgtgtgcattccaaagtgatttgtgtgcaagcacatgcgtgagcctagaagggcgaaagtatgcctgtgtgggtgtgagtataacgagtgtgcagggccgtgcgagcgtgtttattactgaggttgaggggccggccccctttgcgcccaccaggcctttgcacagtgatggcccccgagccagggagcccgtggagagagaagcggcctggcatgggctgggggtcggggctgggcctgatccggtgaaccaggggccaggagggcagactcagagcctggctgggcctgacagaggcaaaggtcttagagccaggctgcggcagggccactggcaggaccctctctgcatacacaggctgggcgagcggaggctgtggtgggcccctcggccgggcacccgaggacgtgtgttttcctaaatatcctccaggctctcctgtctttgttcttgtctctctccagccaggcctggggggctgaccctagacttgcctgtgtatgtgggggcctctctgcctgccctgctaagtagacggatcttttgatttatttatacctctcctaggctccaagtgtgaatcccaggacagtaacaaattgatcacagcgggcttgggacaccagcttccgaggtctgtccttgcagttttgactgacaggcttttgtgtgtgtgcgtgctctctaactgttgaaaatctttgcagctgaaagtcttaattgctttaaggcaaactttagaaattccagagctccctagttggtctgacttttccaaattcagcttgccttttttgggggaaaatgtcgccttagtttggtgtacagtacgtgcaggcaggtcttggaggcacgtttaaaaaccctgtcgttaatggaagaagaatttcattgaaagggacgcagagccgtctggaagcgcctgccccggactcagcgagtttggactcagcgagtttgagcttaccgaatgaactttggacgtcttcttttagcaaacaaaacctggaaggaagcaaaaaagacccacattctttttcttttttctcctgaaaatgaaaaaaagaaaacaccttctgggtttgctggaaatgccccctctccttcccccatcaaggccaagccctcgctgcgtcccccacccccaaataaaatatgcctgtggggagccgtggaatgagtcactccctggcagagagcctgacgggcaaacatttgggaaggttcttgcctaacttcccagaagaaaaggcccaggatttaaaatggtccctgtggtttgtcagcctctgctgtcccgtctgcttcggaaatgactaaaaagtagtttgtatctccacaaaataaagtctcagactgaaggccttagacccaggttggtctggatttagagctgtttgggtttccagaaatggagcgcctggctttaactggtggcatttctggtgggtttgaacaagggcagaggagggaaatggggaggaagttcccttttgcggagcagaaggggctgtgtgctgggagccgttctagggggtgtgaatctcccgttggtcttctgtgacagaaaatgcttttggttttgtgcacaaggaaactgaggcacacgggggtcaagcctgtgtcctggggcagctgagaggaggtgggggcagaatccgaagtcacctgcccagcctcacagcctttcctctttccattgcacttgggatatggtatttgactggctaaggtgcacagacctagtgctgagtactttagcacacatccgttcattttctgctcatcgtagatagggtttattatccccatttcacaaatgataaaactgaggttcagagacatgacttgcataatttcattaaagtagcaccacgatagatggtccccatttatttttatttatttatttatttatttttgagacagagtctcactctgttgcccaggctggagtacagtggcgcaatctcagctccctgcaccctctgcctcctgggttcaagtgagcctcctgcctcagcctcctcctgagtagctgggattataggcaggtgccaccacgcccagataatttttgtatttttagtagagatggggtttcactgtgttggccagccaggctggtctcgaactcctgacctcaggtgatccgcccgccttggcctcccaaagtgctggaattacaggcatgagccaccatgcccggccatgtccccatttactgaggatatactgtgtgctaggtctggtgctgtattttacccagtccactcaccaacactaagatggaagctgtcacgatgcccatttacagatgaggaaactggggcacagagagatgagagaatgcgccaaagaccatgtgctaatacgcagcagagctggatttgaacccaggcttgtctgagcagagcccatggtctccccactgtactaggaaggtagcaggcactgtgggctggatgcctggcctgtgctgaggttcagtgtcgttttcctgatcttacagagagggaggttaagtaacttgggcagggtcataaacccacaaatggcagagtcgggattcgaacccatgtctctgattccagagttcctcaccttaaaccacatctggctgcctttgtcgtgctttgctcctgttgcatgctgcaaagccaagtaggttaagacaggctaggttcctgcagggctgggttgcccgagacctgggagaggtcttccagaaggcactgctggccttcctcgcccagggccagagctactggagagaaagggctgctgttcacattttttcttttctttaagtgccccagatacttttcataagggaagtgtcaaaacaattgtcaaaaggagaagaatatttccttcctcttctcaggctagaccaagcaagggagttggagggtggagagtggagggacctggtgaatcatccaagattaaatacgggcaggcactgccaggcttgtgtggagatgaggctgggacactgttcgcaggaagagtccggtgttctggccccctgatgtcaccttcacgggcctgactcacagtcctaaatatctgacagcgagatcgcttgtaggtaggcttcttgtcacttgtcatttaagtcccctgcctgccttttttccctgctcatttccatttcgatcacggcttctactacatgtgcttgaaatgaatgttgtgtgtgaggacctgtgtggtttgggccatgttgtgcccccctgccagtgtccttcggtgttgaaaggaaaaggtatttctctcccttccatgtatgttctgcaaattgacgaacatttgcaaattgctttgagatgcgttaatttaaggtgtgaaataatagatcttgtgcgaaggctcagccacatttctggcattgatggatttttctcccgtctggcctgtgatttggggaggtaaaaatagtccttttttccacatttttatctttttttttttttgctgacatcattcttaggaagtggtgtgcacatgccgtggaactttacatggaacatggagctctggggagcaggagtgctcttggagtgaggggtggtctgcggtggcccaggcaccccctggctgtccgtgaaatggctttgaaatgagcaggcactgttgagggcctcagtggctttttggtatttggctgtcttttcacttatgactcttgggtaatggcaagataacttttggggaaaatgttagtttaaaaagaaaaaaaatcaggccagcactttcactcattcctgtctgagctggtcccttcctttggccaaagctgaactaaaccaatggccttctcagactcgacttccagacagaggagccgacattggggcaaatcagttggtggtgtaatttcctgtgatgttaactttgggaacttgaacttggagtgggagctagcattttgacatgtgtccctctaacaggacttgcttgtgtggaaacagacccccacatacatggctgcgccattgtctccaattctggatttttccacagatgacttctcgggtgatctggtggtaaaggcacaggtcttctagccaggccttcttggcctccagcaagggcaggatcacagcaccccaccagacctgactggccaccaccgctgtagctgtggctgggcgagtgggggggccatgggaattgaaagatggggtggccgagatctgaaatgcattcagttgcagtggcctggatctgcacggagccgttctttctttctcttagacatctgcatggtggtgacctcatagaattctaagaaaaaaggggctttatgtaggaattccatagagtgtgaaggaatttggacaggggaagggggagggaagttgccattcagagcctgcagtgcctgcattttccccgaattgtttaaccctcatgcttcagaattaggctgaggcttgcggggtgggtcatgttgacctgggtgaacagagatccctttaagaagaacttctccatgttccagaggcgcgttcttactgcaggtgagtggcagtatgggaattagtccacaggccccttctcgaatgcctgccctctcttgttccttgtcctcaacgtctttgaaacttgggcttgttgggaagacacctgcaaaaggatggatgcacatgaccttcagctctaatgaatcaagctgctgatgaggaattcactgggctcccaatccagagagcttcgcacacacccactggggttgagacgagcactgggtttatttattgtggacttttggagtctgaaggactcttgccacccatctgtttcacggaacagaacctgaggctcagagggagcaaggcgctcccccacagccgcattgagagcctgagcctgggcacccgatggagtgaatgaggctggagtcccagacctgcctctcatgagcacgtcgcccactgagcctcagcgtcatcatctggaaaacagggataatattatgacctcagaagcttcgggggaggaagtaagtgaaataatgcatttcagatgctcagcgccttttaagtgcttgatgctcattccccaagattacatgagagacatggaaaatctttaatgaccaaggacccacccagggtcactcagccgggacccttggtccgtggcccagagtgtctccagtgcccctgcattgaggccctaaacaaggccagaagcaggtgccggggacccctctggattccaccagagcaccttcctaggatcatggctcccaaaacggaagggaaggagacagcgcagtttgcaaagaggcaggatttaagcaccagggtggccctgtggcgcctcaggaaaatgtttgcctgtcagtatctgctctcgttcccacctgtccccacaaagcgaggccataagtcctcggcgtggcattggagggtctctgaaggccctgagagctgtgtcagccacggtgtgttatgaagcaaggcagatgttttgttaattatttacacagcgtcggccccgcagaggactgcgctgacaggagcggctgtcacaggcctggccgtggggcagaagtgagcagccgtcttcccctggcagtcctcctgaaaaggtctgcatggcaaggcctgagggagtcctgcacattttatgcccccgccccccaaagccatttgggtttcccttaaactggcttgttttcctgagccggtggagagatccttgtcctccggaagtggctatcgctctggggcggcttctctgccagctcgtcacaccctagacccagctgtagtctgtgtggtgggagagggtgtcaccaggctctggaggtccactcctctgtagtcacctcatgcaaggagggcttcacaggggcccagcctctactccctcatccggaaaacgggccagtaacaccaggcaccagccccgtgatcctcaggcacccttgggggtgatctgccttagaaattcaactttaggattagaattctgctaagaggtaccatgtgacaaaaaaggtagtgtaaaaatcacaaagaccaggacaggctcatgcctataatcccagcactttgagaggccgaggcgggcagatcacttgaggtcaggagtttgagaccagcccagccaacatggcaaaaccccatcgctactaaaaatacgaaaaattagctgggcgtggtggtggacacctttaatcccagctactcgggagcctgaggagcctgaggcgtgagaatcacttgaacctgggagacagaggctgcagtgagctgagattgtgccactgcactccagcctaggcaacagagcgagactctgtatcaaaaaaaaaaaaaaaaaaaaaaaaagagttctgcaaagaatggcacctggcatcagagctttccctgaaaggccactaaggatgaggaacgtgagctccggggaggcgaagggggcaaagccacctgcctgttgcctgttttacataaggaggttttgcataggagtcattttaagatacatgaagtagccagaatagataaatccacatagacctaaagcagattggtggtttccagggcctttggggaggggagactggggagcgactgattaagggacatgggtttttattggggtgacgcagacgttttggaaccggatgaaggtggtggttgcacaacattgtgattgtaatacatcccatccagcggtttgctttaaagtggttaaatatatctgagaaaaatgttaaacataaaagttttggccaggcacggtggctcacgcctgtaatcccagcactttgggaggccgaggcaggcggatcacgagctcaggagtttgagaccagcctgaccaatatggtgaaaccccatctctactaaaaatacaaaaattagctgggcgtggtggcgtgtgcctgtaatcccagctactcaggaggctgaggcaggagaatcacttgaacccaggaggcggaggttgcagtgagccgagatggcgccactgcactccagcttgggcaatagagtgagactccgtctcaaaaaaaaaaagacaagtttgtcttgctttaaaaaaaaaaatacctctccttttacagatggcgacactgaggcccagagagacatcatgaccagcctcaggtcccacatgcagcctgctgctctgtagcctaaatcagatcactgtcccagctttcaggtcaaggctctggttgtgacacctgggcctggactgcgggtgaaaagttttgatgcaaaaacacagaccgtccattgtcctatgggctaagtggactcccttctgctaaccagagatgcttgtgctggctggtgtgtggcacgttatctcattctttcatgacgtatgtccggatggaagtcctgggtcaggcattgtgctgggagcccacacgaagaccctctaatggccccacccattggcctctcaccacctggtggggacagaggctgtcacaaccccttcttaggtgctcttgatcaatttgcaggtggcattttttgggatgtagtctctggggaagtaggagagcttccggcagtgaggggtgtttgaacccacctggagggagacgtggggtttgccagagggctgagagggctggggtgaagggcaggtagaccccaaggtggagaggcaggtggggccggtgggtgagaggtggggctgtggaacttcctcctgcttctttggcctttgctcctgtcggtagatggccttaccaggcacttactgtgggccatgttctaatctaacccttaacctgagggaactcacttcatcctcccagtgatgccgtgatgtgggtatcgttctgcccattttatagatgaggaaacagagacccagagagtccaggatctgtggtgcttgacgagcatcagcctgagtgctgtgaggacacccacagcatgggggtctgagctgaaaattggaggacagaggctgccctccggaagtgaccaggatgtgccctcaggaagtgaccagctgcccagctcaggacctgtgtgagggcccccaggcagctggaaggaacagtgtgcacccaggtaccatgccagggcccctgagcatccgtcttgtcatcgcatagttgtaacctgcctcacagactgaacatgcactctagaaggggatgggacttggtctgtggaccacaacagtgttctccatggccagcattgtgcctgacacataggaggagctcaattaatatttgttgagtgaatgggaagttttaagtaggcacgcggccggatccttggagaatgtttatatggagtgaacgaatctgttagcaaacgttcctcactcccctcagtgggctgtgcagggctgtattgagctgagctggcccttccctgggagaagaggtttcttagagaaatgctcatcctcgaattattccaatgaggaggaacctaagcccagaagggctctacctcccagagttacaggctctccttcctatgccccttccctgccgaggcagctcccacatgtctgcataggagggctttgggttggaatgggtcagtgctgtgtcttaaagctgcattttctaccaagcacacactttgtttagagggcatatcttttggggttgctttgaggaaaggctaaccaagccacctctgagcacagacatgactttttggcaaatgagcaggaccccagattacaccccatcttagaaagtaggaaacccagcattgaaagaggaaagattctgcagctgatgtggccttggcgggccaccagcgtgggtgcccagatggcaggatcactgggcaccacatggcacacagaagagagcaaaggagagggagtccgcccctgggcttggcaggtccggtcgagtccgcctggattcagttacaacaggacctcgagtgggcacggcgtgccggactgagtcagtgtgtgtacatttcctttgttcgtctcctccgggaatgtagtggccttttgtgtgtgttttaaatgccagcctccttacctaacccaagaggaaatgaggactgggtttttgtctgtgcagacgctgggacaagtgtgggagccgcctgctcttggagccagcctagtggtgacagcgtggcatttggaaaacattctgtggttttctccaaggggtgatgggcacaccaggtgctgggccgcccctgagctggccactgggaccctgaaatgaggaagccctgtgaccaggtttcatgatgccattcagcaagggacggctgagcaccacatgccttcttggcccctggggaaacacacaggaatcagatgaggtccctgccccgtcttcctggggaaacatgcagagaaaatacttgtactctgagctaacacctttcactcgcacagacctttatggtgttctgtgtcttcagacattgatcacctgtaggtgagacacatcatggccccactttccaaactcccaaacgggctgtgatctgtagaagtatttagtgccattcagggacaggagagatggtttggaagatgctgtctgctgtgcgaagtctctggatgctcaaatggcttatggggtggcatctttgaaattacccagtcctgaaaatttcaggacatatggtcactgtgatgtgctaatgttagcaattgagatatttaatgacccagaaaaaccccttttcctacccagtgcaggttactggagagcctttatttctcaggaggagggtcttacacagtgtaatttggaccagcagatagggagtcattatccctcattcatttattagctaattaagtggtttatctggtcacacatttactccttcaattgccattcatccagcactgtttgctgatgtacctggcctggtgctgggtactgggggtggaatgaaacagaacaaatatgactgagtccctactgtgtgccagcccatagggtgtgctgtgtgccacaggtgaatgcattcacttcccagtggacatttaacaaccacctactgtgtgcagactcatggagatgcagaaatgcaaatggcacagtccgtagtggtttggacacttgtggtgttttgatggggtctttagtcctggctctctctctgcttgctgtgatatacccagtcagccactgttcacaggccacgtggtgacgtccccagaatgaaccagaaacaatccagatgccccaggaaccgacgtgagaacaaggcatccccttcacacgttgtgtctcagttcagcgtcttgccaccacccagcattttgagacagaatgtgagatcgcgtggttggctaaatacataaatattttatgtctcgatattctgaaaatgaagcccaaatgcacagaactgcagcacatcagtgctatagatcatatgttataataatctgatgacatgttgtttaaatatttatggactgatgcgacatgacaatgggggagagaggaggctcggagcagagtctcggcagatgcgggaaggagggagcagattcctgtgatcccgagaagcgtcacaggacacctgggtttctgatgtgatgttttggggttttatgacaaaaacagtggctgacatttattgagcgcttgccgagtgctgtacccttcactgataccatgtcattgaatcatcacagcattcccagatggtggggctcttattaaccccaagttacagaggggaaactgaagcccagggcaagtcagtggtccaccccagaccccacagctagtgagtggcccaggagcaaatccaggctgaccccattctgcattctagctcttaattactgtgccgtgctactctaggggtgacaggtcatatctgaaaaccccccacccctgcctgggtgaccccttgcttggtgctaactggactttttttttttttgagatggagtttcactcttgtcacccaggctggagtgcaatggcacgatcttggcttaccgcaacctctgcctcccgggttcaagcaattctcctgccgcagcctcccgagtagctgggattacaggcacccaccaccacgcccggctaatttttttttgtatttttagtagagatgggtttcaccatgttggccaggctggtctcgagtgatccgcctgcctcggtggactttctaaatcacaggaaaggaaggtgatgtctgtaaaatgtcggatgggattggaaggcacaaggaatgaatagcttaggaggggcagggagtcgtgtggaagggccactgcagcccggtgcctggcacatagtaggtgctcaggaaatgtggttcttgagcctctgcccttctctttgttgttggttttgcagagtcattaagggagtttactgcagactgtcccccatataagtgtcctgtggcccctgagcctttgcctcagcctctctctctccctgcagtgccctgggaggaatcaactgacagccctttcagtctcccacagtccagccagttaaatcaaggtgttccccttttatagaggagtctcctagagccaaccgcagcatccctgcctttgggagccacctggaatgtgccagctgcagtagccgttccttccacgccccccccccatgctgtctgtggggcttgccactgagtgctccatctccccatgtgctccatcccccggcatctgctgccattggtcctgcctgttgcgttacttctctgtgccctggagcccctcaagcacagaggcctcgaaaggttgatcagacatcctcagcacctggagcggggcctggcacacaagacggcaatgaacggccaaccctagaagttcaccccacaagacctgcagggcgggggctgagtgtccaagaagcctcttgggaagggatggtcttagacctagtggtgtcttcccattctgcagaggcctagggatgtccccaggtccccagagtgggaggggaagggtcagaagtccatggaaataaaacacagggccagctacaaaatttgtggggcccagtgcaaaatgaagatgcaagttcccttgttcaaaaagcagtaaaaaaaaaacacaaaagttttttcctttcctttgcaatctctttccatctgtcatgatgttttttgtttgctatttaatgtctcactccctggacacaagatactttcagggtgagtgcagacctcacaggtgtgggcacacctgcccccgaccctcctgcctgcatccgggcccctgctgcaggtaacgggtggcagaggttgctgggtgcgggagcaggcagctgaatacccgtcctggggaggcagctgagactctgtgctgccagcatgtgctccattattccaccagactccacttaacacagattcaaagatgacatgaagcatttcaggacagtgaaagcacagcatgaagccctacgcttggggctcccttcttagggcagggccaggtcacctggacatgaagccagcctgatgggaggggccatagcacccacacacacatttcacacagagcaagggccttatgttggttctctccacagagctggggccagatctgatttgaagggaaagttctgtgttaagcactgtctgcagactgctggcccagcaggttagtcggccagccaggggctctccctcttcatccggagcctctggtgccaaagacacaccatggtcagccctccctgacttaatctctcacaccattgccagagattgttgcagtaacaaacccaacccctctgacttccgctccttgagtgacaagggtcagaaatcgagtggcgcggttgccaaccttctcactcaggaacaacgccaaacacgtggtgccccagagatcagagagggtgaggagcttggattccaccagctgtcacgctgttcccagccccaaaatggggaggctcagcacccacagggagtgacgtctggttactctgaaaacatggacaaggaggctcaggtgaggggtacttacttagtacccactgtgcaccggagacccggccaagtactttccgtgtgttgccttcgttaatcctcgtgacaactttgagctgatcctgtttttcagatgaagttaactgaggctcagagaatgaagctgccagtccaaagccataaaccacacactttggaaactgagatttgaacccaggcccggctggccccagagttagtgctctttgcacacgaatcccaggcacactggctggctgaggtccctccctggctgggcctcttgcccccaccgtctgctgcatctgcatctgcaggacaggggccagacctcagcgctgctgcctgtccactcctgcccctgagcagtccatccttgttcttggcagggagcagatctcagggccacagctccagcttttctcctgcaaggcctggccagctctgtggctgtacttgtgcccagagagacaggtggcagcggcagagttaggcacacctggccgtgagccacacccaccttgtgctccccgtgtctcctgggcttgttaccgcccactcaggcctctgttttcccatttgtggagcaaggggtaatagcagatcctgtctctggggcagttttcccaatctattgtggtaagggtgtatagtcctcagttccacgccaggcccagaagaggcctttgatactctgtgttgatggtaaacgacatggtatggggtgagctcggagcttggtggcccctgtgacgctctggggagcgcttccccaggccacagggcaggctctcagtccagagctgccctccctaaggaattcatcccttccttgttttctttgttcattcatttcatcccacagatccaggcgctctgctgagatacagtaatgagccccaggcatgaagtccctgcctgcacagggctggtgctgtggttcctaaacaagaaaccggtgcagggttcctggccaggcagtgctggggagaggtagctgggacagcgtggtggcccatggctgccacaaagaatggagttccttcaatctctttcttccattaaagggcaatccctggggatttaacatgctgcctttcgtgtgaggtcccagcactcccagcgtcctgggaaggcctcatcgggctttgctttgcttcaaggtgtctttgagaaatcagtttttccagttgcaatgtgggagttttccccaggctctcctgagactcacaaccgctccccctaacgctgctggtcatggagacccacctgggccaggccctggtcacatgtgatcgcatcgacctctcttggtgaccttgagagtcaggtcctattaattcattttacagatgaggaaagggaggctgagtgaggctgcatcatttgctgaggagcacagtgtgcccactgccaagtcaggatttgaacccacgcccgtggcttccagaccacactatcggaaccactctgccctagtgtgaatggatgtttttttaattcttggcagcagaaaaaccaaagattctgctcaaagcagtagactctcagcggcccatgtgtcagggctgtgctgggtgctgcaggagagctctgcagagaagaatagagacagactgttggtgctaaaattggcctgaaaaatgaccatttccgcgtgagccaggattgcgttgactccttgctccaaggctgtgaggtgtgtggggttaggttcatgtgacagatgaggaagtggaggctcagagaggctgtgtggcttgccaaggtcacacagccccgggcggccttattccacatccacctgctctgtctgccatcatccatggtggtctccggactagctttggcctccccaacatcctgcatttggataaactgaggcctaaagaacaattcagggcttgatcccgaatgggggaggggacggaaccctttgcatgcttgtggaaatggacactcattccacagcgaaactgccttcaaaatgccactgattctcagggcaggagaagacttaagaaatgacagcgggcagtcagggcacgtgtgtctgtgacagcagaggggcccgtatccacccttcctgggaccgacagccagggtgatggggttttatagcatctggaacaggcaagccttttataagaaaatgtttccaaagttgtcccgtcccaccgttggcaagcagtccttaaacggcaaagaaacagccgtgctctgcattcacgaaatggtgagctggcatttaggccatttatttaaagcgggagttgaggaggctaaagacttcagttctgagtggcggctcgcagcctcactgcagcaggggagcgtaatcttcagggttttcttcccatttacgggtttttttgttgttgttgtatatttgtaaaatgaggcttctgctggcaaaagcaggttttagcgagtgcggcggctcttccaggacctaataaggccccaacggagggtgaattccagcaacactttccttccccacatggcccccccattccgtcttgcctcatacactttgggcacagggtaccattcatcttgcttcccattaatggaattaccgccatcacttctgtgggatgagatgggccctttggaactgtcttggggacagaggcaggattggccgccaggcagttttgcttagaggggaagggaaagaaagagagggagagaaaactcttacaaatggatgcttccttgggtggtaaagatccttggccatggaggacagaggccgcagggcccatccaatctgcttcctgcgcatgtcccgtgtgagcctcgctgtggcagggcatgtgatggccccagtggcagatgtgaacggggcttgacacctgtgtaccacagccccttgacttcagaagaagggaaggagggacccagcatttatgggctgctgacagatgcctggcactgtgctggccaaaatttgggaagtggtatctctgtcctcatttttagatgaaacagcagagtcccagagagtgtagacacttgctttgagtcacacagctcatgagcagtagcactgaagtttgaacctcagtctgtccattttcgtggaggaccagcagtgcccctccttgaggctccagaagcagcagagtgtggactcacagtccgggtacctgtcagcagcctgtcccagcatcacctcccaattccccaagaaagtgagcagacatctggagggtttttgctttcatgtaagaatgctgatcgaggacaatgctgaatatcatgtattccacctggacatctgatagaatttcaggggtctgggatcctgagaatgagggagggaggttgggagctgaccggtctgacgcactgtgcttgccattctgcatgtccatttgtagcaaggctggcaatcattgtcctctccagtgccggctctgatagattgataggggctgcccgagatgccatgttgagaaggctttggagactggcattgattagcaatgtctgctgtgtgcacaggaatgaaaagatggatgtgaaaaggaccgacctaacttagtacaattcttaacctgagcagggaccccaggggcacgagctctgcttagttcttgtgattagttcatcgtgtgcctcaccacacttccatcccagtaaactccaggagggtgagactgtgcacagcacacagtgggaattccacagataacagaaggaaggattgatgaaggctctgcagcccccaaagagccaacagttggaatcctacagtgaatgtttttaaaaacgtaattttaaacttctagggatgagatgtaggtgcccacttatttaaaccagggccatttcatccacgtcactaacttgccggatgtctttgagtcatggtttcacctgcctgagcctcggtttcctcatcttcactcccagcactgtggaggggtgacctggttgatgacggtcatggagcccagaacccatgggtaacggggtcagcattcagaagtgtcagctccagctgcctgcccccgcctgccgggccctgtcctctgccaggcggagctcctggttctctgggtctgtaatgctttccttctcacttctcagacatcactgcttctggggagtctcctctgacctcagcacactgcttagaaacccctgcttggtgcctccatagccccttctgcatcttccccaacatggccccccaccctgtgaggcccactaatggccagtcccctgccccaggatcccctccagggctaggactgagccactttcctctgtggtcccagtgctcagcccagggcctggcctggcaaaggcctcggtgacggtaatgaggggagggagcaatgcacccttcgtttgttcctcaggcctgtggccatggggacagctgagatgctgagaccactgtgtccaaagcccaggccttttctggggacagataggtcagcgggacggatggaaccagctctgtgactcacatacccattgtgcctgctgcggtgatcctttaaacgacagttaggtttgatcctgcgggaggtgggtgtttggaaaggttttgagcaggggagtggcccccctgaagcagagtgtggcccgtggaggctggggggctgggaggcggctgtgaacttcaggagagaggagggggaacggggctgtcctggggagagtggggagaagtggggagcagcctggaacagtgccgggcacctggtgtccacagcctgagctcctacctggagacccctggatcagggagtaaagaattctgggctgcaagtcagaagaaatgctccccaggggcttcagtggctccagagtctcaggaatcatctctggatgggtgactggggcaagggtgggctggggccctggtcttagtctcctcatcagtcaaggagggcaatgtgctttttgcccttgactctcctctgaccctggcccttcatacctggatctggcttgggagcagggtgaggccgaggcccacagaagccatagggtcagcctaagagcaagagtggaaaaagaaaaatcatgaagcaataatgagcccgtggtacatcgaaggggccattgaatccccgtggactcaggacgacagtggctggaacagtggttgtctatgtgtggctggagtgtgtgcagaggggccagtgcttgagcctgaatcttcacagcccctcctccatacatgcaaatcctaacagtatgttattattgatatgtaaatattagctattagctttttaaacaataattcctcctcctattgctattgtggctcgttcatcagagcacccttcagatcagtaggggttggccaggtggcgaaggcctgcagttagagcatggggagactgcgtgagcaggtgcagaggtgggaaacagcagttgcaggaaccataagtggctccgtggagctgacgtggtggaggacagacatcacctgggcttgggcttgatgggtcaaggggtcttaggtgctaagctcaggagggatggcaacccagaaaccttgaaggtggataaggaaggggagatggggtcttaggaatatgtgtctggtggcgcgtgtggaaaatgacggtgctaaggctgggaggacttagaggccagtggggaggcccaggtgctgatgccactgtggacattcctgagcctctcagctacctgaggccgcacttccacccaaaaagagtccttggctgggccgggtgtggtggctcacacctgtaattccagcactttgggaggccaaggcaggtggattgcttgaggccaggagctcgaaaccagcctggccaacatggtgaaatcccacctctactaaaaataacaaaaattaaccaggcatggtggcacacgcctgtaatcccagctacttgggaggctgaggcaggagaatctcttgaacatgggaggcggaggttgcagtgagccgagcttgtgccattgcactccaacctgggcaagagagtgaggctccatctcaaaaacaaaacaaagaatcctcagctctttctcccatcccaccaccttctcctaccctttcctgctgggtgttggggcagcggagggctctccccttggcaccctcagcctctctcggctttcctgtgaaaaaccaggccgatgcctgccgacttgtgagaataaatgataaaatctgtgacgctcccagcactgcctggggagaggaaggaaagtgttgtcttccctaaattcctatttctgcgtgtcgtttattctcttccctgtcagagaagttgttttgcttcctggggacgagagaggcccgcgttcacgggagcgcgcccgcaggccccatccaggcaggtcggcggccacggaattcatttgtatccccaatttccaggctgcctcgtgaatctgcaagagccctgctcctcatgtgctgtggagagtgcatcgtgttgtccctgtgactgatttctgatcctccctgcatttatttgtttatttgggtctgagaagtccaaagtgaagctgtgagaaggggcgcctttgagttttaatacgggatgcaccatcatataaggacactttggtcaacagcagactgcgtatgtgacgttggtcccataagattataatgccatcttttgactgtaccttttccacgtgtaaacacacaaatactgaccatttcattactgtcgactgcagtactcggtacaggaccatgcggtacaggtgtgtagcccaggagtgacaggcgacaccctatcgcctaggtgtgggggaggcgagaccgtctgggtttgtgtaagtcaactccaagacgttcacacagtgacaaaatcgcctcgtcatgcatttctcagagtgtgtccctgtcgctaagcgatgtgtgactgtttatatctgtggtactttgtaggcgttgggggcatgggctgggtttgtaggttcccctaggtgagcagtagtgtcccaggcattgaggagggctgtttccaggtctgtccgggtgtcgttttccgtggaggagaagttgctcaagaagatgagcccaggctagcccacaagccctcaccccctcgcagacccaggtggctgcaggaggattctagaggagactgggttctgcccgccaacagggggctcagccacacccccccacccctggcccaccataggacttagtgcccacttgggatgcggtcagaatatttttaggttgaatgggcgcatgagggtggggagacgcatgcgtcagataccggctggatgacttcatgtatgttggttgacacattatacagctggggagactgagactcagagaggctgagggtcttggctaagatgcccagcaaagaagtcttcataccacatctgactccccgctcccttgagaattcccgtcacctagagcacccgtcccagcccctgccgcagtgctggggaggatcagtggagaccagggtggggggaccaagcacgatctcagacctcctgtgtaccggggcactttgcctacacagtctcatcttcagtagatctctttcctggttttctgatcacaaaagtgaggcttagagaggtgatcaatttgggcgaagtttcccagcaaataggtggagtgtcccatatttcaattctggcctggcctggagaggatggggggcttcaacctgtcttggtgggatagcctgggctgtgataccggaggcatcactttcccaccaagaaagagcaggagggtctttatgggggcaaacagggcagggagctccccctcggacccctgggaaacatggggctagattgggcccgacaccagcccagtccctttgcagcctactccagcctttctcttccctttttttttttttttttttgagacggagtctcactctgtcacccaggctggagtgcagtggcacgatctcggctcactgcaacctctgctccccgggttcaagcgattctcctgcctcagccacccgagtagctgggactgcaggcacacaccacaacgcctggctaatttttgtatttttagtagaggcaggggtttcaccatgttggccaggctggtctcgaactcctgacctcaagtgatttgcctgcctcggcctcccaaagtgctgggattacatgcgtgagccacgcgcctggcccagcctttctctttctgacttcacttgccccacctgtgcagtgggaggacaggagaacccctttgtctgttgagtgctgattatgtgccaaggaatttgctgcatgatctgatctgatggccccagtgactctttgaaacccggccccttattggcaccacccagtcactccctggctgcgtttccctcaaggcacgtatcgctgtctgaaatgaccatgtctgttcactctcatgtctgtgtctacctcccaaccacgcaaaacctgtgggaggggaaggccttctctctcttgtccactcctgtgtccccaacccctcggacagcacatggcttcacaagcttctcaagaaatgcttggcaaatgatggcagagtgggttaaccctggtgttctcaaaaagggaatggaggcccacagagggcaggcccatccctgggtcacactgccagggcaggattggagcccctgcctgtccagggtcagctggggcctctctcactgaccagctttgagcctggaattccaggtgtgcctggctgtgtccttgcaggttcacaccgcccaaagaaacttccagtccacacttgtggctttggatcagctcagaaaaagtgtgtcctgtgactgctcgaggaatctgggcatttagcccagaaaagagtgtgtttcctggcttcctgagaactggggcccaccctgcccctggtctaggcgtgcagaacaggagggaggggagttgaaatcggggcctggaagggtacggcgtcagaccttatcatctgagtgaggcttgccgctcacgctgagactgtcccagccgagcactccaggagagggtatccccaccattggagcgtccttagagatggcagcagcgcctggagttgctggagaagaaacattcctcacgctcatgcgaatgtttccctgggctgctgtcccagcactgggtaccgtggggcagacatgggtgtgacgttttccaagcacgaggtgaccagtgtccattgggtcatcaggcctccagggccacatgtttggaaagctattcctggagcaccaggcatctggcacctcgctctgtggctaggcacgggtttatgaggggaccctgcagagagctggggtcctcagccttgacatttgcacattgtgtataatttcacgctttgctttgcttttttctcttcatttttttctttttttgagacagggtcttgctctgttgcccaggctggagggtagtgtcgtgatctcggctcactgcagccttgacttcctgggctcaagggatcctcccacctcagcctcccaagcagctggtgctacaggtgcatgccaccacagctaatttttgtattttttgtggagatggggtttctccacatgttggccaggctggtctcgaactcctgacctcaggtgatccacccacctcagcctcacaaagcgcttttgtttttcttgagaaagatcagagcttccctgctgcatctcccgcttttcgcttgtgttttcttttcttcctcaccagcaggctgcctggtgactggcctgggggcctcttccctcagaccaggaaatcacccagtactccgagagtgttcactagaattaccctcatgttcactggaatatactggtcagatttctgagagggagaccccctttttgtactcataggagaatggaggaggccggccatgcttctcctcagccacgattgaaaaagtcacctagcacagtggcctgagtccactggttcccaaatcccagacccaggccaggcctagggccgtgtgaagtcttccgcggacccacggtgaaataagaaaaggaaggcctggcttggcatagctactttccatgtcagctgttttttcttttttttttttttttttttttttttttttggaggcagaatctcactctgtcgcccagactggagtgcagtggtgcgatcccagctcactgcaagctccacctccagggttgaagtgattctcctgcttcagcctcctgagtagctgggattacaggtgcctgccaccacacccagctaattttgtattttagtagagacagggttttaccatgctagccaggctgatctcgaactcccgacctcaggtgatctgcctacctcggcctcccaaagtgctgggattacaggcgtaagccaccacacccggcctgtcctttcttttatgaaagatggtgatactaggtggacgttttattttagatgccagaaaactctggcaacctatgtctatcttcaaaatgtgggagaggctgtccaggcctgtgacacctccaggcccggaagccattgatgtacttctgtaccccagacacagaagtggagcccggggcagactttgatgcctcaagaacctctgagtcatggccacacgtgagcccccggctctgccctggtgtgcggtggggcgtattggtttcctagggatattataacaaattactgcaaactgggtgcttgaaaacaatagaaattcattctctcttggagaatcctggaggcgtgatgcctgaaatcaggctggtggtaggctcagttcccgtggaggctctgacaaagcacctgccgtgcctttttctggcttctggcaggcgctagccaccctccttgttccttgttccgtgttccgtggctcgtctacacatccctccagtgctcgcctctgtcgccacatggccttcttccttgtgcgtctgtctctgtgtccatccctcatagaaagacacccgtcattgaatttgggccaccctaatcccatgtgaccccagcttaacttgattagtatctccaagtaagggcctatgccccagttccagatagacaagggtttggggggaacattactctgggggcgtaagggatgaggagggcaggtccagggagcctgccctcattcccaggaggagacaggagaccaaggagcagagtctggcgggggaacgctgtcaccacagcaagggccaggctggggccacagggggtgggtcagacacgcccactgaatactcaggggcacgggagggccgggatccccctgactctctgcatcccagattcattcctacgctttcatacaggccccaaagacaagtgctgagtagatctgggtcttcagcacgatgttttttaaaaacaggcttgcagcgtttggtcctttggtggcaccagccaggaccactgagggctgagaacgtctcagcgcccagcataggccgccagccctggctctgctcttttgggttagagagcggcccctcccagtaatgacagggcccgccattcccggcagcgcccaccagcacagcctcccccgctttgtggacaaagggcagcctgtggggcaggaaggagggaatccagcctcccctgttcccccagaggcctttatctattttggcaaaggccctgtgatcagacgtttccgccctgacaactccctgccaagtgatctcaagcaagggagtcccagagccctgctgagccccacttctctcctgtgaagtaggaggcacagttccagccctgaccctctcaggaaggctggggatgacaaggcaaacccttcccgtgcctagcccagggcctggcacatagtaggtgctcagtcaatactgaatgagagagagcatcttggagcccagaacgtaaatttcatgccactcctgcgacggagcctcagtggggcctcttgggaaggagaatctataggcatttccttccccacgtcctaggacacagttagctgagacgaccgggcaggggtggggaagttgagtgcacgggtgtagcactggacggaggacagaggctgctaagctgcatctcaggcattgattggcattgaggaaaacccacctagacttggtatcgcgggagggagggtcatgtgcagggagccctggaagggagcctggagagctgggtgccagccctggctctgcaccccttaccagccatgtgcaggtcatggcagtgccctgtggatcctacttcctgagcctcccctctgcaggcttgatgccactgctgtcatttcggcctctatcccacaactcgcacagggcttgcctcacctttaggcctttgcacgtgccatgccctctgcctggagtgccctgcccctattcctccactcagagctgcttcccgttccgaggaaaaatcccatgccccaggtagactgcacgcacattttcttgtgtttccacaccctgctttgcagagcagcgggcaccctggttgtagtttaagggacgcctgagagccccattgaggatggagattggtcccccttgcctggcacacgcttggtgcccagcacttgtgtgtccattgagtgagcaaataatggaatgtctggaggcatgtgacgcctctgctgtgtggcttggtttccccatctttaaaataccagatgtgggccaggcgcagtggctctcgcctataatcccagcactttgggaggctgaggcgggaggatcacctgaggttgggaattcgagaccagcctggccaacatgttgaaaccctgtctctactaaaaatacaaaaattagccaggtgtggtggtgcatgtctgtaatcccagctacttgggaggctgagacacgataattgcttgaactagggaggcggaggttgcagtgatccaagatggcaccactgcactccatactgggcgaagaccgagactccgtctctaagtaaataaataaaataaaatactggatgtggactgatggagtccttggggatctggtgaaacatgaggcctcaagtgaacggactcgggtctttcctgctcccaggagtggaatgggagcgtggcagcgaccacgcacacgtttgtttaatgattatccaatgttgacccaaaactatgagcaaagctccggggattttctgggcgttcagcacaaaattcccagttaatgggttccagtgtcttaaaaaggcaggactgaggcggtctctatggagttgttctgactgcagctgggccctgtccttccacacctgcccctgcaggaattctccggacgcctgtggagggaagaatgtgtgtgtctggggtccaagaccacatgcaccgcctggtggaactttctctgctcttgcatgtctggtgggagcttcccttaatgacacaggatctgccgagattcatccccaactccaggctggcaccagtgttcaagcccctgcctctgctgtctcccaggtcttcaaatttacaccactctgactctcagtttccctatctgcaaaatgaaggcaggaatgcccacctcatggggtgagccagtggacccaaatacgtggtgcagtaggtgccacggagtagtggcacgtgattttgtggctgttagtgtgagtattccttactttagagagcagaggaaaacacatcagcagattgtttaagccaaaaaatgtctgttgtttgaagaatttcgttttggaaggcaagcccaggttttgggtcagaaccgtattccctcaggcacggcacggttgaacgtcgaggcatattttacaggcttggtgaccgctcaagcctttgagccctccatgcgggtgctctgaggtcagacttttcgggaagccctcacacagctggtctgcttgtcgcgttggtagcaccgtttccacagagcaggctctgtttggctatgaatagatgtttttctcactcttttcttggatgcctgaatggcaggctcccctcctgcagtctcagaggccgacctgcatgtaaaactccaagcggacatcagagtgggttcgtctgttcctgcttggacttgaggctctcagcaaggctcaaagagctgggtcgatggccaccatgacccagggagcctcccgagagtctcccaggctatagtttctgaaggctactgagtgaactgaagaaatcagagttcatggaagaggcagcagatccgagcaacagccgagattgaggaggatggttcaggatctccaaacacaggcccgctggctccactgtgtccaagccgcagatgcaaagcctgttaggacagaaaggacacgagatagcagccagggccggccgcaggcaggagggccgggccaccagcagttaggagtgtgggttctggagccacacaaccggggttcagatcccagttttcccacctctattgggcagcatactgtaagcctcagttttccccttctgtaaaacggagataataatttacctgtctcacaaggctgttatgaggattaaagtaagttaacatcactcaagtgcatagaacgatgctgggtacatactaaataaatacagataaactgaggcccagagagggcaagggacttcgctgtggtcactcagcaagtcattggggcagccaaggctgaaactcatgactcctagtctcgtgaacggttcccccctccctgccctcccccgcagtcagactttttaaacactgccttttgcagaggaaatcgcgtgacccttcagcccacaagaattccgactgcacagaatgtctgaaacctcttcgggctggctgggggccttgttgcaattctattcagctgttagttctttttttcccctctctttcttttaaagctctataggatcctcctttcccttctccacaaatagaaaaattaacctcttgacaaaggagttggaagacttgagtccctgctgtgtgtcccggaaccaatcccccagcctcaggttccccggctgtgaaatgagaaggtgtcctctgttgacagggaggtggccccacctgccagtctgtgattgccacagagacaagccagccaagaagtgccaccctggacgaaggtcgggtgagtgctgattaaacaaaatctggtgacgcatccttctaagaagcgaggcgaaacccaccagagatgctgcgtgcttctgcccacctcctcgtgtcaaaggtgatttgagtcatcagcctggcctgcacttttctcgctctcctgtttccttgcagtgctcctgggctcctgagccactcggggctgaggcccgggggccagttgtgtcccatctgcaggccccagggcattagacctgaggggcctggtcaccttctgatttctgctgggcgccccagccatgagctccagaggctgccagcctagggtgtgagtctgtctccgaagctgctgacatgagtagggacttcccctctctgagctttagttccttatctgtgaaatgggtgcatgagccctgcctggcagggtgagatgaggtacacaagccctatcctacttcactcccctcttccttcctgcccgaaaggccctggctcacctgggatccagctggggcacagcaggtgttgatatgtccacctgctgccccccggctgtgatatgcccccctggctgcgggggacagagggacagctggccacaccgggaagcctggggacagaccctgggacatcagggtcaggagcgtacagggtgcagccctcttggcctagtgatggggatccctaggggaaagacctaggggccaggaggtcatggagacaagactcgaacccaggattggggcccccaggtcctcctgtcctttgtgtaggctcactttcaggttaccctggcaccagcaggggccagcctggttgggcctgggaattcagagatgggtgccaaggtgggcctggagcacgacgtaggcagacacggggccgagccccaccttgctacccgctggtaaggggccttgggcaagtcgtggccactcctgagcccccatctcctcatctcaaaaatgaacatcattcccactcttcccacctttcaaggttgtcatgcggctccctatgatagtgtggacaaaagtcactctgtagaccatcaagaactgaccaggccagatgcggtggctcatgcctgtaatcccaacactttgggaggctgaggtgggtggatcacctgaggtcaggagtttgaaactagcctggccaacatggtgaaaccccatctttactaaaaatagaaagatttgctgggtgtagtggcatgcaggtataaccctggatacttgggagggtgaggcaggagaatctcttgaacctgggaggtggaggttacagtgagccaagattgcaccattgcactccagcctaggtgacagagtgacactgtctcaaaaaagaaaaaaaaaccgcccagaagaaatgtgtcatttcaccctctggaaccatgagccctgtgatcatgaggcacaatcgtcatgtaaatatatagggtctctcaccagccacgggccaagatttattttatggagacagtgggggagggggccagctcagtttcattgtcctggtaactttgtaaaatgctttgccatcacttcccagctcctgggaggatgcagcaggagctgtgcagcctctctcgccctcccaaaaggcggatccccagaggccctggacacctccttccaggtccacaggcccaaaggcctggtgtccataaggctggggttccctggaaagtgggtttctggaaatacttgttgcagggatatcgctgttgcgtgagggctggttgtttatgataacaggaatcataacagtggcagtacccacattgattgattgattgattgagacagagtctcactccatcacccaggctggagtgcagtggcgcgacctcaattcactgcaacctctgcctcctgggttcaagtgattctcctgaatcaagtgattcagtgctcagcctcctgagcagctgggattacaggtacccgcccccacacccagctaattttttgtatttttagtaaaaatggggttttgccatgttggccaggctggtctcgaactcttgacctcaagtgatccactcacctcggcctcccaaagttctgggattacaggcgtgagccaccctgctcggcccagtacccacatttattaagctcttctgcatacccgggccctgataatcctgggctggtattttacctgcatgtaaagtacctcacttggtcctcacggcagccctacaagatgggtcctactgtggctactagtttataaaagagggaactgcaaagggatgaccctgggactggcccaggctcacatgggcggatggaggcagcaccgaatttgtactcggggctctcagacccctgagcttgctgcctctccacctccccacagcctggcctgctcttctcagatccaggacactgcctccctgcagcccccttcattgccccacgttgaaattaacggccccttctgtgattcagcaacgcagttaagtacattggggttttttggttggtgtttcgttttttgtttttttagaaagagggtcttgctctttcacccaggtggaatgcagtggcacaatactagctctccacagccttgaactcctgggcttaagtgatccttccatctcagccttccaaagtgctaggattacaggtgtgagccaccacgcctgacctagttaagactttgattggacaccccccccgccccccccgccacacacacacacacacacacacacacacacacacacacactccatctgctccttcgctgaggggagggtgctctggacacactgctgaggatgtccaggtcaggactcaggcctgcattcccatccaagctctgcctctgcagctaggactccctgagtctcagtttcctcatctgtcaaatggatacactgtctgccttccagggttgttttgtgagcacacaggctggcactatccctgaaggatctggcccagcacccgacactgatggggtgccctggatgcatgcctccatatacacacctccatggctgtgtgttggggagcccaggaggcatccaagccacagccccacgtcactatggctactatgcatgaggaaggcagtgtgcaggggctggagggctcagaagtgatccagggtccaagaacaaattcccttagcaattccagaccgaaaagatctggttttctagtgcccagaaatgagcacgtgattaaatacaggatccccagtttaattccagagcaacccagtgaatcacagatcctttgtcagccgtataagaagcatctgcacaagaagggcgcttctagactgtggagtccaacccactcatgttgcaggtggggaaactgaggcccaaagatagcctgtgactttcccaagaccatgcagccctatgggagtctggcctgtatgagtcctgggccaccagaccacacacagcacagctcagagcacaagccactcctgcggagctaaaaatggccacatacttcctaagcccaactccagggttcagtgaggatcctggtaaggagagcgacacaggaaggtgcaggggttgccatggtgtggccccagatgctgtgattacgcgccagccccgtcacaccgtacgggtggtaggactgggcaaagaagacgccgccacctggatgcactgaggtgtgcacagccacgtggagatgatgctgggggctcacggtgactctcaggaggccctggcctggcctatctggagccttctctgtgaaatgaggctggtaacgcccactagcagggttgtaggggacatggatctgtggccacctcctcaaggggtgccacacgcaccaggtcctgactgggagtccggcccccagggcctgtggatggctggcctgggcccagcctccgcccccaagggtgctggcacctggcatgtgcccgacagttggggccggctggtgggaaggtgtgtgtcaggtggcggagcctcggtgccaggatctcactcacgcgtcctccagggcctcagctgctgtatgcctgtgtcagtcccagtggcgatgagctgcagatggggcacaggggtggtttgcccagggcagaagtggctcgttctgaaaaaggaagcaggtgctggccacggagagcccctcttggggaccaggggctggggctggcctgcagagcccagattcctctcacagactgggtggcggggggtctgtctggcctctgtgcccttgatcccacggtgtcctctactgggaatccccttcccctttagtccaaaccctgctggtccttctgggccacctcaggttttctacctgttgtccaaagctccccgtgacctggccccgccagaagcagcagccatgggtccttttcctgagcagcttcgtgctctttttagcttgtgggtagcagttccagggcctgctcctggggacctgtaagaacaggaactgtgtctgagtcattgcagggtcccgaagggaagacgaacactcctcatcctctgatcctggatccgcaccctcgttttggagaatgcagggcccgaataaagatgcaataacaatcaaataacaaccccactgatggggtatctgccttgtgccccgcctggccctaagctctttcaactcgtgcaatgtcatgtaacccaccagcaccccgggcagtagatactacccttgtccctgttttacccgtgagaatgcaggtgcacacaactgggacgtggctaagccagaacttgaaccaggactgccgcctgccagggctctcatctcatgggcaaccaaggatttgggcccagtttacaaaggagagaatagaaagggttaagcttttaaaggaacagcaagggccggtcacggtggctcacgcctgtaatcttaccactttgggaggccgaggtcagcagatcacctgaggttaggagttcgagaccagcctgaccaacatggagaaaccccatctctactaaaaatacaaaattagccgggcatggtggtgggtgtctgtaatcccaactgcttgggagcctgaggcaggagaatcgcttgaacctcggaggcggaggttgcggtgagccaagatcatgctgctgtactccagcctgggcaacaagagcgaaactccatctcaaataaataaataaataaacaaacagcaagaacagttatgcttttcagcattttgctgggccccagtgtggataggtggggagcgagcacaaggaccaaaggaaaggacccttgtccctccctgagcctacactggtctaatcgggtggtgctgccatcagattccagtccctggtaagcagggggctccgtggcggctgtgacaagttccattcactttggaggtggcagccggagctatttttagagcagcgcatggtgggggagtttccttttggcggtgtctggggaccggagtcttgggaaggggaagtcccatgcggagacagaggcccttcttcctgcacccaccccagcccagagaggcgacccagctccctggaggcccaggcacctcatgtctgccctcaacccagagtggagcagaccttccctggagcttctcaggagccacttcaaaaggtaccctgactttctctgcctcctgctgtgggaaccgcttgctcttaggggtgtgtccagcgagggatggggaaccaggccccagggacctccagggctggagctccagggaccttgacctggctgcacctctgccacccaccgctggctcagccacctgctggtggggctgcccattcagccagtcccaccaacctgacaggacctttgccactagcctgggacaggggtggctgctgatggctgctttcacattgagtaatccctgggcttggccagaacttctgagtttccagggaagcagaaaaagcaattctttctctagggtgggttttgtctgccccttcctgcctgtgggaaggagagaaaattaggggaggccacgggcttgaaagctttccctgcatggaggccactggatgggattctagatgctcgcctgggacccagggtgagttttttacaaacaccgaagccctccagcccccggggctgttccacttggtccttcttccactgtcagtcagcagggtagtagctgcggttctgctctgaaatccatcccttcccttaagccccagcctctccccagtggtccccctggcatgagttggtctcggggggccaggcttctccctcctggcctcaggtgtttctgtactgagtcagcaaccagttacccagcctctcctctgccaactgctggggccatggagagagtggtttagtctctaccctcaaggacatttccatgttcaaggagaagaagacacatgaattagagacagcacgggggagcaggctgtggagctgggagtgacggggtgagtccaggaaggctgcctggaggagatgcccaggagagaagtttgctgggaggcagctcatttccggcaggaggagcagagcctgccaaggcctcgaggtgagagcaagatcatttcccaggcaggcaggggtctctgggatggtgggcctgctagcgggcctgggactcctagagtgagaccgcagctctccccagctgcattgtggtcaccaaggatcacctcaggcaaatgattaaaatgcagactttggagagggttggatctgagttcaaaaacaggccatgctgcttatcagctgcatgagctcgacaagtcatttaacttctctgcacctcagtttcttcatctgtaaaagtgaagggcttgcagacctcacagcagggatgtgctgagctgctgcctgcagtgcccgacacagaggaagcactcagcagatctcagcttcatcttcagggaggctgggagcggacccagccttgaccaggtcccagagtcaagaatcttctgggcagaagccaaatgctttgttgctcctttaactgagagacaagatgtttacagcttctgcattttttttcttccagaattgggttttattacctgaggaggaagtgaaaggtgattgggatgctcctcgattttcaaaaaggccctgggaaccctgcagtgtgcggcccagttggttttgaatctccagtgacttttgtctgatctgtgaccacagggatgctgagccctcagcagaggtttcttggggttgcaggagggtgggaagagccccctccacctactagtcagagattcattctgccaacgccccctgggtggccctcttttcaccgggcctgggtgaggcactggaggtttacagatgaccgcgaaggtcagtccctgcccttaaaggctggcagaggaggcagacatgctgacaaaggaagcagtttgtgtcctcaacagcccaccttcagggagaaacctgtgtagatgccaccagatgggaaagggaagaaggggccttggtgccccctggctgcccactgtgtgctcacagagtcctcgcagcctccctgcaagcttgggctgttcctttttgtggatggggacgtttaaggctcagggaggggacgggacttccccaaggtcccacaagaagtgccaagactatggctgggcatggtggctcacacctgtaatcccagcaccttgagaggccagggtgggaggatcacctgaggtcagtagttcgagaccagcctgaccaacatggcgaaaccccgtctctactaaaactacaaaaattagctgggcgtgatggtgtgtgcttataatctcagctactcgggagcctgagtagtgtgtcagttcctccctgccagccagtctgcctgggcgtggtagtccttccagcccctgggcttgtgctaagtttctttctgtaattgctccatctggctggtctgagaagcaggttcaaatggcaggagaatcacttgaacccaggaggcggaggttgcagtcagcagagatcgcgccattgcactcaagcctgggcgacaaagcaagactccatctcaaaaaaaaaaaaaaagtgccgagatgaaggagggtcgagagatctggtcctggcagacaagtgggactttgcccattgagaggcaccgatgggtctttagtccaaggctggtgcatggaatgacatggaaggaccagggtgctgtgttgctggggagggggaccgctcatttaatatggctgcacgcaaggcctgggggatgttgggggcaaatgcatgagggcaggctcgtgtcaggtggtcagggaatggcttgctccggtgtgcggaccttttgctgtggagtttcaggagagattggcaggttcaggcttgtgtgttaggaaaacctttccatggtgggctggaggctgggctgcaggggagtgtggaggctgaaggtaactgtagggacccaatgagaagggacaaggccagcacagagtggaggccctggggtgagtgaagacatttggaggaagaatggttgggactggatgaagaccaggtgtgggtcctgggggagggcgaggcatccggaggctacagcagccctgtttctgggtgggcaccgtgtggcccccaatcagctggcctcctgatgctgcaggcccaccctgggggaggccccaccaccctgaggaagggggcagcggggaacctgtctgcatggccaccttccaggagtggctcatggtcctgcatccctgcaccttagagcagccaggcttccgctgtcatggagctgcagaatccgggcaggatgcttggctttgcaggtggagagctggggcgagcgtgagggaacacaggacccggccggaaaccagactccatctgtggcttgtcccctccagcttgacaggcccccatgactctggcctgagatcgggctgcttcctgtcaagtgatgaatgggcaacgtctgcttatcctgagaccagacaagaagcggggctggggctggggaagggcccagcagccagagccacagctctgggccagtattcattcagtcagtcatttattcacaccctcttccaaggcagtttggaccaaggcagacttggtttcgagtgtcagttctgcctgccgcctgctgtgtgacctggcacccgtcactcaacctgtctgaactttggtttctcttctgaacagtgtggatcatagcagggcccgtctaggggtctgtaagtgtgaacgaggtatgagcggcactgggcacctgcctggcgcatgtgtggtgcatgctctgttggcgggggctgttattctggtgctccctgccagccagtgtgcctgggcgtggcattccttacagcccctgggcttgcgctgagtttctttctgtaattgctcagtctggctggtctgagaagcaggttcaaatggcagctctctccactgtgtggactcaactttggcaagccatgtttctccatggagccttagtttcctcatcaacaaaacaagggtgatggtactttgcaggtgtcttgggagatgccgtttcacccgtggatgttggctgatgttgaagttggtccggccttgacccagccagtggccagtgcagtgagctgtccttgccgggcctccgatcttcagctccctggggcatgtgtcgggcagtggagcctctgcaggctggctgaaggccccaggcagtgggcatccatcctcggcttctgccaccaggagccagctggaccaacagacatcacccctggtgctggcactggtgctgccagtaccattcgctcggggcggagagaaagctgtgtgtgcctgagtgtgaagccacagggacggcttcctgctttagggaaaacaacctgtgaagctgtgccctcggctggaggcacagaggaggggccttgctcagggaaactggagaggggagtacagtgtctggccaaggctgacctccaaggccaggagtgggttctccctgggcttggcaacacctgtcagtctgggagccacaactgcctttgccacgtctaccctctgcttcagtggacagaacgagcctggtggacattagatgacccctgatcatgcctgtgcacgtgcacacacaggagcagaagaggcaggcaggacacacaccgttaccacctccagggttcagagcaaggagaggtgtaagatccagtatatgaatgcacttccatgcatggaccccagtacacatggacccttgcaagctcatgcccccaaacctgctccaagcagggtccttggacagagccctcctggtgtctgaggtcgtgcttcactggccgggccacgatgagccaccagtctccatgaagtgtggcatttgacaggaggcacaggaatgacttccccctaggtgaagtttccaaaaattcagaggcaagggcccaatgacagccttggtcagaaaggccacttggaacctcagagccagcccattacagcagccgatcccttccagcaggtgcctggattaaaaccaagcgctcatgtctccctagggtcacagcccacattagtgagagcctcatccatggccgggcagggtgcggcacagcagctggctttgcagaggcagccacggctcacgtagatgatgaagacgtttgctccagagcagtcctaaagaggccatgctgcgtaggacatagagcagcaatcttgggtccaacagccccagctgtgtcatttaccagctgtgttacctggggcagggatgaccctgggcaagtccctgcctcaggccccatgtctgtcacatggaggtgatcacgcctccattgtacaagtgagggttagcttcaatagctaaatagcctcatagctaaagcctcagaggtcccttcccatgtgccaggctctgtgctaaggagtttacagtgaccctaagaggaagatctgactgttagcccattttccagatgaagaaactgagacgcagcatggttagatgaaaccgggccaggacctggactcctgcagtccagctccccgccagcctcactgaaccctgaggcttctcccaatctggtccctcggtgcctggggacacacagcacacggcagcctaaagccaggaacctgagctgggaagcctcactgtgcagctatccacagtgttttgcaaatgtagggcccttgcttgaggcagaagaaaagccctctttgaggtggtgttcagtgtggcctgcagctctgggtcttgcattccatggatttttggcccctgacttgggcttggcagctactacctcattgttctgcaacttggcaggagccgcgggatcccggggacgggcagtcctcagtgttaccccgaggtgcctgcacgcatgtgctaagggtcttttccctgctccgtgtggctcgtctttccacgtcccctttgccttggcctttctgcatctgaaccccctaagaagcagtttctgacaggaatttccagagcacagggcttgggtttctgttggggtgtggaccaatagaacaaaatgccctaaaatccaatacccatggagagccccaagaggcagtagattccttggaacaaagagggagtttagagtcactgagatctggatttgaatcctttctctgcagcttatcagcctaatggcatcgagcctcttcctctgagcctcggtttccccatctataaaatgggtctaccaatagccccgagggtgaatgggaaagacctggcccacaggaaccctcatcccttcctttctcccttcctccttccccctcgcgcctccccacctccttcccctcagcagggaccctctctggctctcggtgggtaggggcttgcagagtcctccgtggctgctgctttcctagaacagggaacatcaacacctgccggctcctccctggaggctaacggtgccgcaggttccattaggttctgaacagagcagctcgtaatgactggggtttggcagcaaaggcaccactggggtagacagtggtgctgcatcagcttgctgtggtcagtggggcagagtctccgggggctcctgcccctggggaccctgtggaggaaatgggcccttgtggtccgccagccctgagatcacccctgtgcatcagcagcacaggccccattctcaagtggagagagggcccattcggggtggagccagctggagagatgatggtgttgctgtgtaagaacctgtggggagtgcagtaccgtagttttggacaaatatgcagttgttggttcaaatcctggctccttttgtctgtgatccttgggacccgggcaaatctcttaacctcttcgtgcctcagttttctcatctgtgaaatgggaccataatagaccttacctcatggagttgttgacaaaatgagatgggctaatagaggtgaagagcgtagggcagggcccagcatgatcagggccctgcaattattagctcttattcccggtcccccttgcactgctcctggagccctgcccatgtgaggccacaggtgagctcctgagagtgtgcagaccatggcatctggctgcagctgttggagaatgcggtcagcgccacgtggggagggcaggaatgacattcccaagcacccgctaggctcctccccagtgggatttgcccaaggtctcagctggtgagtgacagggtctagattccactgccacagtttccagtacatgggaggccccagggcaggtgggcgggtaagccgatgtgtgcatgggtctcgcaggggtgacctgtgggccaaggctggtgccttctgagataaagatggaaccttctcactgaagacagttctccactctttccctggaggtctccctaagggcagaggacagtgagcatgtcaccctgaggggtctaggggtgcagctggaagcagctgcagagcctgcaggaggctcagttttatcttcaaattcatgcgcattttacattctgctctctctcatattccccctaacaaagatgcctggggaaggtgctcgtgtttatctgtttatcctggggctctttataccctgggtcttcccctgtgtcaccttgggatgtcacctgcgctccagtgcaagaactcggcacaaatggtggagacaccgagggtgccattttcccatctgcatttgagggcttggcagggagagcactgagcgctgggagacccaggtggggagatgaggcctgtgctgaggcagaggcaggggtggggagggaagaggcaggtgcacccataatgcccctccgtgtgacactgatctgacagtgctctgtgtgcacagactaaaaagacaacaagagacctactgactgatctgtccacactaggatgaaccacatcaaatggccaagtctgtgggtcaaagttggttgagtttctgcagcttcccaagcaggagactgcatgagccaggcttggcaggacttgcagccagcgagggcccccctgaccctgagttgggcgtgttctgcagtccataccatccacttccctgcagtctcacatcctgtcatctattttgagagagcaggtttaccccagaacagtctgtggaaggtgtggggcagggaggagagctgggccgccctgaggacacagagggagaagggtgctgggagccagcctgcaagttctggggagcctcagggtgcctttgagggcacaacttgggaggccaagctcagcgggtgagttagggtttggtggacatcctttgacatgtcaaagggtgtcacagatatccctggagcctgagaggtctggtcggcccaccactgtggctggaaacagactacagtggggaggaaggaagagtgacttgcaccctgagacacagtggccggacctctaggagctggctgtgacagcccggagggtgttgatgcctttcccacctcctggaacacccccgtgttaatgggggcgtgggtctacctgggagggagtggcagggctgctggcccagcagaccgggggaagactcttggtttggaatttgactggggcataggtgaccaggtgagacagcaggaggcggggtctgtctggagagagatgacgtctttggctgggtcctccagaagccaaacttgagatggggatatgtaggcatgggatttatgaagtgcccctgggagaaccactcagggaggagggagggcaaggccaggaatgggcaggagacggaccagaggttccttctcagacaaaacccgctgaccgcgccgggggctctaggatacgagtcacatcttggagggccccgacctgagacgggactggctttcattctcgccccctcagctgttgaataagggccaccgcaggggagggggctccattcctcaggacttctggctctccaggggtacagctgagctgctccaggagcctaggccaggcctcaaggggttctgcctaggatgtggtcacatgagaggtgcccctcgggacatccagggcttgtctgggagaaggagcagcagccagaaacaggggccccatcacatgtgtgatctagtcccttccatgcacaccatgtgggagccctggcacacaggaggtgctgcagaaatgcttgtggggtgagcgcaggtctctccttctggggaggaggagggcttttcccctggcatcaggaagcatcccggtggctgggtcacacaggttctatgcacataacctcagaccctgccccagaagcacttgtttgatgggggaggccagaggctaaaatattgggggagatgcccagatggccttgagctcaggactgggcacacagtgggtgcttaaccagggacctgtggctgctgtgactacctatgaccagcatctctgactctcccagggcagcccaagccctggaggctgaggggggctgttcctttgcacagaggtctaagtaggacggcaaacaggacctcttggccctggccttccctgtgtcacacgtgtggtgcgccagggcccagccaggacaaggacgtaggttccttcccacagcagctgtctgcagcctgacccaggcctttctcttctgagcacccaggctgccagcatgggtataggtgggggtgacaatgggggataggggtacagaactgctccccaagaagcaggggcagtgctgtggaaagaacaagtctttggactccagcaaatgtggggttgaatccggtgtcttccttcctggccttgggggctgctgatggacgtttccctgcctggagcctcttccagtggggataatcctagtgacttaggacagtctaacagaaggagactgtgtcacccgggggtgtcaagttgtagccctgccacttcggagctgggtgaccgtgggcaaattactgaacggctttgcacctcagctcacgcatctgtaaaatggggtgagcgaaagtccctcctccttctgagggtctcaaagagaaagtgaacaggccgctgttttctgttgcagttcgtgccctcgtgaggctggcatgcaggatggcaggacagcccggccacatgccccatggagggagttccaacaacctctgccacaccctggggcctgtgcatcctcctgacccacaggtaagccccttacctttgtctgcagcacactgaagagttcccaaggaatacggatccctgagcctcctttgtccaaactcctactggtggaaacccttcagctccctgaaacagaacctcttgaatgcttccagtgatggggagctcgctaccaaatctagtgagctcatcgttgaattcagtaatactcagagaagcctcctctgccaagctctaggctgggaccctgcaccctgatcctgcccctggagtgttccaagtggatggaacagctttatctcagggatcagcatggttggaagggtacagagggtgctgtggaggccctgagaacagcgagggactcagaggaatgggctgactgtactgtgggtcagaaaattctttcttacagtgagccaacattgcctcccattttggtcttaactgtgtttcagcccccttcagcctcttctagaaccagcagagtttgggagaacactggcttcttaacgcctgcctctcgctctctctagataccttggagagccaggcagccttcagcagcttttctgaaggtgacttgtaggtttctgaactgccttgtgtaccccatgctgcccgggcctggcacgccctctctgacccctcttccaagtcagtgcaaatgctgctccctctggggagacctccacttccaccctgctctctgctctgggctgcccgcacacctgtgtccacacacctgggtgatgcccgtgatcacatctcactggggcactagttcctgggtctgcctcactttctagatggagagctcccctggagcagggctttgctggtgggacaatcccacaccgggcacagaggggccccgcgtgctcgctgagttaaggaactgtgcatgtgtgtgctgtgtacccacttgggacggggctgtgtggaaaacactcaggtctgctcttacggagcacacagcctcatgggagagaaagataaggagctgagcagaagaaccttgcgggcctagggagcccagcaaggcacctgatccggggccagagaggcttcctcatggaagtggcatgcaaaggcctggaggggacagagagcttgtctgggcaggttgagcagagccagatcctgtagggtcctgtggccagcttagaatgatgaaaagttctcttatatggtgttggctttttctccaaaggatgtgagacctaaattcaggggaggttcagagatagccaccctcctgagccatggagggcttgattacagcttctaactgcctaatccctcttggaagacttcagattggctgatgtttgacctcaatggcaaggttgccatgtacagttgtacaggttatgcactgcacaaagcttctgggctaaggaggcaggtaggtctgaaatccttctcctgtgcttgcattatcaccaagccatgctccctggtggacagctgcatcagcccaaggagggcggtgatgctgcagattgacacagaggcgacacgttgagcttagtggacactatgtttgtgtgtgtatctggtgggggtgtgtgtatatgcatacacacaagcatgcagagggtccatggggcatctatgctatttgtactcatgcaggggcccatttcctaggtagaatttggggaggcagatcccagaaagctgggaagccccaggacactgtgggtccagagtctaccaggacatggtgctgatggctgggggcagcagggcctcctcgggtaatgtagcaatttgtcatattaagtcattcactaacaattgaatcccccttgattaatctcccagaattagccagttgcattttgagcaattagggttaattacaacctcatttggcagaggagagggccctgtaattatttcatgagcaaggtgaagaggcggtgggctgcagtggcagcgttcacgacgtctcatcgcacatgttggagagggtaatgacatagttaagtgtaattagttacgattactcggagctgggctgctctgggcagcggctgtcgggcaacgatgcccccagtcccaccagcatctggctgggtttgcagaatgggggcgcaaggccacccatgtgccgtgccggctccaggttgggatgggaaagggggactttctcctcggctcctgaagccttggggatttaaacactgtctggggagacatcccagccgtgtctcgcctgtttcaggacatagaagcacctggaattaatgggccaggcattttccttgatagcaggaggcaccgctgcttccctgaaaccatcctcagaggaaggagccaggctaagaatgctttgatgtgggccaggctgtttccgcacccagctctccgtctctcattagccgggtgagactaggaaagcaacctctctgagcctcagtttcctcatctataaaatgggataataatgccgcttccctcatgaggcggctgtgaagactaagtgagatagttactgtaaacatccaacacagcacctcacatcgtgggtactgaggaaatggtatgtcatggatcttatattttaaaaaccatttctgttttcatagctaaaggcctccgagctggataatacccccagtgtagaaagaaagaaactacaaccacctgaactgtggtttttgttaacctgctatgcccaaggctagtggcttgttcatttcaggaagctttctagccttgagagccagcagcacatgaaaaaatatttgctgaaaccggcagaaccatatatgaaattcatatatacttaggaaagctgaacatacttgcttttatagaggtttctaatgaatgaatgaatggaattgaggaaagaagcttaaaatgcctcatgctttttaaattttaccaatgtgctgcagagagctttcattgggaatgaagtgtaagcctcacctgacacactaagaaccacgtgaatttccaagaaggggaaaggtattcttgcctgagaaagccccggctaatgtgtcttccatctggaaagtctttgcaaagccagttgggatgtgccaagttcagttatatttgggtgctcttccgagagaacttcgcaggggattgggtcagctctttctaggtgtgcattgcacaggccaaaatctttatcagaatcttcccaaagcagtgatgctagttggttaaggtttaatgaccaaatatcaatggctattaaaattcagttagtgggccgggcacggtggctcacacctgtaatcccagcacttcgggaggccaaggtggatggatcacctgagtctggagttcaagaccaacctgggcaacatggtgaaaccctgtctctactaaaaatataaaaattagctgggcgtggtggtgttcacctgtaatctcagctacttgggaggccaaggcatgagaatcgcttcaacctgggaggcagcggttgcagtgagccgagattgcaccattgcactccagcctgggcaacagagtgagaccccatctcaaaaaaaaaaaaaaaagaaaaagaaaagaaattcagtgtctgctaactgctgtcaattcagcaactgtttttttggggtttttttcctgccatgggaagtgcccagtgcctgcctttgggggctcccagtctgctgagaagctctgcatgttgcagagaggtggaagctccccgggagggatggacagatgctgggagagcccagagaatggggaggccagttctgctagatagatgatcaggaatttggggtgggacagggagaggccccagacctgaaggtgcatggccaatcaggttagagaagttgttgaaatacctatgcttagagaaggtaaaagaatgtatggtgtttatgaaggtctcaaatccatactatctcatttgaaattgaatctgtagcaaatgaggagcccattatgggttttcaggtggcaagggggtacttgggttgggttctagatagatcactggtggctcgtgctcaaggctcagggaaggtgaaaatagggaggtgaggaggccccttcttcaccaggtgagatgatgcctcatggggctacagcactgggggctggacatggggagagagggttccagagacttccaggggaaagcagcctcacttggtagtggaagggatgagggagaggggttgtcaggagtggcagctggaactctttgtggtttcgccctttatgtctctgcttgtgagtcgtcggagctggttccatatcatctttcgtatgtgtaagcttagctttttccagactctgttaatgagaattgtcctgggggaaccataatgatttagatcgttttgggttttgttattaggagtcttccatgcgatgggcattggctcactgatcccatgagccagtggcccacggagtgcggtgcagacgtcttagctgagccagtaatggtggtgtttgtaccaacagcccagtgcctgggactcatctcacttagtactcctgctgactcagaggagttgcttactcaatgctctattttgcagggaaggaagctgatgtcataatctgccatcgcaccgtcaaggggcagagttgggattgggtccaggcccatgggaccccacagtgccgctttgggcagctagatctttgaaagggaagatgggctttgggtctgaagttaggcagatcgtgaggagctgagctgggctggcctcagaagaagtctgacaatgtgaactctttgtaaattgtgcccttttgtgcaacacagatttaaaatatatcgctatatacacatctaccaaatccattagagtttccctacccacagtgtcagatgtctttaaaggtgaaattcgtttataagaaatgtcatcctgatgaagtgtgctttttaaaatcatagaaacggttgccttaaaattaatgatgcattgcaaatatcagggaaaaaagacccatccagtgtaaagatgattaaaattcaggtcagaagtctgacttagtcaggctaaattttttaatgagatttcagaaaattaattgggcgaatgcatttttattcttttagcatgtaattttatgctcctgtttaaaaaaaaaaagattcgtctatggctgaggctgattgtggttcaaacattttaaactcaaattagcgcagggtggggggtgtttgtggcctaatttgatctgacttggagaagacagcgtgggtttctcagagctttctgggtggggggtagctatagtggtctgagacatcctccctgccccccagtctcccagtcatgccctgcctcttcctgagaatgccagcgacatttcttgggaggtgggattgggatggcggtggctcggggaccttggccatctcattggctcctgctcaccagtttcctgctgctccccagggcccttgttccagcggttcctctaccctcctcctctcaaatcccatgtgcctgccccaggcagcccaggccttctccctcgtgcccacggtgacaggcagcacagcgagtggtgacaccgcagggtcagcctccctgtcccccggcccctcgatcagtctcctctgcctttggggagagctgagggcctccgtgccctggcagaggagcctgaggagtcagaggtggcctcctatggtgttgccccacagcgcagccctggaagggaggctgagggcagctcttgcctagcatggtcccttgacaaatggtcctgggtgacaaagtcgcaaggttgtgtctcttacctgcccacaggtgcacgtcgtcagccccaccgcctcactgcagcccccaaggttaccgccagccgccgaggggtgggaacggcagggtgatgatatcaacagccaagaaccccctgggcttgtccactgctcaggccgtcccagtccccggggaagcaggtccaccactaggcccattcgacagatagcagcacaatcaccgtcaccacgactggagaatgacatgtcccagcacctagtgccaggccctcttccaagggcttgcatttgcttatccatttaacccccagcagccccctgaagggggtactgttatgatctcctcagtttccaaagaggaaactgaggcccagaagccttgcccaaggcccacagctgggaagtggcagaattgaggtttgagccccagcctccaggccccagcattggagtctcaacatcagagccagagcagtggttacccctctgccaacttgtgccctggggtggggttgggggtgttattttccccaggagccacaacagggtttcacacaaagcagggacagtgagcaacagaaaccagttttctgggctgggtgaggtagctcacacctgtaatcccagcactttgggaggccgaggcaggtggatcacctgaggtcaggtgttcaagaccagcctggccaacatggtgaaaccccatctctactaaaaatacaaaaaatttagcccagtgtggtggcgggcacctgctactccccagctacttgggaggctgaggcaggagaatcgcttgaacccgggaggcggagattgcaatgagccgagatcgcgccacagcgctccagcctgggtgacaagagcaaaactctatctcaaaaaaaaaaaaaaaaaaaccagttttctgaaaggccatcggggtggtcggtcattagtcagcagtgatcacatttggggccaccctgggcgcactgttctggggccagccccacgcccgtcttgcagtttagagccacaccagacactaatcaccaacatcatctcccagagtcctcagagaaatcctggagccagtgttactgtgcctgtgtgtggacgaccagcccagggtcacttggctgcaggggcaaaagtggaacttgcggggagctgacccaggagcgggggaggtcttggaggtggcgacggagcagccaggccttccaggccaaggacacagttcaccctttcccttctgctgagagcccccaggtgcaccagggccaggactctgctggcccaggcagctgcccccaggagcctggtgtctcaaggtgccccacacctgagcagaggccaccctggggacagcgtcctgtggcagccctgggagtgcagtggtgccccagagcctgctggaccatgtccccagcacacgtgctccatctaggaagctgccccaccagaggagctggcctctaattgggtcggatggactgtgacaagaaatgcaaatctgggtcatccatatgcgtgtgagcagctggagccccagccacctccacccacatccaccaggagcttcggccccactgtggagctgcacggtgtagcctcccaggacgggcagtgttgggaaccccggccagactcccactagtcacagtaagaagcctggtcttccagggcaaagaccctcagggaccacttcctccaaacccttcactgtgcctgggggaaactgaggcccaagaggggagggagcccacccccatcaccagcagtgcagctggctctagatctgacagggagttctagcctgtttcctgatttgcgagatgggattcataacccttgcttcatgaagctattaggagtttggagacatagagctgtctaagcagctggaaactagcacatagtaggcgtctaacgtacaacacctcatggttatttttatgagtacgtgcgattcttctaagtgctcagaaagccgccctggctgtttatgagggtatgtgattttggctgcattcctagaggtgacggcgtctgagtcacagagtcccactgtgcgccaggtcgtgtcaggcacattccatgtgtcattccacaaacatgctccaagcagttgctctggggtcagagcctcagtgcagaggacgtggaggggactagacaggggcccccttttgaagaggccggtggcgggtcctggggcggggcctggggcagggctcaggtgactgaaagaatggaggctggagcaggaagtggcaggcctggccggtcagggggtcttgagtgaaaagccgaggagggatctgagctgagagcccacccgatacggagcaagagcttgggcaccacagtccccagtcctggggtcacaccccagctctgctgttctttgctgcctgatcagaacaggtcactgctacccctccaagcctcagattcctgaaatggggacagcagtgaggcccactcacagggttgttctgaggacccaaagagtgggcgcgtgggcggtgtctgcacagagcccagcatgcagtagacactcaggatgcctgctcttcttaggtgggtgctctgtgtacaggtgtatttacccgacagacattggcacatggtggataaaatcatcatcttcctcctccagcagccctccagatcgggtcctctggcaggacccaccatgagaggtaattaggcctcgaggcttcaaagtcaaggttggcccagccctcaccttgctgtgtgctgtgaggcctggactcccatcactcactcccgcaggagggtgttctgtagagttccctcagccaaatctggaagagacattttcttttttttgagatggagtctcaccgtcacccaggctggagtgcagtagcacgatctaggccaactgcaacctccgcctcccaggttcaagcaattctcctgcctcggcctcccaaatggctgggatttacaggcacccaccaccacacccggctaatttttgtgtttttacaaaaattttttggccaggctggtctcaaactcctgaccttaagtgatcgcccgcctcggcctcccacagtgctgggattacaggcgtgagccactgcgcctggcctagaagagacattttcactttacttttttccctgcttttccagtgagtttctattattcattaagtcatgattcagggtcccagagtagggatcaccacataaccaggttcccctcaggcactctgggagaaggacagaggagaagttgatggacccagcttagacctgcccaggagacgtgcccctgctccgcaggcatctcaggctgagacgcagctggtccggccagcagttcctggtgtttccaggtggggaagcagctgtcagaagggccagtcctgtagttctcggtttggtcttgatgccttccgccagggtgctggctcctaaagacgcctcggtacggtgcccggctcagtgtgaccctcaccaaagacccacttcatgctagaaagttgaactgcttgttctggcttcactaggggcggtggcatggagctgggtgatgtgggcatggctggcccctctgggcctcagtttcctcatcaggcaaatggagacacagccgggcccatctcaccatagggcaggccagagatgtggcatcctctccccttgtctgtctcctccttccctggcccactgttggcgccccctcctgccttttcctgagagctcactgcacaggtgtcctggggtcctcctggccactgtggtctcacctggaggctccatccctgggcaggtcctagcgcaggatcatgtgttccaatgctggcccctgcagagtctttgtggagctctggtttcttcacgacaccctaaaaaaggcagtttatctaaaggatgggctcagggtgtaaggctgcacatttttttgagagggggacagagtctccatcacccaggctggagtgcagtggcatgatctctgctcactgcaacctctgcctcctgggttcaagcgattctcatgcctcagcctcctgagtagctggaattataggcatgggccaccacacccagctaatttttatatttttagtggagacagggtttcgccatgttggccaggctggtctcgaactcctgacctctcgaactcccgcctcagctcccaaaatgctgggattacaggcgtgagccaccacacctggccaaggctatgaatattaaccttggttttcttgtctgagatggggaacggctgccccaggaagggaacttgccatttcttatgatgacctggggcattttgcatggtggccacgggctggggatacatgagctgcacccggcttaccggaccccagtttgggcatcaaggattcaggagaggatgagacgggcaacgcccgtggtcccacggagctagcccccagggatgggactcagagacagcaaacaaacaagcagtcagacaatgaaggtggtgatgagggcagtggggagcatgaacagcctcagtttttcacctgcactgggggtccttgaggggacccaggggaccctgtgcagaaagccccctgggggggtgcctgggaggctcccagagcagggttggcagcagagtccctccttcaccttagagggtgctgttggggtgctgggcctctaggggtcgtccccaggcctctgctgcagcctggctgctcacggaggccctctgtcccccgttccagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcaggtgagctgacaacccgtggggtcaaacctgcatctcgggaggtggtctctgcatctggacggggtgcccgggccagtcccttctctcccctcttctgtgaacgagggaaacagcactcaactcactgggttacagagagaaccaggtggactcctattgatgaaagttcactgtgaactgcaaaggaaaagaaaaacgagcatgcattgagcgcctgctgtgtactgggtcatgcaaggagcacatggagcctctcaacagtcccgtgggtggggattgtcatttcatctctcagatgaggaaaatctcataaccgccagggccccagcatgagtcttgggggagctgaggttcataccatgtccacccatccttgcgcctgcggttgctccacagttctgggcttcctgccttctgcgtccctcctaaatggaggaagtaggtcaagcggcaaagtcaggacaggagccatgtccatgagagccgctgggcccgtctgaacacagctttgccggaggaaatggctttaaatcctccagcaaagcttcccaagccccttgatttgcttacttgtccttaaagaacaagattgagagcctgggcagaggagggccgggagagagaatggcgttggggaaatggggagagaacacccgcagcttcagggcgctggaggagtagcagggtcctctctgtccaaaaaaggaccagtttctctcttgatcttgttttttttttgagatagagtctcagtctatcacccaggctgtagtgcagtggcgtgatcagctcactgcaacctctgcctcccgggttcaagcgattctcctgcctaggtctcttgagtagctgggactacaggcgtgcaccaccacacccagctaatttttatatttttagtagagacggggtttcaccatgttggccaggctggtctcgaactcctgacctcaagtgatccacccacctcagcctcgctgggattacaggtgtgagccactgtgcctggcccgccctctccatcttctggggaggggctcacctgggctctctgtcttggttctttagtgccacgatgggttttgtggtgggacagtgctggggggacccacagtgagcaagccctacaggggctgggagtgcaggggggggtcacagagtcccttggtgaggaggtgggagagccgggactggaaagcagaccccgtggcctcctttgggtcactggacacagattgtaaccactctatttctctttttcctcccgcccaagatctttgagatgatggacgccaaggcgaggcaggactgtgtcaaggagatcggcctcttgaaggtgagcaccctgggccgagcgggagctttgcctcctcggggaggttctggggccgcggctgggccacatcatgtccatcacagcccttgggtgccaggaatccgcagcccctgctaagttaacagacgatagctttctaggggcagcggctagtgagttttctcctggccaggcaggagcggcccgcctcatcgctctgcccagcccttggggtcgctgcctacagcctttcctccttgctgcacgcccctcctgcttgtacatggcagtacccggcatagaagtccttccccacagggcagccctgaccctgcctcgcagtggcctatggaccaggcttggctaggggaggagttcattgtggggaccacatccagactgcagcctgtctggctctgcctctgtctctatgtctgtctccctgtttttctctttctcatcctctttccatctctcctctcagcctttttctttggttttgttggtagtggtggtggtggtggtggtggtgggttttttttttattttagaggcaaactctgttgcctggactgtagtgcagtggcatgatcatagctcactgcagcctcaaactcctgggctcaagcaatcctcccgcctcagtctcccgagtagctgggaccacaggcgcatgccaccacacctgatttttattttttatttcttttgtttttttttgagacagagttttgctcttgttgcccaggctggagtgcagtggcacaatctctgctcactgcaatccccaccttctcggttcaagcagttctcctgtctcagtctcctgggattacaggcacccaccaccacacccagctaattttcatatttttagtagagacagcgtttcaccatgttgaccagcctggtctcaacctcctgacctcaggtgatccatccacctcagcctcccaaagtgctgggattacaggcgggagccaccgcacccggccccccatgaaacatactggatttgctcggcagtttccagcaaagtgggactgctggtggcagggctgcccgccgaagccacagctgcagaatttcagattagcagttttttctgccacacgctgccctgtgttctcaggccttggccctgctcttggggacttccaggctggtggggaagcaggtaggaagcagatggtgaccttccagggtgatgcagattgactggtgggccaggagccccagggaaacccgcttcctgggcaggcctcacagagggcagggcaccatcccagaatctggaaggccgaagtgagccttcttccaggcaccgcagcaccgtggattatgggaggttggggagacagaaggctggacatggcagcagagccagatacacactcagaacaaaaggggagcccctgaagtggctgcaagtcggggggccatggctgggtgtgagttgtgagtgcctgctctggtggcccccggccacagtgggtgagggagtcaaggctggaggcaggaggtgtccttaccactaactattataggtcaaaaaatatccctcgaaaacattgtttaaatgtttaagtaatggtcagcttgctgccacttacccagccctgaggaatgtttgtcctgatcacccattgccccctccccacctcatgtgcccttctccccgagtgaaggaacccacaggtgagcatgctgagcacagcctggtctggtccctggtcacacagatgtgccaccgcagcccctgccttgcaggagcctgagcctggcgtaaacccacatggctgcagaggggatttggtcccttctccagggctgccatgcagccaagggcaccaagccggggtttcagaggacacacccctcgctcactagctgtgtggctgcaggccagccatgggcctctcaggacctcagtttcctcatctgtaaagggggcatgatgacaacagggacgctggaggagtcagtgaggaagcatgtctgacgagctcagggcagcgctggtgtgtggtacgctcgccgcccaaggcagcccagttgtcatggttgccacctctgcccgccaatgccagccgccttcccgaacacgggtcccactccacaggtagcccatgggaagtcaacaggatgtgccagggcacgaggtgcttcctacaaaacaaaaggaaacgtggttttcggaggggtgactgttgacatatcacatcattcatgcaaagaacccaaacccaaaacctctcaagtgcgggggctggtggggtcggcagctgccaagcgtgggacaagaaggtgggtcctgttggaacgcaggcgtgtgttcattcattctgtgcaatttctgatcaccactgaatgctggacaccagggtgcagcccagtggagaagacagatcatagacactctgtgttacatccgggagggcctggagcttgggagcagagcccctgatggcagagattcaaaggacagggacccttactctcagctctccctcccttccctctggccaccaccacagccagacaaagcccaaccacattgcgtctttgcagcaccttccctgtccctgacccaagtgtgtccccttccagacccacctgggcccaccaagaggccacaggctgtgaagtggactccatgtggaccaggttctagactcagctcggcccctgcttgctgtggacccgtggctgatcccttcccctctctggaccttggcgatttagcccaatggacgtctggagcccctttctgcctgtgcctgtgtagactgcctgggcatttaagggagcccttccttaaccccctgccctcagacgtgcagggaaatgggggaggagtctccctcctcccctccccaggaaccagcgcctccttgatggggctttacttcctacccaacccctctcatttctcccttgttggagaaactgtgtcatgcctggactgctgatgacctgggcagtttttggggagtcctccctgagaggttgtgagatttcctggtgacataatgaggtgaagttcaagaggagggtgaaggagcagggtgttcccatttatcctcatagcagcttgcccacgccgtaggtcatgtctcagagatttgaaggcactttcaacttgccattcacttgctttgacactttttttggtaactgaaaaacatgtctatggagcatgatgtgtgctgagggcagcgatgtgatggccagtgttcgcgcaggacgtccttttcaacacaaaatctgggcaagaggattttcttttctttctttccttttttgataacagggtctcgctctgtcacccaggctggagtgccgtggtgcgatctcggctcactacaacctccgagtagctggaataacaggtgtgcaccaccacacccggctaatttttgtgtttttgtagagacggggtttcaccatgttggccaggctggtcttgaacgcctgacctcaggtgatccacccgcctcggcctcccaaagtgctggcattacagacatgagccaccacgtctggcccaccttcttttttaaatttccatttttattttagattcagagggtacacatgcaggtttgttacaagagtatattgtgtgatgctgagatttgggcttctgatcccgtcacgcagatagtgaacatcatacccaatgggaagtttttcagcccttgccccactcccgccccctcttgtagagcccagtgtgtctactgtttccatctttatgtttgtgtgtacccaggatttagctcccacttataaaagtgagaacatgcagtatagatatgtttctgtgttatttctcttaggataatggcctcctgctgcatccgtgttgctgcaaaggacatgacttttattctttgttgtggctgcataatattctattgtatacatgtaccacattttctttatccggcccaccatttctgcgcacctagattgattcggtgtctttgcttttatgaatagcgccgtgatggacatacaaacccatgtgtctttttggtagaaccatttatattcctttgggtatatacccagtaatgggattgctgggtcaaatggtagttctatttttagttctttgagaaatttccagactttgttccacggtgtctgaacaaatttacattcctaccaaaagcatagaagtgttcccttttcttcgcagcctcaccaacatctgttattttttgacttcgtaataattgccattctgactggtgtgaaatggtatctcattgtaattttttttttttgagactgggtcacaccctatcatctaagctggagtgcagtggtgtgatcatggctcactgcagcatcagcctcccagaatcaagtgatcttcccaccttaacctcccaagtagcttgggctacaggcctgcaccacgaagcccagctaatttttttttgtagtgacaaggtctcactctgttgcccaggctgttctcaaactcctgggctcaagcagccctcccacttcagcctcatgaagtgctggcattataggcatgagcccctgcacccagcctattgtggttttgatttacatttctctgatgattagtgatgttgggcatttttttcctgtttgttagttgcttgtatgtcttcttttgaagaatcactgttcatgtcctcttcctactctttattttatttttatttatttattttttattttgagacagagtcttgctcagccacccaggctggagtgcagtggcatgatcttggctcactgcaaccaccgtctcccgggttcaagcgattctcccatctcagcctcctgagtagctgggattacaggcacccaccatcatgctcggctaattgttgtattttagtagagacggagtttcaccatgttggccaggctggtcttgaactcctgacttcaggtgatccacccaccttggcctcccaaagtgctaggattacaggcgtgagccactgcgcccagcctatttacttattttttatttttatttttattatttttagaatctcactctgtcacccaaactggagtgcagtggcacaatctcagctcactgcaacctccgcctcccaggttcaagcgattctcctgccccaacctctcgagtagctgtgactacaggcacctgccaccatgcctggctaattttcgtatttttagtagaaatggggttttgccatgttggccaggctggtctcgaactcctgatctcaatgatccgcccacctcagcctcccaaagtgctgggattacaggcgtgagccaccatgtccagcctcctctgctcactttttaatgttttgtttttttttattgatttaagttccttatagattctggacattagtcctttgtcagatgcatagtttatgaatgttttctcccattctgtcaattgtctgtttactctgttgatcatttcatttgccatgcagaagctctttcatttaattatgtcccacttgtcagtttttggttttgttgcaatggtttttaaggacttggtcttaaattctttgtcaaggctaacgctgagaaaggtatttcctaggttttcttctaggatttttatagtttgaggtcttacatttaagtcttcaatcaatcttgatttaatttttacacatggtgaaaagtaggggttccgtttcattcttctgcatatagctagccagttaattgagtagggagtcctttccccattgcttatttttgtcaactttgttgaagatcaggtggttgtaggtatgctgctttatttctgagttctatattctgttccattggtctatgtatctatttttgtaccagtaccatgctgttttggttaccataggcttgtagtatagtttgaagtccagtaacgtgatgcctccaggtttgttctttttgcttaggattgctttgtgtgccgccttctgaagtctagtcaccctgtgtaaattaactacatttgttactgaccaaggttcttccacaggggagcctgctgctaagatggcaacagggctccctcccagccacccctgggaaccaggattgaatgtgctgcacctgcgtcctcagctgtgcagggtgcctggttcctcacagtggtgtctggatattcactgagccacagcgctgctggctgaggggcaggcaggggccagcacacccacctcagggccagaccttggtccagagcaggggtttgaggacttggacaggcagtgggcgccatagcagacagggatcagtctctggggggacctggtgagaggatggacgcatggggaggagctggggccagtggctgagcctgctctggcccccagggcccacacatggggggctggcttggggaatgaatgaatgaatgaataggggcttgcatggctctgtaacatctgcccaggctcccctcattttagaatccacggatgggcacagtgcatccttctcccaacgacttccgggccttttgggaaatgtgctcactatcggcctctggtggttggctggtgtctggactaggctgaccacacccacaccagggcaggatattcgagtcccctctgctttcccagatcctggagtctctttgatataaacagtcagctttgttatgaacagatgccaggggctcctcttagcctggagggcctgacttccagccaggggggcaccgttctgtccagctccatgctccactgcagcaaacatgcaggcggtggtgcgaaggacagaggcagcgtctcagcatgagcaaatcagccgggcagctctcatgcctccagggatttttttcaacatttcacaagggccaggcatggtggcatgcagccgtagtcccaactgctcaggagggtgaggtgggaggatcgcttgaacctagaagttcagtttcaatcagggcaacatagtgagatcctatctctacaaaaaaatattttaaaaaaaatgattttacaagagataggtcaggaattgagaaagagtgggaaggatgaaggcaggagatggtccttctgaggagcacctgcaggctggccgtgtctgggcacagggacagagaggtggggcccaatgccgccctcagggtcggggtggtgaggaggagggggagggtcctttccacaagtccatgctgagtctcacatagctctgtgcggctgccctgttacacatttcaagagtattgacccatgtcgtcttcacaactatgcttcaaaacattatgccagttttacagatgaggaatctgagacttggggatgcaaagtggctttcccagtgtcacccaggccttcctgactccccagcacaggcctttctttccctgggacccacttctctagcaaatgccagggcctcagtgaccgggtgccagcagggtgccggtggcaggcaggcactgggtctgtcccgtcttcacttggtgcccccttccctctttccctcctcatgcagcaactgaaccacccaaatatcatcaagtatttggactcgtttatcgaagacaacgagctgaacattgtgctggagttggctgacgcaggggacctctcgcagatgatcaaggtgagcgcctggcggggtgggggtgctgggggctgcgcagatctggagccaaaggtggcagtcttcctttagcccagtcccacaatgctctgcctttagccagaggcggccacccggggaccctgggcgcccccctgcagatgcccacaggcctcagctgcagtctggtgagggcctctcagggtccgtccccagctgctgttgctggaggcctctttctttccactggcctcagggaagctcagctcaaaagagcccatatgcaaaagcaaggcgaaggtggtgccaagacaggatggtggctgggagggggccagccatgggcagaaggaactcctctggccacccccagtgccccagcctaccacaggcacatgagccacttctcctgcctcacagaaggagcaggggcagcaccccgtttggtcagaccccagctcttgggaaagcatcttgtagatccactacctcattttaaagaaggggaaaactgagcccagagaggttaagagacttgcctgaggatacccagcattgtgggtacagagccatgcctgtggcccaggtctcttttcctggcctgggaccctttggtggacatggtcccaagatgctctccccagccctagagggggaacttcatttccatgttagggctgacacccaggcctggggtcttcaagagattgagtgactgttcgagtcacatgggcaggctcagcgccaggactggctcatgctccacgcccctacatacatcttcacctgcctcatcccaccacccagggcacagggcggagttcaccatgagtctggtgtccaggaccactgcagcttcagtgaaacagcagcacctcctgccagcctccacccagcccagtacgctcatgcgtccctcactgagtccccgccgtcctcaaatagcaaagctcagagaggtctagtctcctgcccaaggcacctcagcctctaggtggaagcccccaggcctgcctgacccccaggcccaaaccttcagcccctactccactgctccttagtggaggtcctcacgtccctactggcttggacctctgtccccagggccctgctgtggccccatcacctctctaccctggatgcagcctgcctgctcccaagtgaggctgggccccgctggagcccccaccctgctcacagccgcacttagaaacggggccggatgtgggttctctgtctttcccatcaggcactggggattgagcaattgctcagtgctcttctgaaatttgggtcctaggaatacaggcgtcactgggaagtggcattacttgagctgttatcacctgctcttacatttccgttgacatattaatgcctttgcagggatgttaatctgcacacagatccctggtgggaacagatgtgctagatcatgtcttagctcttcctctcccccgcccccgctttacttgtttctccttcacacggattcccttgctgaacatacaagcatcgtgtatccactgtgtgccagccctcatgccaagaactagggttgccgccagcatggctcctgccctcagggatcccagattctaacaggaaaacagaccctcgaatgagtagttaggagccagtgtgaacaagccatgtgcagggcctgtgggagtcagagaaggcttcctggaggaggtgacactgagctgagctgttaggggaggtgggctgtccagaagcagaaacggtcccacagggatgggaaagggaagggagctgagatggagaccaccggatcacgtagggcctgttgctccaggctcggggtccaggaccaggccctaaggtcagagaagcttcctaagattcatggcggtgaacaaacgtggtcagctctgtgttctagaagaaagactggaggccgggtggaaggagaggtgagggcagggacggaggaggagcaggagatgaaggagaggcctctccctgctgccacacgggaacgcagcccgtggagaggacgcctcaccctctcagccccagtggagcccagacactgtggcctctcagtccacggagtggggctgccgtcagacaggcagatggggggctggggctgggcaaatccctcttccctgaacctcagtttccaccctgtccccgggaacctcttggagggagcattgcaggaaacccaggccaggtgcagtctccctcagctgagagagaagaggagacatgggggcattctatccagcatcccttctctatgccaggcctgggatggggtgtctccttccctgtgcaccccttccttggcttcaccagagccaacactggctcagggttcaagtcagtcatgaacccagcaggattgagtctaggatgggtgtggcctcagtttctgagcagccacctggccccccacgcctcgggtccttcctcctcacctggcatggttccccctcccacagtccccacctctctccccccactgtccctgcctgctcccgttccctccaacccggctcaggggccctcacctgcagagctggctcggtgcagccgccagcaggggaggcctggcagtgcagagacccactcgagtaagacacgtcccctggatggcctcaggcgggtccctgtgcctcagttgcctcatctgtaacataccagcacaatgcctggggtttggtgggagctcggttcccctggttctgcctgctctcaggccacctctgggtttccagaggaacaggggataccccatggtcgccccactggcctcagaggctgtcaggcagcagggattgtgtcccgagagcctgcagcctcaagggctgagctgcgccatcacagccatggtgcccgagttatttacgaggaagagtgaagctaggagctgccgtagccccagaacccaccagagactctgcgcctccccgctaaatgtcagacagcgcttataggacatgacatttagaaaatcaccactctcggccacgcgcgtccctgcttaaatgctgtaatgaggattcactcacatcacagcgtgaataacatcccggcctggcccgccacaggcctggaggtggcctgggggtggggtctgtgctgagacctgggacggctcacctgagagggcctcccagaattgtacctcagaacagcctcgaggggatttacggcgaggtcaggggctccccactgcgactgtcccaccgtgggaagcacccagacctgggtcccagctgggtgctgggtgaccttgggcatgttcctgaacctctgagctcagtctcccatatcaatggttactggtgttattagaagtgggctaagggggccaggcgtggtggctcacgcctgtaatcccagcactttgggaggccgaggcaggcagatcacctgaggtgaggagttcgagaccagcctggctaacgtggtgaaaccccatctctactaaaaatacaaaaaatagctgggcgtggtggcgcacacctgtaatcccagctactcgggagactgaggcaggagaattgcttgaacccaggaggtggaggttgcagtgagctgagatcacgccactgcactccagcctgggcgacagagggagactccatctcaaaaaaaaaaagaagtgggctaaggacttgggctttctaggtgggaggcctggggctgagctgtgtttctgcctctttctacgtggccctcagtttcgtttccctgtctgtaagatgggcctagccctccctcttaggcccggcatggtggccacaccctgcaggtggtctgaaagtgctggcccagctcctttcctccacccatgcccctttccaggccagtgtgtcctggtcagttcccagcttcccagcaccagagcagctgccctgaccagcaggcccacagcgccgcctctgcctgctttggggaaaggtggttgctttgaagcaaaaagcccctgcacaaaaagctggtatgcaggtagctggtgaagaagtcctgccccacaggcatgggcctggcacctgagagccacccccgtctctagctgagccgtggctgtcacatgctctgggcctgccctctccaggaccttctgttacttacagctcactcagtgtggccggggacctttagtttttgttttcttcctggagcactaaatatgttttcccaggcagtgaagcagactgatgcccgttggaactggggttccttttgagtgcgtcaagcccatttcctcaaggttctcgccgcgtttgttaagaattccagtgcactgagatctgctggttccgaggagatgggggcagctgtgatttaaccaccacgtgtgtcctgggtgccaccctcctgggccaggctggggctggggacagggagagtccacacccatttcagtcttgcaaggagtgccctgtggagggggtgtccaggaggttctggaaaaatgcagttgagggccactttcagcatatttgagctgggtgtccatgcagcaaagccatccggacatgccaggcctgcctggccctcacggagcttgctgggttgggacagggtggctgcagagtgccattcaggcagaagtagaggcgtggacacagcactcttggttctgggcttattgtttgctcagtggctcaatcccccccccccgcccctgccaggcaccagttacccactggggaaaggacagaggcagtgccctgtggccacccacctccaagcccgctcacccgggcctatccctctgcttgtctcccccactgcagtactttaagaagcagaagcggctcatcccggagaggacagtatggaagtactttgtgcagctgtgcagcgccgtggagcacatgcattcacgccgggtgatgcaccgaggtacgtgccacccgccaggagccgcccggagccacctggagcccaggaagacacttcctcatggctcctccagggtcctcaggggcagccccttgaggaagttggaccgctctgtattccccaggcaagggggctgcccagcaaccgcgcacacacacgcgcccgggtcaggaacctccccgaggtggaaagtgacatgagccccagggggcaggggccccgcttggcacaccacttccagttccccacagcagcctgggagggaggtcgaggaagcctcgcacagaggggactttcatgggggctttgccgtctcagcgggctgggctgagaaggggaggcacctgagaggggtgtttccacagttgacatgattccgagttgtgagaaaggagcctgctgggtgcccggcagggcacgaggtcctttacgtaggctgcttcatggacacctccgttccttcactctacctgtatctcttggtgtctgctgtattggaggccccgccctcactggggggtacggcactgggtgctccactgagcactccgttcattcattacgcagattttccctgagggcctcctgtgtgcgaggcactgttctaggcatggaggatacagctctagagcaggaaacaggagcacagaaacccctgctgtcttaaccctcacagcagctctgtcaagttggtggagggagacccatttttcatatgaagaaactgaggctcagaaatggtcaatttcccgaggtcccacagccagagccaggacagggccttgccctgagggagcaggacctgggctaggcctcaccttcctcccccttcctctcgtcctgccccacctaccccaagcctcctaccccacaccaatctccttctcctcgccctgcagacatcaagcctgccaacgtgttcatcacagccacgggcgtcgtgaagctcggtgaccttggtctgggccgcttcttcagctctgagaccaccgcagcccactccctaggtaagggggacctgtctgtgccccagcagcccccagcggtcctggtgaccgtgcagggagacgcaaacattctccccacgtgtgtttggtcagttagtgcaggaagatgccttttttaagccccagggttttctcatctgttcagaatagtgacccagaagggaatcagctgtggccagaggagcccagctggggcttcccacaccccctgatcacctcccagcccttgcgggagaagctgactgagccggttgcttggagcagggggcgtgtctgtggcacagggcggtcatcttcccactgctgtgagtgtcccgttcacgggcagcacccttggtccatccctcctagggggtggacatttgcactgttcctagtttctggcttttaaactggcggttttgaggctgtggggaccaggtgcctgccagggaggaggtgacattgtagctggaccataaagggagaccagatgctgttgggacagggaaggggagggagcagcgttccaggaaacagtgggtgagcctcggtgtgcggctgagcttggctttgccacagaccagggtccttgcaggagtggcatgaaaagcgggcagggccttgaactctgagctcagtgggctggacaccaccctatgggtcggggggtgctgaagggctggactccggaagagacttggtcagatgtgttttggggacaggtgaagcaatggcaagcttcagtatccacacactgggtatgtaaccaaatgtgaaacttggaatgctgtacgatgggggatttttcatttagtgagaacaaaggaaccaagaaagcccccgcttccccaccagtggaacacaggagcagggtctcctgtgcgttactacaaggctgtctgggtttcaccacgcccatctgtgggaacatttcccagaggcccatggagtgggcgagggcccctgctttctcagggctatttcctggctctttgaggtgtgtttgcagtggaaggtgcccccaggcccaccccctgtgtgctgtgcccaccagcatccgcttccccaggagggggctgggccccaggagctgcccgccgcctccttgaacaccgccccattccagctcatttccaccccactccatggctcaagccaggacgtctcctatccccagacccccgagtgcctgcggcaagcggggtgtgagagacagcagcattgtctgggcggaggcactttctggaagtcacagtgtcttgtggaaagtgtcactgttcatacaggttccagagagactctcagcgcgtcacacacacttaggagaaatgtacgagcctagagaccagcgactcccagcagctgatggagccagcggggctggcggggagggggttgttttgaaactcttgtccccacctggccaggcctcaggagctcttcctttagctccaaagggaagatgtgtagggacccaccccccagggagtatgggacgttccactcatgcccttgacagccccaagcatccagccatccttccctttagcagaggaagaatcagaaatccaggcgctcgagagatttttccgaggtcacatggcagcaggcctctccttcagaacccacgctgcttccaggaaacgagggccgggggcctcggcagataccgttggagtccccctttggggacccgggccactgactctccgttgctggaaggaagcctcgtctttccttgtcccctcaaacatttacttcccttgtgaaaaaccaagtgtttcggtcagtttgggactgtttacctgtgtggttgaagggcttcgaaaagaccaggaaattcaagggaagctgtcaaagagaagagttagaaccgctgcgtcctgtcccccgtcagtcagcaccgagcctttctctgtcccactgcagaaaaaagactgtggcgctccgtcagagagggttaggatcgcatcattaggaatgggcagagatgcgtctcatccgacagtatgattttattgacttggactggtgcacttattatattaatgagaaggaattggaacttgggagaaggccgccctcataagccgggctcttcccaagccctccgagcgccgaccaggccacatgatgggtggaaggagccctcctggggcctgtccccactccgggctctgtgcccggcatccaggagagatgcccaatgagctgaggcctgcacggagctgagcaagtccctgccagcaggacaagctcccagaaccaagggcctgcacccaccaggttctagaatggtgacagtgccaagctaaagcccaggacctgtatctccaagacccaggggaaagaccccttccaccaagaggttctgcaaacagctaagtcttgcacacacgtttggttgggcaagagattgaactaattaccattgcatcgtgactcaggaggggcacaggggccagggacacttcacgccctgtgcgtggggatgaattatgcatctgccgcatctcatgtgcacctactatgtggggatgctgtggtggcagccacgttgccccagcaaccacctcatctcctaaggctgctgacccaagagctgggcttatgcaaatctggtctcctcccacttcccccctccctgggccccctccccgcctctgtatttgctaacacgaggctggcatgaaagggcattagtcagtgccatggtcgggctgacaggtgcggtacccagcggtggcagagtggctgcctcggtgtcagaaataggagccgtaattagagcgcggaacagaatgagcgtcagacgaattaccaggcagcagatcatatttgtcaggaaggattgcatacataaaaattaagtgacagtacacgccggcgtaatgcaggaaaaatgaaagatttgcctatacacagctcacaagctacaagcaagtgtctcgctccgagcaacggcagcagctgcaagacaaatcacggggctgggagagcgggcgggcaggcctggctcctcggctgtagtgacaggacagtctcggtgacaggcagccacgggtgacagggcaggaagggcggctggtcacacccaggcccatgcagggcccgtgctgcctcttgggggctgggagagcaagtctagttgggggtgaccccatcaggtactcgaggtcagggccctgctgggtctcccagggcttagcctggcgctgaggcgcaaaccccttccttcttcttccttgagcaaactgcctggccctgggctgtgtgctggggatatgcgattatgcagctttcgaggggacagacacagtccatgccaggtggcatggtgaggggacaggtgggactgcctcttggggcccactgtgggcaggcagggcaggcgtggggctctgtgattctatacagagccccagggagcccagggtggctccacccctcccagagccgccctcacttcgttactctgtagccactgaactcactgaaaagatgagttaaagacggagaaaaaagagttcaaaaaacattttgttttttcgttggccaggcgtggtggctcccgcctgtgatctcagcactttgggaagccgaggcagtcagatcacttgaggtcaggagtttgagaccagcctggccaatatggtgaaacctcgtcgctactaaaaatagcaaaaaaattagccaggcctggtggtgcacgcctgtaatcccagctacttgggaggctgaggcaggagaattgcttgaacccggcaggtgaaggttgcagtcagctgagatggcgccattgcacttcagcctgggcgagcgactctgtctcaaaaaaaaaaaaaacaaaacattttgctcattttgcttttttgtaaatcatcacaaggcttattattatcccattttacagattaggaaactgaggcccagggaagtaagagagaccacatccctgtggtcacccagtagccagataccagagccccacgggaaatcagctcaagttgaagagcccttctcgaggcatcagcctacagcatggcccagggagggtttgggttgtgggtgcccagggaaggggtcgagagaggatccccagcgagacctcaggtgcgaggaacacctagggctctgagcgctccatccctgaggaaaagcccacctgacctcgccagcagcaggtgttggtggacgacctggagctcatcctgggccccacagggaaggacagagcctcctctcatggtgtgtgtcagcgctgccttgccggggatcacaccgtgctgtgctgcgtctgtgcccaggcctggcatgggggcccttgtggaacatttgctgagtggatggacgaccttcatggccaggcatccctggggacacctgtccgtgcaggtgcggagggccatgcagatgcatcccaggccgcctcctgccccagccccaccctgcgtcccatcccaacagtgcaggatgcctgggaatgatcctgtcagtccctcgggcccagaatccctgcctcagcagatggatctcaggcctgagtttcagccgaggttctgagcactaacccctcggtggcagtcacaggtctgccaccttcctggcattttcaggggcacagactgttaggaagagatgagctgatgccaagaggggagggaaggagagggaagggccttaaggggccagcaagtgaggagtcaatctggacctgggatgtaaactccagctctttggttcattcattcgttcatccattcgacaaggatctatgctgggcctgggccgttccccgggaaggctggcttggcccctgcctttgtggaagatacagcctggtaggagaatccatttagtcttcaccatgaaccaaacactcctccaacaattgcttctcattttccagagagggaaaccaagtctgcagaggtcagggggggaccctctgttttcctgatggggagaccgaggctgagagagagtttctgttctcagccagggagtggaggaagcaggtgcagcccagccagctccagctccatgtcactgctgtccccacctgcccctgtctgtcccatggaggattcagtgccaaggcacagccccccagcccaatgtcccgccggctggacggatgtcagcaaggagaccgcatttctccagctgctttccaatccaccatctggggaagaggggcagcttgcagacaccagcctccccttcctgtgaaatctgcctttttcgtagctaatgaacatgtttcaaacaccgagagcatttcaaaacacggcaaagtttgttttgacaggaccggcgcatcttggggaagcggggcccctttaatcagcctccctctttcagatcccgcattctcctctgatatctgctgggtttgaaatcgggagttctaggtaaagattccgggaaggtcagggtttgtcaggctcttctttcatacacacagctccgtcccccaccaagaggagggggcggtgggagtctcagggaggggcatggaaacccaggctgcacagggctctgcctctgcgtctcggcatcgccgggagatgggccgggataaggcccgggctgcactgcacacagaggtcgtcctgggcaggacccccgctgtctgtggagacccctcctcctgccagcttccccgactcctcctcagaatcccagctctcctggcgtctggggatgcatcctccagtggcccgctgcaagctgggggtttctttgaaatctcttgttttatcttcaaaactcatgcgagttgggcattgtgctctgtagtgtctgagtggctattgtcagcgtagacaccaggctttacgtgacttattcccagacaagttgccatcacaggaagaggtgctgtatctgctcctgtagcttcccacagccctagctgcagtccaggacaccctgccccccagtgagacacagcaccctgactttaagatagaagggggagcagcccctcccctgggtcagggggttggggaacctgccgggaggcagggacctgaggaccctgtgctgccaggctcaggatgggccaagcctctctcagttaaggcttcactagttccttcactttctttacctttccgttgcacagatgctcaccgagcgtctgaaagagtgaggtgggtgagtgaggccttttggcagctccttttagacgggaactaacagtaacatctcttgtaagagatacagggtccaggttccacccctggagattgtggcccccaggtctggagttggactggagatccagatttctaaccagcctctccaggcaattcagctgcagcatggatcatttcagtccttttttttttttttttttttttgagactgaatttcgctctgttgcccaagctggaatgcagtggtgcgatctcggctcactacaaccttcacctcccgggttcaagagattctcctgtcttgccctcccaagtagctgggagtacaggcgcgtgccaccacacccggctgattttttaaatttttagtagagatggggtttcaccatgttagccaggatggtctcgatctcctgacctcgtgatccacccgccttggcctcccaaagtgctgggattacaggcgtgagccaccacgcccggcccaagtccattcttgatagacatggtctactggctgtttctgaatacttcctgggacaggcaactaactccctgcctcctgatgggcccactcctgcaaggtcccagcagggtcaaggctcagttaatcttagttggaggtgggcaggtggctggctggatggatgggtgatggacagactgatggatgaatgaatgggggttggatggatggatggatggacgatagacaattatggatggttggacagttgggtggatgatggatggatggcaatttgcaacactagcatcttagaagaaagctccaaattgcatttggatgtttgccttttctccgtacaccagtggaaatggggtaagcagagagagcagtgaggtggcagaggaatgaggtgaagagaggaggggacggagggctggtgaccccaatctctctctgcccacgtgcccaggctttcaatataaagccaggctgagacagggatctgtcggcctgccttggagctccagcagagggaggaggtggtgacagaacaaagggacaaacctaacgtttgggtcctgctgagcagccggctctccctggccaggggaggggaccttaaaggagcccgcaaggtggcaaagggaatagcacgtgcaaaggcacagaggcgagtggaaaagcgggctggggctggggctggagtagccgctgtgggaggacccgggctgagggccaggcactccaagcccttgctttccgatggtcctggccaaggcagcgccaggccacaccccggccccagtgtaggtgacctctccccacagcatccctcctgtagaggcccaggcagatccacagtgagcagaggagactcagggtgggaagagcctgtagggtcagacaggaaggggcttggccaggggtctgaagggttcagtgttagccagacagtgcacagtggtgtctctcactggggacaggactccctgcctgcatctgtcccctgccatctctgtgtgcaccccatcagccctacatcattgtccaacctgtaggcacatccatccatagcacccaggtgctggaatccacttacatttgtcctgaggttcccactgttcaccgagaactgtgtgtttcatcccatggttggctacgacaagccatccatttcacactgggctgttcctttacttttgctccctcgtgaccaaaatatacaaggtgttgctactggaagttgcgatttgctgtcctataagaaccccacacggattcatatgttgactgacagccctttctgctgagtagcggttagcccctggcttcgctcatcaagtatgcatagaggatgacacctttctcacaagcagggctttaagtgagggctgctgcgcttgtttggggattattgccatgaaaaggagcttggtatcctgatgaagcaataatcacatttcagacagttgagctccgggcagccatcagttaaataagcagtgtgttcagctgcaaggaagaattgtgggcagtggcacgtgccgccacatagctcacaggcaggcggactcattcatccagtgagcggacgcccacaaggcacccactatgagccgtcctgcgcagggtactgggatgcggcaacaaacaaagtcctgcccctgggagttcacagcccagatcagagatttccaacaccattacagcctctccaaaaactgcgaggtagttcttcatccatctccattaagataagaaaaacaaggccggatgcagtggctcaggcctataatccaaacactttaggagaccaatgtgggaggatcgcttgaggccaggagtttgagaccagcctgggcaacatagtgagaacctctctctacaaagaattttaggcggggcgtggtggctcatgcctgtaattccagcaatttgggaggccaaagcgggcagatacccaaggtcaagagtttgagaccagcctggccaacgtggtaaaacccatctttactaaaaatacaaaaattagccaggcatggtggtgtgcacctgtggtcccagctactagagaggctgaggcaggagaatcatttgaacccaggaggcagaggttgcagtgagccaagatcgcgccactgcacttcagcctgggcaacagagcgagaccctgtcttaaagaaaaaaaagaagaagaaagaaaaaacaagaatataatcaagttcaaaatgttaaacttgttcagttttgtaaagaactgtcctcagttttgagaaatgggttttctcaatcatgccaagctgtcttttctttaaaaatcatagtgactgacactaaatggtagttgggggctttgtgttttttaaatgcttccttcatgaaattaaaagttacctgtgtttttcccgaaatctcttgacccgtgaaaccctgaggcctgggcccggtgccttctgagtccagcccctgaatggtccattctcctcccagggtcctggatcccctcttcctcatgtcacaggccacatctcagccagcctttgccacgctgggactccagctcaccacagagactggttaggacagcagcagcctctgtcacatgacatggtgtctccaggccagtgaaaatgttctcagtttagcaaccttaaaaatccaggccaggctgggtgcagtggctcacacctataatcccagcactttgggaggccgaggcagacggatcacctgaggtcaggagttcaagaccagcctggccaacatggtgaaactccgtctctactaaaaatataaaaattagctgggcatgatggcacgtgcctgtaatcccagctactcaggaggctgaggcatgagattcacttcaacccggaaggcagaggtgatcgcgccactgcactccagcctgggcgacagagcgagactctgtctcaaaaaaaaaaaaaaagaattccgggcctatgcctccagaatagccatccactcaatgggctgataggagaatgtcaggttacaggaccagattcctgggctccactccagacctgctaaatcagcccctctgctgaggtgttcatgcctctggtgatggagagctcactgcttcaggaaatcctcccatctttgcacggttccagctcatccaatatgtgccctgctgcccagagataaccctacaggtgctgggaggtcagggcacagccctccacaatttcctcagtgttggcgtttcctgcggggagaagagggaccctgaggacaggccctgaagccctctggcttccctcttggcagcagagccccatcttcaccattaacacctttttcctcattcactttttaactgaggtataatatacatacagtgaagctcctggagccctttcctggtcaccactcctatagagtagcttttcctgttcttgaatttcacataaatgaaatacaataatgtgctgttttgtgcctggtttcttttacccagcattatgtccatgagctgcattcattttgtcgtgtataactgagatttgttcttttgcagtgctgtacagtatcccactgtgtgaacagaccacagtttatcaattgatccaacatttgtttccagtttttgctgttacaaacaaagccactctgcacattcttgattgtgtcttttgatggatggaagcactcatttgggcatctacctaggagcggaattgctgggctatagtgttggcagtgtttggccatggtagaaaccagccgatggtcttccaaagtagttgtaccattttaccttctcatcagcaaagcatggacattccaggtgctccacacatcatcgaccttgtttttctttaactttggtttttttgtctttaaacattcagatgggtgcgtaattgtacctcattgtgtttttttggttttgttttttgttttgagacagagtctcactcactctctcacctgggctggagtgcagtggcatgatctcggctcactgcagccttcacctcctgggttcaagggtttcttctgcctcagcctcctgagtagctgggatgacaggtgtgtaccaccatgcctggctaatttttgtgtttttagtagagacagggtttcaccatgttggccatgctggtctcaaactcctgacctcaggtaattcccacacctcggcctcccaaagtggtgggtttacaggcgtgagccaccgtgccattcattgtgttttaatttgcccttccctgatgagtagtaagaaaagtagcctcacttcatgtgcttcttggccactgggatattctcttttgtgaagtgcctgttcagggcttttgctcatttgaataagggggtagtttgtctcttatgtactgatttgcagaagctttgaaatatgttctgtgaagagtccgttgtcaggtgtatgtgttgggatgattttctcccagtctgtgacttgcctttaactctggtgtggtttgatgaactgaagttcctagttttaatgccttacacacgtttcctttttggttagtgccttttccatcctgtttaagagatttcggccaacccgagtctggaccggctaattggcgggtggccatgggcagagctaagtggtcagtttctggaacctgagggtctgggtttgaactaattcctgccactctcgtgcaaacctcttcacccatctgagcctcagtttctccatctggaaaatggagatactgcctcatagcactgttgggaacagaaatgagctgacacatggaagatcttggtcagcctccacagtgatggttttttcactgttcagagcctgatcctgactcttgcagattcagacagtccccttaaaggacatgtggtcagttgcttcccccagccgggccgaggcatccccttcccctgggcagctggcagaaacaccaacccccagctctccagccccatcctgattttttttttttttttttttttttgagcccgaatctcactctgttgcccaggctggagtgcagtggcgcaatcttggctctctgcagcctccgcctccctggtttaagtgattctcctgcctcagcctcctgagtagcttggattataggtgtctgccactatgcccagctaatttttgcatttttagtagaggcggggttttgccctgttgtccacccaccttggcctcccagagtgttgggattacaggcgtgagccatggcgcccagcctcccagcctgattcttggtctcggtgggtccagggaatctgcttcaagtccccggcaccccaggtgtttagtgccctgctagcatgggaacctctaatctgatccaactgctcatctgacagaggaaggcccaggcccagagagggagaagggctgctcagagaccgaggcacaatctctccccagctcccgtgtgccctccctccaacctcacctctgtgccctgcccctgccctacatggagcataagcagccccgccccttgctgtgttgcagtggggacgccctactacatgtcaccggagaggatccatgagaacggctacaacttcaagtccgacatctggtccttgggctgtctgctgtacgaggtgagtctctgtccgtggctcagcagcatttggtgggacatgcatggggggtgcccagttaggacagggctcaccctaccagctcagggttggaacccaggaatgtcacgtctgcctgaggcatcggtaccaccagggccctgtccttcaccctcctcagccccacgtggggcctggtctgcagggccaggctggtggaggctgttagggggtggacagcagtgggcggggtccaggaagggaagacagggagcacaggccaggcatctgatccccagctgcccctgcccccgtcgccctggtaaccacattaacacaccggcgattctgttcatcctttattatgggtcaggcccggtgcagggcacctggggtcaggagaggagtcagacttgcctcatgcccctgaatcactctccactgacaggtggccaccccctccaggcccagaaatgtgggtctccctaaagaccaccacctctccccaaagaccaccacctctcccctgagctgttaaatggagctaggggatggccacttccagacctggtggcctgcctggacaaagggacaggaacatttctgagtttcagtgagcccagacgtgagacaataagaataaatggaagccccccacccattttgtccagccacactggggccccaggtgatgagaggtgtggggagcatgagccactcttggccatgaagctcttgcagccaccggcaggagggaggcctaagttctccggtgtccaggttggcagccacacaagctccccactgtccctagaccaccaaaggctgggtggctccgggattccatccacctggctgagcccctccgcatctataagatgggaacaggaccacctgtcttgcattgtcctcagtcctgataaatgacagacaggaaagggctctggaaacccccccaggctgttagacaccaagcccggcttggttttacagttggaaccctgactgtttttctgctttccctggagctgacttgagcagatgtggggtctggcttggagctgacacactgaaagaacttcagtctcagctgctgtggccggtgacagtccacagcagtgatgctcaggacagcgtgtccagggcctgcctcgagtgctgcgcagttgtccacagagcctgattgctctgtccccttgggactgtcgactctgaggctgacctcacagcccttgtgcatgaacttgagggctaagctgcccaccgctgggccacgtgggacccgcggccgctctcgtggccagggggtcttgtggccagggtcttttggtggtgagatttcccctccccacattacagattgagaccatgagttcaaaactctgatctgtttgcagggtttaaacttcacagcatctttcttttgtttttttgagacagagtctcactcttgtcgcccgggctggagggcagtggcgcaatctcggctcactgcggcctccacctcccaggttcaagcaattatcctgccttagcctcccaagtagctgggactacagacgcccgccatcccacccggcaaattttcgtattttttggtagagacggggtttcaccatgttagccaggctggcagcatctttctttataagccagtgacctgctatatttcattttaacagactggctggaggtgtggtccttgtggaactggtgcttgggaccccttctcccggggctcagcagatgcgggtgacaagagggtgggaccccttctcccaggagctcagcagatgcaggtgacaagagggtctgtgggttagtctggccctgacagagctgggaagcaggccgggtgctctttccaggactccacagggcatcggttgcaggaggagctctttgaatgaggacctagctggagcagccatggcgagtgtgtagtggatggggaaggggcctgcaggtgaaagggggacgagccatttgtcctccctgcctccctgtctctccacagcccagctcctgggtgggttggggcggcgagtgttgagcagggtgtgtgggtgggctcgggggagggcagtggatgtaggagagaatttggagggaagtcagtgtctttagccataggagacaagacatgttaagtccaaactcttctgagacaggaggaaacctgctggtgtagggccctgtgtgcctgcacattccgaacagccccggggagggtgcgtgcctgttattttgcggagaagacgttaaatccaggtggggaaagccccgggtgtggagagttgttgagtggcgcagagccactgtgctgctggtgtgtgtcccccaggaggagtcgtgagttccagtctctccaggactcctctaaatccaggcaggtggccactctggccaccaaggtcgctgaggctagcagtagagtcacgcccatgtcacctgctaacccggctgtccctgggctcagggctccagcgtcaccgccctgcccccacttgccctaaggtctgaggaggggatgcaaacccacctgtaagtgggcatcgttcacccggtgtcagatcctgaggggcagagacaggcgttctaggtctcccaaggcccaggctaatgcccgcagcatagtggatggtcggggagcacaattttgaattagagcacgtgtctgtgtgtaggcagctcacttaccaactcactttcatccaaatcccagctccagggcccacccacggaaggatccaggcaagtcagcccctcccgggtgggcctcaggtgtcccatatgtagaatgagtggccagcccaccttgtcatagtgaggaaggaatgaggccctaggggtgaggtgcccgagtcagagaaggccctcgggcctgtccaccagctgcaggccaagcacgggcacttctgcccgcctccggcacgaggctcctgcagcttgccacatttccctttttgctttggccagcgggaagccaaagtgcagcccagcctcagtctccgaggaggctccactttgtcctcctttcctcatgtgtcttgtccctgggtcagatggcttttcgtttctttttccattctgctttgtgtttttgtaagctgcttcctgtctcccatgaaccatgggctctccacacataaacacacacacagcatatgaacacacacacaggctggccaggctgacagagctgtgcccacttccctggggctggggccgggaggccagcagctggctccctctgcctgtgccaggccctccacttgagaaccggccctgtggttcccagccccgttccctgcctcagtctttgtctcggctctgcagaggcaggcacagcccatcctgtgccaggcctcactgaattctggctcgggcagtcctcctccgagtcctcatttgtgggcacctaaatgtgcatctcacaaggcagtcccgccttcgtgactccctggcattgaggctcgggttacgccgagctgactcatttgttggagtgagtggggctgtgcggctcgcagctgggggggctggaccacagccggggggcggtgaggggacggatcgcagccggggggtggtacgggggatggatcgcagctggggaggtaccgatcgcagcgaggggtggtgtggggggacagatcacagccaggggtggataccagtcagcagtaggaagtgaatgaaacacagcagtcaagccctgaggggattagcgtcctcagggacatcaggcgctgacctaaccctagcagccccggcctcacacagcagcaggctgctgtggccacccatagccggcccatccaagggtaacggggcaggggctctgtgccaagtgaccccctccccactcctgcagtccctaaaggggaaggtgaagcaggcgtttccccagcagacagggaggagagccacatctgagcccacggccatgtaattggaaagaggcctcccgcagtcacgcccggagcctcccgccccacagcctgtggtgtcttccaggggcaccagcctgaagagctgtgacaaagccccctgccctctctggacaacagctgaggatcctgcacagggcacatacccaggtcacctgggccctggtgacagacacagccggagaaaacctgcccttccccaagccccagcacagcccggaaggctcaaaagcccctgtgctcatccctgtggctgcagtgacagatgccaccacgccgatggcttcaagcaacataagtttactctcttagatctcgaggattctggaggccagatgtccaaaatcagtctcgctgggctaagtcaaggtgtcagcgggcaggtgccttctggacgttctgggggcgaatctgtttccttatgttttccatggaaaatggagaggccacccgcggtcctcggtccccgccttgtgtcaccacagcctctggtgtgcgtcagcctggcgtcttcccctcttctgtgcccttctctctcgggctccctgtcatgagggctcttgtgggtacgttggggcccacctggataatgcccccatctcaggagccaacatttcatcacagctgcaaaatcccgtttgccctataaagtgtcatttacaagtcccaaaaattcggtgatggatgtctttggggcccaccattgagtcccccataccctctctcacacttgggcatcagctattaccgaggacctcctgtggccaccggagttgctggcgctgaccccagctagtgggagccaccacaaagccccgcacctggccctcgggtggggccccagcggagtgtcttgaagaggctggaatcaggagtgctggcccgaacatggagtgaatcatgactcgcaggccaggcggtggggagcccccggtgggagctgggagcaacaatgcccgagcttgggatatcggaaggccgggctctgttctcgttacctagatgcccatggaggtgcccagcgggctgcccgctctgcaggactgatttttatctatgtgggagctcagctgcaagtacggagctagaggaattggctcattcagtgccagtcccaggatcctcatagggggcctcctcgcagcagccttgaggtgcccagctgggactgagacccagcgagacagcggactcaaggggaagatctgcggagccttggccgggacgccgctttggaatcctgcttggacggcagagaggcctggacgcccctccgtggtggaggagcagggctgcagacctcctggcctccagtcacccttctgtctgggatgtgctcgagagacactgggtgacaagatgggtgtctgaggccctgacaggcaggagtcagattccccttgtccctctgacatctcagatcacacaccagcttctctgagccctcctggtgggggccagggcccacccacccccttttcctcggctatatgtcaccctgatgacaccagagagaagggcttggcatttgaggagcagcgctgagagccgtggcctcggcagttctaacgaggccccagacagtgagtcctctctatttcgaccagtcagagtctgggtggtcactggtagaaggagatctcgccgtccagggtaatcgttgtaatccgcgcagcccagagctttcttcacagcccattgccctgatgagggtggaaggcccatggccggcagcagagtgggggcaggctggggcggatggaggaggcctgttcctggggaaggccgagaggggtcctctggcatagctcactgctgaccccattcaaaaggcttttctgaaacgatgtggagaaagtgctggaaagagcagagacatgatgggaagtggatgccagcttgggggctcaatgctcccctcagcgttctggggcctttggagttcccagcagcgaggtttataaaattgagatcaaatgggcatgatctgaagttgaagatcggctgattcctctccggggtcagccacatgaaaaaccagggcctgcgttcacaggaccaacactcaaaatgtcccttctacgctgcacagtaacagtccaggaaaatccaccttaatcctccagctgcaactcgggggcacccagatcaccccaggtgaccgtcctggagtctcagctgctctctgttatggcaacagatgtcctttgaaaatgcccgattaaccctttgcacccgagagtctcattttaattcctggacatgcgtcacctgggtggtgcatttggcaggctcccagcccgctcctggtcaggtcagcagaccccaaaatgggcagggcctctgcatcctcacacttcccctgcctggccagaccctccctgcagccctcctccaagggtgggtttcaggctccacatgggttcccagcccttctctgaggggcccaagctcccagccagccggaagacagaggtgatgctgtccctaaacacccacctgaaggcacttggcctggcctgggctcctggtcccgagggtgctgaacctggggctgaggaaagcccacagtctccaggctgcactcagcagcttccccaaaggccatctgcaaacccaaggatggtgccaggctctgaagctcctccacgccctcctgaaggaggcaggcccttggggtcaccagacctgttcatggacgaacacagaatggggcaagaccaggaaacccaagctgacgggcaccctcaaaccctgctaccaaggactcctccccgctcagcctctggggcgcgaggacaagcgacggttccccaggtatcccagggcccctcggtaggcgcccaggagcccttggccaagaagccagagcagggtggcccctccgggggggaaccggggccagacagcaggagggcactcgcccgacggcacttcactagccggaggcattgggcctcggggggcggtccgggaggcaggcagccacagtgagctggagtgacgagaagctctttcccattatgggttcataatggggccagcaggtgccacgctgggctgctgcgccaccgcctcagggccactgtggcccctgcacacccccttgaggagtcccctgtgagtgccctgagtggtggggcagcctggcagcaccctgacagctgagaactcacaggaggccaccgccccacaggcctttcgctcccccgtggctgtggccggccttcagggcagaaccggtgccgcaggcctcacctcatcaaaggtggtcttggccctgctggtggtgcctcctccgtgtgccagcccaagcctcgccacaggcctgtgggtggggacattttacaaatgaggaaactgaagtccagagacacagcgagtgcagagctggggtcgggacagagctagggctggctgtggagccaggcgcttccctcccaccctgaaggttccctccaacatgctgctgcgcacctctatccaggggcaggaggctgcctccctccctcctgaaccccctgctccccctgccctgataccggcagctggcttccacaggcagcagctctgcgaggggctggcaagaacagccacagtgaaatgcctcacccttctccggcccaccccaccccaaaatgtcagtccataggtaaggaaagctctctgaacatgtggggcacagagacctgcccctgcaggcatcttggaaaaatcgcgttttatggaaataagaccatgcactcggcaacctgccacatggagcctgggtcccccgggctgaggtgggagcaaggtgggaattagcttgcagcgtccagctgcccttctttattgccttgaaagttttgtcaccgaaaccctcgtgcccacttaatccagtgacagaatcagggtagtgttgcgcctgctcctctgttgaaccccagcatgctcggtgattcgggggagaagtcctgctggactcgccgcggtcgggaccagagagaacccatgccccaacaatctggagcagcctcctcctctctagtccttctgagccttgaggccgaaagcttatcttcgttgttcccgtcccttgcagatggcagccctccagagccccttctatggagataagatgaatctcttctccctgtgccagaagatcgagcagtgtgactaccccccactccccggggagcactactccgagaaggtgagtttgcaggagccggaggcctcgccagccccaggaggccaccgaggcttatgagggccgctccaaaacaccacagctgtggggctgaggttaggctcactttacacggtgcagaaagggagctttctggaaaagtgacttggagaggggaaagtaggtgattgcactgaagaaggggtttcaccacgcagctccagtgtgggacccccaggtaggaaccagtggcacgtggcccttggcacatctccacctgttcagctcccaacttggtgctccagtgggaggccctctgctgcaggtccccaggacagggtctgtgccgtgccagacatgggaactgatacaggggcaggatgtggcaggcctggcgtccccataccaccagtggtggccactctgctcccatgacaggaaactacggcaggaggaccggtcagtttcctccttatataacagacttaacaccctgggcttctactgtcaacattttacactggctgcgggagccgtggacacagctcccatgggtctggcatggggctgtaccagttactaggaatgtgtgaatatcttattcctcggctccgtcaccttgaagatgggactaataatctccttggtggataatggtgaggaagaaaggacaggtttcctggcacagcagggtcaaaagtgtagatacatgttcacacactctctgcactgttcctaggtgagtcacctaacctccctgagtctcagtttcctcacctatacaatggggataatattaaatcttccacacaggatcagcataaggattaaggtaaggcaccaggctaacactgccaccaccatccaaagtggccaatggatggggcctggctcagtcagtgttcactaaatatcatgtgacccttatttctgttcaaggtcaacgctagtgggtgagtctggggcctccgtgggcccaccccataggaccacaggccgtcacctcacgataataacagctcatgttcagacttcctgagttgaatcttcccctcacccatttaccaataaggaacagacagacacaggcaagttaaaaagaccggtgaggcaggatctgaacccacatgcgcagccacggagccatcgtgcttcttgatggcatgtctttggtggcccatcaattagctggggtgaggctctggaaggagtgcccttgccccggccaaactgcacagggcaggtcctgggtgctgcgcttgtgtccaggccggaggctcctcgcagggcacctgtgctgagcctgtgcttgctggcgttgcagactccagggctagaggagctcgagtgtcgggcgctgcacagtgcccttcctctcctggctcccaagttctgacctgcacttttggaggaagtatttctcctccccagtgggaggaaaaacaagttgcatctctttacaaagttaatagttgccatttgcttttttcctttctcatcttctgaattcggacttgtgtatgattcagaagcttgaagctgtgcaactggagctggtgacaactctgtgctttggctgtcagtctagaaatgggagtcgccctctctacttcagtgatgaggctgaaatgaacattgaagcccctgtcccaagtcagccctttcctggccacgagcccccactccccggagcactggctctcgccgggccccatgcttaggagtgagaggtggtgctcaggagcccccagcacaccctattttaaagttatatcgctgcttagaaatgaaaataagacacttttattatttttctcttgaattctgaaaacttcaaacatgcacttattgacaactgtgcgtttacttcataaattagttcgggtcacagacacttcacctgaatctggttttcttgggtattttaacctgtcagaggccaaccacaggtaccttcccccgaatattgtaaggttcagaaaacagctgtcttgtccacaggcgacttcagactccgggagtggcctagcaggctgcaggccctgtgtcacctgggcttctcggttgtaaggcatgcacgcaggtgcgaggggataccctaaggctctgtggcccagggagaaaatgccccatcagctgagaggagccctagtctacaggaagcccaggccccatccctcagcctaacgggcctgcgcagcagtagcccccgggcctccagaacgtcccgtgggcccttcccagtccctgagtgagtgtggccactgagaccaccagagccccctctggttcaggaccacccagcttcctgctgctgctgctgcttcggctgctgtggcctgcggggctgaccacccctccagcagcaggtatttaaatggaaaccaatggctgtgagcccgtgatgcagggtaagatgtaggcattttaaggtcattattttaattaccattaaaataattggcactccggctatcagaagaatggaggcgatcagaggcgcaaggcgcccctcccccacctcggggcgggagcagccttcagtgtctgtataattaaaagctccgtctttcatgagcacaataaaggggccgggggtgggcagactgcagccctgctgcatgttaatgcgtttattatgatcaataagcccttgccttgagttttgtcctctggtttgggcatctgcgtgactgacagcagacacacacacacacacacacacacacaatttgcccaatggtgtggacagctacaagttcaaaataatttggaggttaaccattcttagggtctcaaagcacagcctttgggactagacaggcctgggaggggtactggctagcccttgggagccatgcggctgcgcaccccttacttgccccagctaaacaccgttcttcagctctaacggggacaacgggaccatctagttgctctgaggatgaagtgccttcatgcagacagactgtggagtgcggagcctcagtaagactgctttcttgagaataacacaccattctctcccctgcagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacagcagacagaacctatctgtcctcaggaggggcgcatggctcctacgctctcctctgagcctaggccagtgctcaaggaggatcagcaccctgaagggccaggccaatggccttagcagccccctactgcccccaaaaacaccacacagtgc

SEQ ID NO: 12743 - DNA, 6167 bp, Human
agataagagaaagtataatatgagccttgaacatctcattatgccaaaaaggaaggagatacacaaaaaatggtgggcacgtgtctaaaagacacagaaacctgattgaaggggctcacactagccaaatctagaacaatatgaaagcacacattaacagtaaagaataggaagccatgagtcaatactaatgtaaataaataaatataaatagtaaataaatggacagcttgattagcatatcagttttctattgttgtatcacaaattctccaatttagggccttgccagcctactgtccagctgtcagcaggacagtggtctcatcagaggctcgcctgtgggaagatctgcttccaagctccctcaggttgttggcagaatttatttccttgctgcagaagggctgagggttttggtttccagctaaaagttacccccaactcatagaggctatctctagttctttctgtgggagctttacaaacattgccacttatttcatatcagctttcttcttcaaagccagaaacagagacccttcctgctggaagaaggagtcttatataacataatgtaatacttacaagaatgacatcctatcacttttgccttataaagttacataatcaattataaagtaatgttcatcacctttgctatattctcttggtgagaaaaaagcaagtcatacatccttcctattttcaaggtgagattatacacgctctaaattcgggaaggaggggattcttgaggtcccattagggtttaccactacagtttgccctctaactcccagtgatttgcattcctttcatatgcaaatgggcattttcatatattattagcagaattataaatcattaaatactctctagatgaaaatttgactgtagacccattttacattaatttttcttcagggaaacttagattaaggcaacaattagggatatgcagaaaaatttagctatgatggatgatctctgttttgtataatagcaaaaaattggaaaattaaacttccacacaggttgggagaaatgtttagtttttaaatgaattgccacaaagccctcaaaaatatcatagaagtagtgttagtctgttctcacacggcgataaagaattacctgagactgggtaatttatgaagaaaagaggtttaattgactcacagttccacagggttaacaggaagtatggctggggaggcctcaggaaatttacaatcatggcagaaggtgaaggagaagcaagcatgtctaccacagtggagcaggagagggagaggggtggggagagagagagagagagagagagagagagagagagagagagcacaaagtggggaagtgccacaattataaaccatcatatttcatgagaactcactaactatcatgagaacagcaaggggaaagccacccccatgatccaatcaactcccaccaggtccctcccccaacactggggattacaattaaacatgagatttgggtgggtacacacagccaaagcatatcagaagcatttgtgtttatatagctaaatgtgcaaaatactgttttaaaaactatgttactatacagtatttatggtactcagatttttgtgaaacctataccacatccatatgcatagatggcaaactgagaaatatatactctaggatattaaaaagtcatttatttttgctttatttttattcttttcttttatatatattttctgatattaaaaaagcatagtttaattttagcatttaaaaaattaaaatttaaagtttaaaaattcaacatctacaataatgtaaaaatgattaattcatcaaaggataacaaatttagctaatgagagaacatttacacaacaaaaattaatcctaacttattgacatgaataacattttgaatcagttacagtgcactttatccttttataaatgttcaggaattaggaatattccccaaacatttacccagtttgacacaatgtaggtaagaaacattcatgaactatatccacaacaatttttaaatgtgcatattgcattaaattcttactttctctacttcacaaattcaattacttctgttccttttcctctcaccaaattatatatttattaactttgtattcaattcacctaaattatcttaatggggccagaaatccagtgcctggaatttccttatgaagtaaaataatttgtttcccttttgttcctctatacttaaaaactcttctctctgggggcaaggcatagtagaacaaaaggcagcagacagcatctgcacaattaaaggtccctgtctgacaactctgaagtgggcagtgattctctcagcatggcgttcgagctctgagaacggacagactgcctcctcaagcgggtccgtgacccccgtgtagcctgactgggaaacaccaccccctaggggccaacagacacctcaaacaggcgggtggccctctaggatgaagcttccagaggaaaaatcaggcagcaatatttgctgttctgtagcctccactggtgatacccaggaaatagggtctggagtggacctccagcaaactccaacagacctgcagctgaggggcctgactgttacaaggaaaactaacaacctgaaaggaatagcatcaacatcaacaaaaaaggacatccacaccaaaaccccatctgtaggtcaccaacatcaaagaccaaaggtagataagaccacaaagatggggagaaaccagagcagaaaagctgaaaattcaaaaaaacagagtgcctcttctcctccaaaggatcacagctcctcaccagcaagggaacaaaactagacggagaatgagtttgatgagttgacagaagtaggcttcagaaggttggtaataacaaacttctccgagctaaaggagtatgttctaacccaccgcaaggaagcttaaaatcttgaaaaaagtttagacgaatggctaactagaataaacagtgtagagaagaccttaggagctgaaaaccatggcatgagaattttgtgatgcattcaaaagcttcaatagccaattcgatcaagtggaagaaagggtatcagtgattgaagatcaaattaatgaaacaaagcaagaagacaagattagagaaaaatgagtgaaaagaaatgaacaaatccttcaataaatatgggattatgtgaaaagagcaaacctacgtttgattggtgtaccagaaagtgacagagagaatggaaccaagttagaaaacactcttcaggatattattcaggagaacttccctaacctagcaaggctggccaacattcaaattcaggaactatagagaacaccacaaagatactcttctagaagagcaaccccaagacacataattgtcagattcaccaaggttgaaatgaacgaaaaaatgttaagggcagccagagagaaaggtcgggttacccacaaagggaagcccatcagactaacagtggctctctctgcagaaaccctacaagccagaagagagtgggggccaatattcaacgttgttcaagaaaagaattttcaacccagaatctcatatccagccaaaccaagcttcataagtgaaggagaaataaaatcccttacagacaagcaaatgctgagagattttgttaccaccaggcctgccttacaagagctcctgaaggaagcattaaacatggaaaggaacaactggtaccagccactgcaaaaacatgccaaatggtaaagaccatcaacactatgaagaaactgcatcaattaatgggcaaaataaccagctaacatcataatgacaggatcaaattcaaacgtaacaatattaaccttaaatgttagtgggctaaatccctcagttaaaagacacagactggcaaattggataaagagtcaagacctgtcagtgtgctgtattcaggagacccaactcacttgcaaagacacacataagcttaaaataaagggatgggggaagatctaccaagcaaacagaaagaaaaaaaaaaaaaagcaggcattgcaatcgtagtctctgataaaacagactttaaaccaacaaagatcaaaagagacaaagaaggccactacataatggtaaagggatcaattcaccaggaagagttaactgttctaaatatatatacacccaatacaggagcaaccatattcataaagcaagtccttagagacctacaaagagacttagactcccacacaataatagtgggagactttaacaccccactgtcaatattagacagatcaactagacagaaggttaacaaggatatctaggacttgaactcagctctggatcaagcagaactaatagatatctacagaactctacaccccaaatcaacagaatatacattcttctcagcaccacacttattctaaaattaatgacataattgatagtaaaacactcctcagcaaatgtaaaagaacggaaatcccaacaaactgtctctcagaccacagtgcaatcaaattagaactcaggattaataaactcactcaaaaccacacaactacatggaaactgaaaaacctgctcctgaatgactactgggtaaataacaaaattaagacagaaataaataacttatttgaaactagtgagaacaaagacacaatgtaccagaatctctgggacacaattaaagcagtgtgtagagggaaatttatggcactaaaggcccacaagagaaagcaggaaagatctaaaatcaacaccctaacatcagcattaaaagaactagaaaaacaagagcaaacaaattcaaaagctagcagaaggcaagagaaagaaatacaggatatgcaattaggaaaagcagaagtcaaattgcctctgtttacagatgacatgattgtatatttagcaaaccccattgtctcagcccaaaatatccttaagctgataagcaaattcagcaaagtctcaggatacaaaatcgatgtgcaaaaaccacaagcattcctatacaccaataacagacaaacagagagccaaatcatgagtgaactcccattcacaattactacaaagagattaaaatacctaggaatccaacttacaagagctgtgaaggacctcttcaaggagaactataaaccactgctcaacgaaataaaagaggacataaacaaatggaaaaacattccatggtcttggataggaagaatcaatatcgtgaaaacgtccatactgcccaaggtaatttatagattcaatgctatccccatcaagctaccactgactttcttcacagaattggaaaaagctactttaaagttcatatggaactaaaaaagacccaacatagccaagacaatcctaagcaaaaagaacaaagctggaggcatcatgctacctgacttcaaactatactacaaggcttcagtaaccaaaacagcatgttactggtagtaaaacagtaccaatggtagtaaaacagtaccattttctaatggtagtaaaatagacgaatggaacagaacagaggtctcagaaataacaccacacatctacaaccatttgatctttgacaaacctgacaaaaacaagcaatggagaaagaattccctatttaataaatggtgctgggaaaactggctagcatatgtagaaagctgaaactggatcccttccttacaccatatacaaaaattaactcaagatggattaaagagttaaatgtaagacctaacaccgtaaaaatcctagaagaaaacctaggcaacaccattcaggacataggcatgggcaaagacttcatgactaaaacaccaaaagcaatggcaacaaaagccaaaattggcaaatgggatctaagtaaactaaagagcttctgcacagcaaaagaaactatcatcagagtgaacatgcaacctacagaataggagaaaatctttgcaatctacccatctgacaaagggctaatatccagaatctacaatgaacttaaacaaatttacaagaaaaaaacaaacaatgctatcaaaaagtgggcaaaggatatgaacagacacttctcaaaagaagacaattacgcagccaaccgacatatgaaaaaatgttcatcacttgtcatcagagaaatgcaaatcaaaaccacaatgagataccatctca

SEQ ID NO: 12744 - DNA, 48996 bp, Human
aaaaagtagcatacttaggcgactcagaaaatcctgccccatcttctatctccttactccctcctcaccaaaaaagatcttttttaatactgaagaccccctttaaaaagaaaaagaaaaagaaaaagaaaacaatagttgctctaatttgagtgtcgtttccctttattggagcatttgaaaacagacatttaagggcaaaagagatggaacacatctgaggtaaatcgtgtatctatcttcaggctgtgcccaacctttagaaccacctagaaaggtacaaagctgagagcctctctcagatttttcatatagtatttcaagactcacctcttaattgcacccttcccccctcccattataaagagcatggaacctaggacccaccgccttgtgtggaagtccacacaccactggtcacaggccactcacaggtttgggggacttcatgatgattcctagactttctgagtttcccttgcctcatctgaaaaaagggccaggacctaactgcaggttgtgagagttgaatgaaatcaaataacaacttttcagtcagtgacagactgcatatacaaaggtggtctcatacgattataatagagctgaaaaaattcctattgtctctaaagaccttccaggaggacaggatgtgaggtggcatcagtggcactgacaatcctgaccctgtgcaggcctaggctaatgtgtgtggttgtgccttagtttataacaaaaaagtttaaaaagtaaagaaaaaataaagaaaaagaaaaatttaaaaatagaaaaagcttatagaaagaatacaaagaaaaaatattttcatactgctgcacaatgtgtttgtgttttaagtcaaacgttattacaagtcaaaaagtttaggtcgggtgtcgtggttcacgcctgtaatcccagcactttgggaggccaaggaaggtagatcaccggaggtcaggagctcgagaccggcctggccaacatggcgaaacccagtctgtactaaaaatacaaacaaattagccgggcgtgggggcacacacatgtaatcccagctactctggagggtgagacaggacaatcatcaaaaccggaaggcagaggttgcagtgagccgagatcgcaccactgcactccagcctgggctacagagcaaggctccgtctcaaaaataaataaataaataaagtttaaaagatttaaaagtagaaagtaaaaaatcatagtaagataaggttaatttattattattgaagaaataattttttaataaatttagcatagcctaagtgtaatacagtgtttatacagcctatagtagtacacagtgatgtcctaggccttcacattgactcaccactcacagactcagccagagcgacttccagtcctgcaagctccattcatggaaagtgccctatacaggtgtaccatttttaaaatctttcatactgtacttttgctgtaccttttctacgttcagacatgtttagatacacaaatatttaccattgtgttacaattgcttgcagtattcagtatggtcacttgccgtacaggtttgtagcctaggagcaaacaacagcctgtaccatatagcgtaggcgtgtaagaggctataccatataggtgtgagtacactctaagatgttcacacaagaaactcgcctaagacatttctcaggaggtaatcctgtcatcttaaatgatgcatgactgtaagatctacggctgagtgcctaactgtatatcgagaaataacgctctatttcatccgtcttccgatattgaactttaactgaccatcagaccggcctgaataccagaatctctttgcaatgcactcgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcaggtaggtgggtcgcgccgccaggtgcgggtcggggatgcctccaggccggggccccgccaggcagagctcgaggccgagctctcccctcctgcccgccggccaggtttcgctttcgggcgggcagaggacgaggtgcgcggaggccggagcttccagccccggggctgcagggagcccgggggacactcgccgtcgcctcgcgcaccttggctcggggtcaagtttgcaggactccgcgctccgcactttcggtctcgagaattgaggtggggtggggggagttcggtggggggtgcgctctgcgcggtgcccacagcctatgacttgcggtcggggacggttaccatgcggggcccctcgccggccagtcccaggttcccgccaccaccgccgcggccgcgcggaggggcccctgtggatgccgcgtctcggccgccgggccccgcagtcctgcaagccgcgcgtcgcgagatccgcgctttaaaagccaaactccccgaaagggtcagccccgaaggaacatgatccagaaagacgcagcttcttaaagtaagctccccctgtcctgggtacgccgttgtttcctttgcagttatgaccatgtacagatagtgctctttgatttttcagaaataacaaaacttttaactcgtttacgacataaggtaactgaagagctctttcgttttgtttggtttttaagtttaaattctctaccaattggaatccagtaaaccagaatgattcattaacctgattgctttttttccctgtatttctcgtacatgagaaaaagattttttaaaaaaacaaaaaagatatccgggatccctttttaaaaaaattattttaaaaaacaacaacaaagcttctccaaatactgtgctttgtagacacttcgttcaggccccgctgtcttttaacccagaactgaacagtaagagtgaatgcaggaagaaagttgacggtgaatctggagtccttggtagttaaagaaaaagttaaattcaatatagttacaacaataagaaaagtatgcacacagatcttggagagattttgaacgatagctattatacataaaatattttatcttttaaatttatcagaaattatagttatttttccttttaatattcccgggtagactgaatgggaagaaacgactgacgtgcaaatattgagccttcaactaacagacagaaatttgtttttatttttaatcgaagagagaagctgggcgctgtggctcacacctgtaatcctaacactttgagagacagagacataggcaggaggatggcttgaggtcaggagtttcagaccagcctgggcaacatacggagacccctgtctatactaaacattaaaaaaataaaaataaaaaactagccagacgtggtggcaaaaacctgtagtcctagctactccgtgtgcccaggagttccagactgcagtgagttatgatcacgccactgcactccagtctggccaagggtgagaccctgtctttggggaaaaaaccaaaaacaaagaaagtgagagagagaaataaaattgttgggtgctgacattaccaggtagtaatgttcttgacttcaaaataaaatttacaaaacaaaacagtaagaaatcttttctgacccaagagaccttgatactactttcttagctcttcttagggtattcccgtcctctcctgggtctttgggctaaggtctaaggactgctgggaagaccaccttagaagatgtatgtagttacctggatactacctgctcgtaattgaaggattatctacaatgtcttctgtacaacgtgggcttactaaggttctatgactttgccactctcaggtagattaatgctttaatgctctcattttttaaacttctaaaaattttcgtctcacagctcagtgccatatcaggctgtaaaataccaaaacatccaaagaggaaaaaaaaaactcagcatgtcatgaaccttgtagggaaatcttggtatttcatttcagataaagttgtaatggaattcaaaatgtctatgcggctccctcaaggcaggtgcaacacgctgtcattcactcttggacccctccagggacagaatttcacagtgaagtttatccttatggcttatcaaactccgccctattggccattcccatatcctgttctcaggaacgataaagaaccatgattagcataatataaacaggcatttaaagtcactaagatagaatgggagatggtgacttctcaggtcatctgcctcctctgctcaaagcccttcagaggcttctactgttcctggaatcattctcagttctacaagatcctgtgtggccaactcctgcctgtctctccagccttatctcacaccacctaattcctgctatcctggcctttttctacttcccagagcaagccaaagtgtttcccatctcactcatactggcagttcctctggaagttcctactggagattcatactggcagcccctctgctagaatgctgctgtgccactctattcccagctaactcctgctcagactttggcctctcctgccaatgtgcttccctcaagaaggtcttccctagggagttcaacaatgaaaacacatggacacagggaggggaacatcacacaccagagcctgtcggggggtgggggctaggggagggatagcgttaggagaaatacctaatgtagatgacagattgatgagtgcaacaaaccaccatggcacatgtatacctatgtaagaaacctgcatgttctgcacatgtattccagaacttacagtatatatatatatatatatttaaaaaaaaataacagggtcttccctaaatccccaaagaggaaaaaagtatagcttatgatgtctattaacaaataaacttgagttttggagctttagattgcagtctaaataccaaacaacaactatgcttattagaatgacttaatggagtgagagtattagtcaaaatgtctcttctttgatacaaacatggcagcattccgtattttatttcactgagaagttattccaggacatacttcactcacacacacacatacacagggacataaatgattctagtgaactaattaaacttgcagaattattttctttttttaacttttaattttgaactaatttgggacttgcagagaagtttcagaaatagcacaaagaattcccatatccctctcacctggtttctcccaattaaaacatcttatgtaaccattgtacaatgttcagaccaggaaattaacactggtatagtgctactcactaaactatagaccttgctggagtatcacccatttttccaataatgccctttttctgtttcgggatccagtccaggatctcccattacatttagtggtcatgtccccttagtcttctccaactggtgacagatcctcagcctttctttgctttcatgaccttgatacttttgaagagtcccagttacctcttccttagaatatccctcagtttgggttcatgtaaagtttcctcaagcttagaatgaggttattcaattttggcagaaatgccacataaattgtcacttcaaaggatttgtaatatcaacatgtcttcttattggtgatgttaaccttgatcgcttggttaaggtggtctcttcagagtttcttactataaagttacgatttttcactgtgtgactaataaatattttgcagagagatactttgagattatgcaaaaatcctgcttatccccaaactcacacccaactatttttagtatctatcggtggattttgactgcaaaaactactatacctagtagtgattttttatttcactctttttttccacatttattcattggaattctattacaaggaagggtcatcatttttgcctttttaggtatttattcaattggttaagtatatcagtatggactcatggatgtgtcttcttctttcatttataatccaatactatcattatcagttttattgctcatgctgttccagctttggccactaagagttccttcagtttggctcctgtgtccctctaaggaaccccatcttttttgagcacttcattaactttctagtgccaacaacattccagactcatctagtgttttccctgccccaggcctggaattaatgacttcctcaggaagctctggttccttctattggagaaaggtgtttagaaaccaaaatctgggtgtgaggcatgcttattgctactggaatgttgtttctaggtgctctcggtggacggagctgggaaatatgtgtgtatagactaacgtagttatacacacacatctatatttctgtatgtatctgtgggtgtgtatatatatttaagaccgtgagtttgtaatggtgccactaatttcaacctaacaatcaagtttcattctagccttcctctttcatttacagcctctttgtctaacagtgagaaacccagatgtcattatctacaatagacttatttgcctgattctaatataaatattttcaggattgctaactcatgctcttatgagaaaaacgtgtacttactaaattatagcctttatgtacagttttctggtcttaagctttataatatcccatgaagatactattgaccaaagttacctggcttagtccttttttttctttactccttttggtgtggttattctatccatttgggataagttcagttcatttgttaaactgcttgtattacaatttgggttccccctcatgctagttgttttgtttgtgacatttggggcatttggcagctaggtgaaatattactgtgcttataaaagtcagagctatacaaaacggttttctcagacaagtgtggctcccttctgagccctactacctcctttctattcctcaccataccaccacctctttcccattacactataaatgtgattacgatgttgtacttacactgtcattgtgatattctgacatcatttctactttgttcttggtccacattccatgccatctccttcatttcttgtttatttttcctgaatttcttttgcaccgatgagcaaatatgtgtatgttttaagatccaggtctaaatctgatttctgtactgcagctaatggaggatttgctcgctcaagtgttctttttatcaaaaaagcatgtcttcttttccagcctctctcctattgcccttcaagcagacttggggtgatttcttatctatagatttgcaggcctcctgatctatcagcttgaggcccagccccagcctccccagagagtatcatgtacccaacatccaagcttatggctacaggtatctccagcctcactcctcacaatgtgcactcctcctgcctagaactactcagcttcctatagaatgaattcaggaaaggcagtatttgcgacctggagagcagccaaggagattggttacccatggaaagcggcatggaataggaacgacatagtagggctgaggaggaagcaccacctccctgattataccttttcgtttagctctgactcttagaaccataaggtaggacatatatatttcacttactcataaactgtgggtaaagacaataggcaagtgggattattgctttaaaattaagattttagtataaacatttcaacataaaacttttgctgtttttataattttttaatgaaactgtatatctctatgttgccttttttagtgcttggcatagtatttttcacaaaatgattgttctgtaaagttgtatggctttcttaaaagcaactttcattatatgcgttacattttaaaaatgactttctatttgcaccattttcttcaaagtacaattttaccaggtgtcattgacatgctgacttccatattgatttaaaaaaaatgatcatctgaggcttcaggcagcatatattttatggagtaaaatcgcattatccatcttaattataacattatacttttgctatcatcgtgatgttctgacagcatttttacattttcttagtctacagtttatgacataacacaaaatttgatatgagaaacatgaattaaatcactttaatcaattccaaggtctatcaattacatataaaattggagaacaaggccaagggcaatgggtcatgcctgtaatcccagagctttgggaggttgaggcagaagggtcacttgaggccaggaatttgagagcagccaggagagaccccatctctacaaaaaaatttcaaaaaatagccaggcttggtaatgcctagctgcttgggaagctgaggcaggaggatcacttgagcccaggagtttggggctgcagtgagctatgatcgcaccactgcaactccagcccaggcaacagagcaagactctgtctcaaaaaaaaaaaaaaaaaaaaaaaaaaaaaaaaaaaggagaacaaaagaactatagaaagaaagtatgctagtcagagacattaaaattaaatactgctttatctttcagaattccttttgatgtagaaactcagagttgacaggaccttaaaagtcaccccacccagctgccactctcttgattgtcctctgcagcatcacttccaagtaatgacctgtctgctgtgtgagcacctctcatcacaggatactcactaccctgcacccaggcaggcaggatgtcctgtcactgcagatttcaactattaaaaagttctttgataaaatgagctgagccttgatccttcaattttcactcactgttagtcctcattctaagccaatgaagtcatgctggacaagctgttcagatcattgaattcaaccatcacatttcctctgtgtcttctttcctctccagaaaaccacctccccagaaaactgctaggtgccttctctctcccagtatttccagtatatgttccagtttgtttgcaatatctcgggctgacttcctatagatcatgatgagactgctggtctacaacattctaaacactgaaccttggaaggttcatttaccctccaatgattcagcatcaggttcctgatgaacacaggcctctgatgtctaaaaggagccctcctttcttatctttgttgtcatctatgagacacagaccctcattcaaactcagaatttcatattagtacaatttcattttgctctggaggtgattttgtttctgtttgcctcttacagcatagggaatgaaagtatggcatagtgttttatctagaacttgtgatgatggtcttaaatgcaactaaggctactctttgctgaaaggacaatttttattgactataaatattatctatacgaaattgggtctgttttttgagggtagcaatcgctgcattacactttgcaccaccaaaatggatacttcaatcactatccactgttcaagcaaatgccagctctacccacaacacagagaaaaggcatacttagtcctgtacagacttgtggggaagctttgtttatacttcttgatttcaacatgtataccatgtatacttttcaccccgcttcttctcggctgcatagtccaaagttccattccatacagctacatttgcattttgatgacgtgggatattttggcagctatgtgctcctagttaaagcatttgtttacattatcaaccgtatttaaatttcctccttaccaactttgcagggttttcttttgttttggtttttttgctcaacatcagtcccctcatcttcactttcaggagactccagcagctcttagagcattcatttttcttttcaataaacattgtgctcattgttgaggaaagatacaagcaagcaacagacacctactctattagcttctcaaggctgccatggcaaagtgccacaaactgggtggcttaaaataatgcaactttattgcctcacagtcctggagcctggaagtctgaaatcaaggtgtcagcagggtgggttctttctgaaggctgtgagggagaatccattctgtgcctcttcgtgcttctggtggtgctggcaatcttaggcaccccttggcttgtagacacaacaccctgatctctccctgatcttcacatggcattcttcctgtttgccttcacatagtcttccagaagactctgcatgtctgtctgtgttcagatttccctttttatgaggacaccagtcatactgcatttcggcccaccctgatgacctcattgtaacttgctcatctctttaaagaccttatttctgaatgagatcccattctgaggtactagaagttaggatgtcaacatatttcttttgggcaacacaattcaactcatcacatctaccataccctcaaagacttatagaataccaagcaggatccatgggcttggcatctatggtggaaaagaatgttttctcagccacatgcagtggttcctcctctccaacatgtttaggagtctgtgtccaatgaaggaaaacttttgcagaagggtgagagctgaaagcctctactgagaatgttgagagcccggacgaggtcttctcttgtgctttccgtaacttgaccataaggcagagctgtcaatgggtacttaataaagactaaagacatttaaatttatccagcagaggagctcactcttctgagacctctgcctcccatcttggctgctctagggagcacttgccctgagaaatcctctcccttgttccaacaaagaccattttcatatgtaaggcgtaactacccatagtcttccagcccagcatccctctccctttccaacgaacccatctatgttgcagaatgtctataaattatctactaaatgctcaacttattatttttaaaattagcttatcaattttaagtgcaaagtagaatatcacatgcagcccataatgtagggaatgaggtatttgaagtgatcagatttaacaaaataggattacctcaataccccatgcatccattttgagttttcaaaacatttaactatatcccgactcagtgtaatttctaaataatccttcgagtgatttttgctcactcattcattcagtgtcatccttttatacatatggggagctgttctaggcttcagggtgaacaagaaaacaagggccctttcttcatttagtcttcagagaaatatagacaagtaagtgattgcattaaaatgtaaatgccagaattgaggaaaacagtttctttagaagcataggataagacacctgatctaataatggtgtcaggcagggcttcctataggaaggtcctttaaactgagacttataagagttgttggttaattaatatacatgtatgcatatgtatatatcacatcacattctccttactcaaggataaaaggtgaatcagaaaagaaatttgatatccaagtaaatgcctttctatgaataaataccttaaatacttttagtaaaaaccatattaattcaatcagtagtcataagtaggttgccatctatgttatataaaatatttataattcaatataaatttagatctttttaaaaatgtggtaatatacaccatggagtactatgcagccataaaaaggaatgggatcatgtccttttgcagggacatggatgaagctggaggccattatcctcagcaaactaacacaagaacagaaaaccaaataccacatgttcccactctttttttttttttttttctgagatggagtctcgctctttcacccaggctggagtgcagtggcacaatctcggctcactgcaacctccgccttccgggttctcaccattctcctgcctcagcctcccaagtagctaggactacaggcgcccgccaccacgcccggctcatttttttttttatatttttagtagagacagggtttcaccgtgttagccagggtggtctccatctcctgaccttgtgatctgcccgccttggcctcccaaagtgctgggattacaggcgtgagccaccgcacctggcccacatgttctcactcttaagtgggagctgaacaatgagaacacatggacacagggaggggaacaacacacaccggggcctgtgaggagtgctgggggagggagagcatcaggataaatagctaatgcatgcagggcttatcacctaggtgatgggttgataggtgcagcaaaccaccgtggcatacggtttacctatgtaacaaacctgcacattctgcacgtgtatcctgaaacttaaaataaaataaaataaaatataaaaaataaaataaattcaggtcttttaaatttaaatattagcaaacaaataaagctaagtcctgctatcagcatattccatatataaattaccaagtagttaatattccttttcacatacatttctttcttaaaacactaaaaatgaacaaacaaacaaaaatccaataatagcaaaatcccatggaaaggatgatttttctgagtggtagtcatctagtgggtaggagtcaggggttttgtgactgtaggacactgacctcaagatcatcggcagcctcaacaagccactgtggtctgcggctctttgcaacactcactcaaaccacagtaatcaaaaggcacacattatgctgtggcttctgacataggtactatttaccacttcctgagtcaacccagtcctttaaggactctgttaactttcatgaacaacatcaaaggaactgtcttgcctggtccagtatccaagttgtttctggaggtgttgcaatgaaacagtgaattgaatagtgtcctcccaaaagtaatttccacctacaacctcagaatatgaccttatttggaagtagagtttttgcagacgtaattagttcagaattttgtattggtccattctcgccttgctacaaagaaatacctgtgaccgggaaatttataaagaaaataagtttaattggcacttggttctacaggctacactggaagaatggtgctggcacctgcttggcttttggggaggcctcaggaaacttacaatcatggcagaaggcggaaggggagcaagcatgtcacatggcctgggcagaaacaagagagagcaatggtggggaggtgctacacactttaaacaaccagatcttgtgagaactcactcactatcaggagaacagcaccaagcgggtggtgctaaaccactaatgcccactttgtgggcattccattcatgagaaatccacccccatggtccaatcacctcccaccaggtcctacctcttacattgggaatttttagtacttcaacatgagatttgggcaaggacacatatccaaactatataagatttcatgatgaaatcatcccagaattagggtggactggtgtccttgtaagaagaggatgggactcagaaaaaccacatgaaggccaaggtgagcagagactggagtgatgttgccatgagccaaggaacacctggggccaccaggagctgaaagaggcaatgaaacatagttttctagaaccatctgagggagtgtggccctgctgactccttgatatcagacatccagccttagagctgtgagataatgaatgtccattgttttaagccacctagtttgtggtactttgttttggcagccctaggaaactaatacaagggacttggactcttctttgtgggcgtctcttcattattgccctgcttttatcctgattactcttgttttatatcttgtggcaaaataatgtaagtacctcaaagagccagtcttctgcaagtcctgttcagcatatggaatctctgttcattttactgcatttagttacacaactttatcaaggcgtaattcagccttgaagaggtccgatcctagtcctggtcaccctcaaaacaattcatcattctgatagtgttcttgatggctaccgaacacttctatcttcctggtgtgtgattggaaagtctgagattccagttgagatcatgccgtcaatctcatttgcctccaaattccaagcaacaatcagcagaagtaaatactattcattattttcttgaaagttaaaagaaatgcaacattgaaattactgtacacaaatgcttccaccgaaacagaaagtgagaacttggagccaggatctcagggccacgtggaaagaatagcaatcgggaaatcagaggatggaagttcagcccctcctcgtccactgccctctgtgggcaagtcacttaccttgaatgggctttggttttctcatctatgaaggagtagggttccatgatttctgaggcccagagatgaccactgcctgggcagtaccaggccatcacttcacctgccttgtgccctccacccgcctgagggaacctgccctgtcactctgtccttggggctggcctttgtaccctggttcccaccagctgtctcctgccactgaaactagcccctgcctaaccctccacatttcttacatttcccccaggagtctccccacattaccacctatgcaacaacacaacaatctttttcctctccacagagcttattctaattcataccaagtagataccatactggatttattttcttttttttcttttctttttttttttttttttttgagacagaatcttgctctgtcgcccaggctggagtgcagtggcacgatcttggctcactacaacctctgcctcccaggttcaagtgattctcatgactcagcctcccaagtagctgggattacaggcacgtgcgctgccacgaccgactaatttttgtttagtagagatggggttttgccatgttggccaggctggtctagaactcctggccttaagtgatctgccaacctcggcctcccaaaatgctgtaactacaggcatgagccaacacacccagcctcatactggataaccatcctctttcattttcttgatcacaacctgatacaggattatacgaaggacatagttctgtaacagtgaagcatcacttgatgatggggataccttctcagaagtgtgtccttaggtgatttcatccttgtgcaaacatcatagaatgtacttccccaaacctaaatgaaatagcctaccactacacacctaggatatatggcatagccaatttacccctaggctaccaacctgtactgcatgctactgtactgaatactgtaggcatttgtaacacaatagtatttgtgtatctaaaaatagatacacatcttatatatacatcatcttatgggaccagcatcattgactgaacgttgttttgcagcacgtgacgttatttctgaagtgtgcaccagtggtttaagttgatctttgagctagcagtgcagttacccagctacacccagctgtacattgtatcatccagggccccagcaacagcactgcttgttaatttattgtggctgttataggctgaaaggtaacttatgcaggaagggtatccagcataggtgagcgaattggatgtgcttggaggaaatgggctgttttaagtcttttgatgtccactgccattggcctgccatttgcctgcttcccacagataagtaattcgtggcaatgtttattactgataataatggcagttattcatataataacaatagttattgttaacggtaaggaacagtaaatatttacaatgaatagtaactgttgagatgggtggctgggaggaaataagtataaaaggtgagaatgggtacataatagtggaggaggtgaaggggaggtgatgctgaaagcatactccagagatgtccaaggagtgtttgaattatccctgtactgatccactgggcaaattgaaaagttactacgtctgagtattgggaaacttttttttttcattttttccctttgaaaaagaaaaagaaccaactcttggggttaatcaataaaccaaaattattttcactgcctttctcaaatgattggttaagattaaatcatttgagaaaggcaacaaaaataatgtttgttattgccttgtcccactgttcctttttctttattccttctaaccttcctaaggacaatgtcacatgtgcaagtgtaaattaaatacataaatataaaactttgggaaagctgatgatggggacatgtggtctttatgagtaaaggaggcacccagaagtgtgtgtcatgaggggaaagagttacactgttttacatcccattaatcttatttattctttgccaaatagccttgctgttgcttttcagcttactgaagtacttactgatatatgcattgaaaactggtggccgagcatggtggctcatgcctgtcatcccaacactttgggtggttgaggtaggaggatcacttgagcccaaaagtttgagaccagcttgggcaacattaatgagaccccgtctctacaaaacaatgttttaaaacttagccagtcatggtggcatgcatctgtgttcccagctactcaggagactgaggagggaggaccacttgagcccaggattttgaggctgcagtgagctatgatcatgccactgcactccagcctgggtgatagagtcagaccctgtctcaaaaaaaaaaaaaaaaaaaaaaaaaaaaaaaacccgcaaaccgctgacattttccaccataattctttaatgaaaatgaaagaatctctattttcctccctttctctaatgctcttttgtccattatttaccatttaatcatttctgcctcattttttttttaccttttctattatttttttcttgcacttttatcttgttgactttccttctgaaaatttcaagtcatgaagatattagtggaagaattgcattgcctctaggaggataaaaagaagtactagtgttgaaaatgatttgaggaataaagtgttgatatttaagaaatagttactggttgaacttggagtttccaacagctattcttttcagtactttagtggtcccaaacagtttgtctttgaccatgttctttcttttatattttcccttcctatgcatattatcaagtagtaaagatttcaacccatatttgaatctacttttccagttactatgatgatcattactaccaattgagatgttttggagattataacatgtgaagaacattaggtactcactctcaaaaagtttattttattttattttattttagagacacagtctcactctgttgcccaggcagaagtgcagtggagcgatctcagctctctacaacctccgcctcccaggttcaggcaattcttctgtctcagcctctcgagtagctgagactacagtcacataccaccatgcctggctaatttcatattattaatagagatggagtttcaccatattggtcaggctgatctcaaactcctggcctcaggtgatccacccaccttggcctcccaaagcgctgggattacaggtgcaagccaccatgcctggcccaaaaagtttattttctaaaaggtaagggaagagctttatataatctaagagatgacataaagtagtgggactggttttctaacaatggggctggcttatacaaattaataatagtcattatgggaggctacacacaaaaatctcacaacaatgaatttcataagctcccttttctcagttgcaggtacagcttggcacacactgatcagaatatcccattgagtggcaaactttcaacttgggggaatgaattttattgttgaaagcattcaaagccactttccacaagtttgggtgatcaggctgggaaatgctatattgagcaaaaacaagatgtaactatttaaaaaatgagattgaattttttttttcatgtttctaagctacttctgaagataattgtagctgaaaggaaacatccctcaaatgccatgagctaagaagtatcatgagaataatcataaaccctcccaagtaaaggactttaaagatacacactctctttagtgggtaaaattcaatagatttattttattttaaatagtctgtatgttaaagtcttacttgctatgaagcaccaacagcaaaatactaaaaaaacatgtttaagcacatagatttacttactgaggtgtggccataaagaaataacaccaatttttctgtatgacttatgtattgctcatccatataaatgtgcaggtacctggcagagaaagtatatattgatgggttgtgccccagactcagaaaatatctcctccacgagagcagggctttctgtcaatttctttttttttttttttttttagatggagtctcactctgtcacccaggctggagtgcagtggcacgatctcagctcactgcaacctgtctcccaagttcaagctattctcctgcctcagcctcccaagtagctgggactacaggggcacgccaccatgcccagctaatttttgtaattttaatagagatggggtttcaccatgttggccaggctggtcttgaactcctgacctcaggtgatccaaccacctcggcctcccagagtgctaggattataggcgtgagccactgtgcccagcccttctgtctatttctgtcctcaactgtacccccgtgcctatcatatattctacttctagcccatagtaggtaccagtaactatttgtcacacgaatataactatgaacagttccaccaggaaaagcttaaaagaataatacttgagtttacctcattgacttttttatatctttccttagaagccacaatctttaatatgcaaaattgatcttggtcatataatcttttcttcccacaacactgtacttgggagcatttcccacttacctaaatgtaagtatcccaggcgagagccctgtcttggccagcacacttgggcctgagcatccaccaaatggctgaaaaaccatgggcaagtcattcaacctccctgggcctctatccactaagctgtaaaatgaggatggtaactttggaggacaatactgagcgaataattcctgagctctttctttgtgccgggcactgttccaggagctctatgtgaagaatcttaatcattgcaacaagcctaagaggcagatagtactgttccattttccaaatggggaaattgaggcacagaggttaagtaactggcttgagggcgcatagctggtaagacgtagagcatggagtaggctccagtgtgaccctagaactttggttctggaatctctccctgagctactcacataaacaattactagcaaccattgggttagggcagttggcagtaccttgtaagaatggacagtattattacagagaaaactgaggcagcgcaccagtccagcaattagtcagagaaataatagtgaggtggtggttaggggaagaaaatcaagtgcaacggaactaatgctagcaccgaatcgtgctctgtcctttatagacgacagttgtgcagcttttttctcaggtaggtcctcactgaatcatattgtaagtgctgtttagaagacttacttttcagccaggcgtggtggctcatgcctgtaatcccagcactttgggaggccaaggcgggtggaccacctgagaacaggagtttgaggccagcctggccaacatggtgaaaccccatctcactaaaaatacaaaaattagctgggcgtggtggcgggcgcatgtaatccccagctactcaggaggctgaggcaggagaatggcttcagcctgggaggcggaggttgcagtgagccaagattgcgccactacactccagcctgggcaacaagagtgacactccatctcaaaaaaaaaaagaagacttactttttgtgggaacttgatatataattaggaagaagaagggagatcaattaatatttttcaagagaaaggattcgtaacttgggacagaagaaaacatgccgttcctttcaacatgatgaaattaaaacaatgcttaagataatctatgtgaagccagtcatacctgttttgctcttcggcggttagaatgtcattgtttacaacatccgcttcctgaaattagtcaatcatcccctggtgtttctgtactgccttttaaccttgttcccacagtagaaaactcacttgggatggaaattttctttccctacaagcctatgaaggtattttcctatttaaaaatacacataaaatatgtagcaaccacttgccatgccatgggttactgtgccttcattaaaacgcagctgttgagtatcttctgactgtgcagatcctgtgtgtaatgtaagcttaccaaggtgaattcaagctacacagatttggtagttcaagctgttccacttcaattcaatgctcatgtgaatctaggatctgccatgatttatgtcagcccgaagagttcctggtcagttcatttccaaagcatttatttgccagacactgagaatacaaagaccttataagacctggtgtccaacagatcagagcctctgattccttcacagcttcagctttagaaggctaaagggggtaggacatctggggaccttttctgagcaaggtggagcagggcttctgaaatgctaaggctgccccagttggtcataagcttcagaaacttgaatggtcccaaaggggagtctccagaagtgatcacatttggctgtccagtctcttgcgatttgtttgctttctgtactggttaatgaatgtgctggccataacgggaaagtctaaatgcctcagccacaaaagacaggttgggttaaccacagaggctgattaccctggctgtttatgagttcaccctgagaaccttacccttttaactggtgttcatcaggcactcacgtatgcgtaggcttttccttgagtacaactaaaaagaaacaacttttactgtcagacatataattaaaactgtaacatacttagatggcaaccctagtaatcactttgaggccattaggaaaaggtcacaaaccattttgctatacttacagacctgtattcaaggtaactcttagaacaaatgtagcagctgcattttataaaactccactaatgataaatttacccatttagatctatcttattaatccattatcttcctactggaaggacctgcgagcaaacagagaactttttcctttggtgctagagcataaatgaagctgggctagaagaatttcccaaagaccaaatgcattagttcattccagctgctaaaacagaatgtgatagattgagtgaattataaaaaacagaagtttatttctgacacttctaaggctgggaagtccaagatcaaggcagatttggtgaatggagagggcccacttcctggttcatagatggtcatcttctcactatgtcctcacatgttggaaggggcaagggacctctctggggcctcttttataagggcactaatcccactcatgagggctctgcccttatgacctaatcacctcccaaaggccccacctccaaacaccatacattgggtgttaggatttaacctgtgaatgttttgatggggaggaggaacacacacattccatttatggtgccaaggtataatataataaaagggaaataaacactgagaggggacacaaatctctatgtggcttacaagctacaggaaatcaatcattacctcgaagttcattaaatggatagttccttgccgactcctcacaactttgtgaaggcagaggccatctttaacccacaactcaaaggggcatcctcacatatccttccatcgttcaaagctcaaagggagtccagagttgatgacccttccctcagtcttctgagttctgcttcctctggaaagatcagtctcctgcccaggtgtctgtggtcaggattgctcactttagtggagaccacacacaccctacacatcacagcacaatcatgtcattaaaatagcacaagccagtatttattcaatgatgcacacatggaaaaccaaggggtctcttagttccaaaagaatgctagaggcagaagggacctaaacgcaaaggtgtgaaaaaacagggtaggttcaagtattgaaggtattttggtgtggctggtgaacacggtgcatttggcagaattgcaaaaggagacattggacctgcccatctgaagaatttgtgtaccaaaccaaagtcatgatggtctggcactccccaaacataaaactatgtgcaccaatgcaatggctttttaatttgggatgtgaaatctcaaatatctcagagaatcagagccgtgcttccagaccataaatctatttgttaaaatgcatttgttacccataaattggcacacatttcctgatagcaatgtgggtgtgacatgttttcactttggtgttgattcaatgaccttatcagtactagcaggttagaaaattgatttctctccattgaaatgtttattcaggaatctttcatcatgcttttcaaacttgaaacaaacacagtgcctaaaaacttcgcaattttttttaaactaaagagaatactagttatcaaatcgtatttcttttttaaatgtactatttcttttcctttaaataaaagtgctaactcttgttttgttttgttttgttttgtttttagatagagtctcactctgccacccaggctggaatgcagtggtgcgatcttggctcactgcaacctccacctcctgggttcaagcaattcttctgcctcagcctcccaagtagctgggattacaggtgcctgccaccgtatctggctaatttttgtatttttagtagagacagtgtttcaccctgttggccaggctggtctcaaactcctgacctcaagtgatctgcctgccttggctttcttaagtgctgggattacaggtgtgagcccacacacctgggctaattctattttttatcactcctttgcatcatcaaaatagataaaagcatgagtattccttgctagatcttcatctgttaattttactttcacagcacagccactctcttcctgatgggacctgtgcagttctgcttcatcggcaggtcccacttctagtttgaaacttgagttccaagcttcccatgcatctccctctccacagcctgcatcttggtgcacaatggagctactgcagttatggtctcactggcttctcccttctcctcttggtctatacagtcttttctcccttcagcagtgaagtgatccatttgaaatataaataggttcatattttcccctgcagcaaaggattcaatactttcccatgaatttcaaatataatccaggcattttcccagagtttagagagatgggggatctagctcctttgtactccttagatttcatcttggccactgtcctctttgtcagctttccaaactgatattttgacagttccaaagacactgtccttttggataggccctttcccatctcagtgcctagaacactgccctctcctaaggccctgtgtatttatgggttctgtgacccaccactccagccttactccgttgcttagtctgatcaccaaatttttatgtatatatttgtttttgttgtttactttttaatgatgtctctcttcctactaccctggaagctctgcaagggcaggaacttacctgtctattcaccataagatatccacatggtaggcactgtgttagtattcaagggctgccatggcaaagtaccaccggtttgctttaaaaaacacaatttattctctcacagttttggaagctagaagtcaaaatcaaggtgttggcagcaccacactccttctgaagactagagaagcctccttccttgcttcttccaactcctggtggtcccagtcatttcttggcttgtaggtgcatcactccagtccttcgtcttcacatggcattctccttgtgtttctgtgtcttcccatggctgtcttcttataaggatatctgttatactgaatcaggagcccacctgacttcagtatgatctcatgttaactgtatctgcaacaactctatttccaaataggtcacattctgaagtactcagaggttaagactttaatatatattttatttttatttatttgtttttgcaagagaggaacacaattcaacccataagcgtacccaataaatatgagttgaatgactgaatcagatgagtgtcgaactgatgtttctcatcaatacagataggattgactatagtatgatttatatgggagacaaagagctaaagtccaaggccaaggtgaaatatatgtgtccatatctataaatttaactgtggtttcaaattaatagaaatcctgttctcggcaactaaacataaaccagagtagagtccaacacaatcttctaggaatccctaccttcgtggtcaccatatcatctggagaacgtgtcaaaagaggaggagtttctgcttgcattccctaggaccagataagggaggacatattctggcaggaaaaggaacggacctcctatgacaaaatgtggtgggatcccaaaaaatttgctgaacagattagtatctaacatttttaaattcccaaattatttgatgtattaatatcatagattaatacatgttttctcatcagccttttcttatctttaaattctgcttaaattctacttggtttacaatgctggcatgtgagtgaggaggttaagagtatgggttctgaactcagctcctccacttactagctgtgtgaatttgtggcaacttactaaactcctctgtgcctcagtttcctcatctgtataatagagatgataacaatagtacctaccatagggctgttatggaaactgaatgagttggtttgtgtaaagcacatagaccatcctggctgtgtggtaaggattaagtattagcgactatttttatgatatgccaaccaacttgctcatatcgactaaatacattttaacatataaaggctttcacaatatttattattattattaaaacagagcctcttagcctgtcataagtggatcccactttcaacattttattttttgagacagagtctcgctctgttgcccaggctggagtgcagtggctctctgcaacctctgccttcctggttcaagtgattctcctgccccaacctcccaaatagctgggactacaggtgcccaccaccatgccggctaattttgtttcttgtgtttttttttttttttgctagaaacagggtttcaccatgttgcccaggctggtctcgaactcctcacctcaagtgatctacctgccttggcctcccaaagtgctggggttacaggtgtgagataccacgcctggccacaacattatttttaatcatacccaaatatatgataccatttccaggtgaaaccagaactaatccaaaggaacaagcagtccatgtgagagaattcttttaactcctctttgcagaaaagtcaaacctctctgtagtaagaaccatctgtttccattgatcaaagacacattattaaaagtccataattaacaaaatactactaatccacagcaatttataagcatccatttctgaaaataaaatgtcgacaagcagagagacaagatgtgctttgcctgatctaaggaaagatgactaacgtggcttaatttgttctgatttaaaaaaaaaaaaaggtttcaaaaccagcagaccatgtcataacaggaatattttgtgtcctggagagatttagagatgggctgatatcaagacgtgacctacttttctcatgacaggtctgcccctgaataatagtttgatttattgacaacaggatgatccaaaactgaaacattttctgcctctgccatcagaaagataacgtcaatccaaaggaagaacctgcaggtctaaaagctgtagtattttttccccagatgcagtgtacaaaatataacattcatttttaagtggatttctgttaaagatgtttattactctgaaatcttgtcagcgtatttgcaatgagcttaactaagcatttgttttttaaaaaaaaattcaaaaagtttttactgtgatctttacttgctattaaaaagatagtaagtttctggtcttctcctcgggtagtttttaatttttttcataaacataaaatcaaactattagaaagaacatttctcaaaattattaaggcaagagccatttattaaattattgggaatggagggttttttttttttttttagtgattggtctgtcttagatgctttcagttttagaatcattgttgtattcattctctactattaggtaacaaattaccttacacttaatagctttaaacaacaaatattatctcacatattttttgagggtcaggattccagtaagggcttagccaagtggttttggctgaaggtctttcacagtagtgtagtcaagaggcaagctggggctgcagtcatccgaaggctggactggggtcagaggatccacttctaagatcactaacgttcctcttggcaggaggcttcactcagttcttcagcagctttgggaagcctcagttactttgccacatgggcctccacagggccactcacaacaaagcagctggtgttgcccatgcaaatgatccaagacaaagaaaacaagacagaagccacagtgccttttatcacctaatctcagaagtgtcttttgtcatggcttttgtcatattttattggacacacagaccaacccaggcacaatgtgggagagaatgatacaacctgtgaatgccaagaggaagggattattggaggccagctaccacagtcatggtgatagataagatttacccataatgtagacgtgcaggggaggcatacatagttcacagcatttataatgaaatatattctcttctcaaagaatagaatggcataagaacattattttttaatgttattattgtcacattattcattctgttggtttaatatcattaccagagtttgctaacatttcaacaattggcatagcatttgtgaaggaccatttagacaattacaaagcattaatcaaactgtctactgaatcaatgaacattaattattgacagaacattccagagtatagtttatttcagaagagaaaaattgctttgtttccttatgacagcaaccaaaaaaactaaattaaaataaaattgcctgtctatttcttttactccaagttatttctcaaaacttttttgggtatgttttaggcatcttgagagctctgtcatttctttactcacattaaaaaaacaaatagggctgggcgcggtggctcatacctgtaatcccagcactttgggaggccaagatggcaggatcacctgaggtcaggagttggagaccagcctggccaacatggcaaaaccccatctctactataaatacaaaaaaattagccaggcatggtggtgagtgcctgtaatcccaactatttgggaggctgaggcaagagaatcatttgaacctgggaagtggaggttgcagtgagctgaggtcatgccactgcactccagcatgggcaacagagtgagactctgtctcaaaaaaaaaaaaagataaatagaatacagtgttgtagaagataaagatttgtacagattgaaccttgagacgatatgcctggactatactatctaagataacttctgttttctatctccaaactcatgttgccacaaaccaaaatgttcaatttccttttcatttctataaagccatgttttgacaatgtcttccaccagtgatattataatgcacagtctattttattttgtataagatgctaaccactcttcatatgttaaggccatctaaaaatgtaggccacagcattttagctctggaaagatccttggcaatttttatgttaaatgggttccacattttagaagagctgagaagtgttatactcaatgtgctgcctcctcatgttctgttttgtcttcaaaaatctgattaaaattgagaacctagtagtaccacaaagcagtattaaatcattgataaatattcactctatgtaatctccagaaaataccaacaccacttgctacccaatggttccaaagaattacaagaagaaatcaaagactgatgttgggcaggctatgtccttttgagattcccctacccctaacacacacacacacacacacacacacacacacacacgcacacggcagtggtcaattgattgtgcttctctgtaacattttttaaaaaaataaaacaaaattttttaaatgagcaaggttaaaagtaggagtcatgacaattataacacaagcatacctacactcagccatctttacactaaagagctaattttgcttagaatcagggtgatattacaaagtttaattctaaagtaaataatttttcttttcacttggcttgcaaaataacaatacattgtatagaactaatcttaaccaaggattacctcacacataattcctttctctgacattagtcccagctactttactcaagaattatgatacttagccaagattggacctgccatcagtgactgaactaaattttatttcctaagtttgattggcagtattaatattttatatttttcaagttcattgattgactagaatgtgcatatttgtgacaggataagttgttcataaaacctgattggttatcactccgtgctttgtgatctttccaatattttaaattaatattttgattcctacatattaccactgaattttttcatttactttaatccaaggattatctttgctttattttataagaaagtagcctctcctttccttttccaagtttttagtagtttctcaattctttaccatttctctacaaggatttctgtaaattaatcctctaggatacagtttttcttagagtgcacctatgtgaacatatcagtgtttatttaaataaattgtcttatttcattggttccttttctaattattgctttactatattcattagtaaaggcagtcccaattctaacctttgaaactctggcctctcggggtcacctactctaaattttgtttttatatttaataaagagattgttttagttctctgctgtgcataacaaactacccccaaaacttagtggtttaaaacaatcattttattatttcttaaatttctggggattaactggggctctgccagatgattcttctgctgatctcacacgaggtctctcatgcagcttcagcctgtgacagaaggggctagaatggccacagtaacttcattgtggccccttaattggaaggctgggctcagctgggacaccaggacaactgagcctctcttcgtgcaatctctcagcatggtctctccagcaagttagctgttattttacatagctactcgggaatttttttgaaaagcaaaagtcctggcttagtcccagagccacctctgccacattctcttttccatttcagagatgttacacagggaatgcatactggaaggccgtattgggggccatctctggagactagctgctacaggaatcatgttttccttttctgccactaagacctcaattcctttctgctcctttttcagttccctgtgtctctggtggtttgcctaaacctgcaaacatcaccttcttatccatcaacatgaagaatgtcctacaatggactccaccagagggtcttcaaggagttaaagttacttacactgtgcagtatttcatgtaagtttcttcttttccttttggctagcttacaaacacaagactcagactcttgtgaattgtgtaaagataaactctccgtggtattaaatgtgtttgaaaaagagaaaagttttagatatttcaggttaagttttcttgatgttttgtaagattaaattagaaaacagtttcttcatggagacagaggcattggggggctcaggcgaggcaaggttatttagacagagaaaagaagtttctaataataaaacattattaggtggctgagcaaacaaggcaatccatcatcttgaaatttctaagctgtttggaattataggcatccttagactccttgaaaccgcgtgcacatttggtgtgatcagctgttgcacttaaagatagcagtgaatagacatttcatctggccctcaaaactcattgcaagcaggaaagaatgcaagacagatagtcagtgtccatcttcagagaaacaaaggaaatggccacaaccctgaccacaaactaggaaccatccaagccaaatcttgtggaatctgaagaaaaacagctgcagaaactgaaggcaaacctacctacaccttcccagctccaaccacaggaaatgatttcacaaaataagtatcacagtgcaaagaggcccacctaacaatctgagagcatggaaatctaaggattgccaccaccagaaattaaggaaatgtccccatggagccccagctgggtgccacagaatatcagaggtggcgaaactgaaatagaaatcaggcacacaggacatgtccattgtggaggccctgtcacagcccagggagaagctgggaatgagccggggtcaggaggaaacggaggtggcactggctgggaggcagcccaggaaggctacaacatcagcctcctgcagcccaaaacctgagggcagacaggcttcacagggagcaaagggaataatggatttggtgagagggtgtttgatggaaacagaagtttaaaattatggagagcgttggccggacacggtggctctcacctgtaatctcagcactttaggaggccaagacttctggatcgcatgagctcacaagttcaaaaccaacctgtgcaacatgacaaaaccctgtctctacaaaaaatacaaaaattagccggtcatgatagtgcatgcctgtagtcccatctacttgggatgctgaggtgggaggatggcttgagctggaaggtggaggttccagtgagctgagatcatgccactgctctccagcctggacaataaagccaagtcttttcacaaacaaacaaacaaacaaacaaacaaaaattatggagagcaaaagctcattatctgagccctattcttatatccatttgcctgttcaacaaacagctggccccactcaaaaagtaatagtcccaagggaactagcatagcgcctattcataattactggaagggggaaagaagaaaacagaatacaagtttccagaaagctttgctatggaagtaaggaagaattaaaataaataacagtccataattttgttagagtgcataaacaacaggatctgtaaaggtaaaactcaaagaagagaaaacagtgaaagaagagtttctaagacaacagggagaacatgcttttttttaaggaagtgtgcagagcttaggaaaatgctggaatataaaaatactgtatcaagatgaaaaacctgttagagctaagtgatagtaatggttgaacaggtaataaaaactgtttggaactgtgtatcataaatgtgtggtgtgtctagaaaaaaattggtaaaaacaatagcaagacatatcctggtgaagttattggactttaagataattaaatgattcatggccattttagcaaaagcagaactcaagttgagagaaagggagaatttcaatctggcaacactcaacagaatatatcttgtgaggaaaagacaagtataacctaagactcttacgaagttcagtagactggtgtttggaagcaggtgggaactcaggagatcacttttctgagatcttcctggaggatgaggtggagcactaactaaagacgacctccagctaacagagagataaagacaaacccaaaagaagaacttagtgatgaccaaaagactggtagcatgcatggaattcatctcagtgtagaactaagactaaatagtgatggaaatgtaattatagaagtttcttagaaataatttgaatttaaacaataatataaggtggaaaagggggggggaactataagtgtactgattttcatagccagaagccattaaatgtcatctaaaatgacaatattttattattttaataattaacctctcaatatttttcacaaaccattttcttaatttaaaagctcttttaggaacaaatatgtcttgtggtgacaaacatttgcacttctgtagtttctttaatctcacttcaatttcttttttctatcaaagttcaaggcacattgaactgactacttttattaaaaccatatgtatggtataatctaatttttgtccatctattctgctatcatatcgtccttctgtttatacagaagcacaatgagatatccagaatcatacacaccaaatgttccagggtaatgggttttaggatgatttgtttctcttttgattatactttctgaattgtttgattgtttgaattaaaaaaatttaccatattttcaaaaaagaataaagtcagttttgtctttgaaaaaaaaattcagataactaaaaccagtgaaagacttcagcagcgactcacagtgacctcatttatctagaacctcattctcatttccaaggagtttctcaggagccagtgttagaggaaagaaatcactttgcagagaaaaggctcgtgagcatgtccttgcctccttatccattaggtggagcaaagagcttgctctgtcctttatgttttatgtgatccagaaagggatttttaaaaaatagacaagagtcatcactgcttcgtgtgagcagatcactcagattgtgcaacttttaaaaatatgtttttaaaaagaagcttgcgatgttggagttcttacatgcctgtgcatgtgaaagagggacaggaatataagacaatgtatttcactgccagagggctccaatctcagctctggagtcagacagtccccagttcatagccaggctatgaacctagctgggaaggttacagattatacttttatacttttgagtgaagtttgtttccaaggtgaaaattttccaaaagtttaaattctatccaccaaaacaattaatgcaaaataatagaatgtagcactaaaaacagaagttttggcgtcagggaagagtggttcaaatcccaggaatgctgtttactagtcatgtgaatttgagtggatcccttaatctccctgagcctcagctgtctcatctgtaaaatgggatgaaaataagagtacctaccccctagggttgttatgataattagtgagataaagcttgtaaatcagagaccactgagggccccatatggctgtttgccatgcgtgagtgtcattactggaatatttgctgagtgattctggtcatcattcatttattttgttgaaaatcttgtaaagagccttttctcctgcatcagcatctgtcatgggaagctgccttgcctttggcagagtgaggaagtttgaggagggaggggccacataggcaatggcaatagtcttcaagccacaattcaggactctttgatgactcatgaaatgaatgttgagggatattatttttaatggaaaggaatggaatggtgtggaatggactggaatgaaaaataactgaatgcaaggcatgtggtaaagtttaaatattttcttgtacaatttttgttttaatatgttagatagttttatattttgtgagctgaatcacaatataaaatgtatttttcttttccctgtggatcatggtcaaaaaaaaaaattgaaagcccttaagtaacagtgatcacttggatggagaagttgatcagtaagatctgactatatttctgatgtcttttggtaggtatggtacttaggaaatgggaaacatttactttcagaaatctgttgccatattctgaaaagagaaaatatccttaagctttggcaatacatggacatatcctctttctcaagacgcactcttcccttgacctttatgatatttttttctcatccctctttagttgctatttccaggtcttctttctatccaacctttaaatcttgacgctcctgaaattttatcctagactttattttgtttccatggatcattcattcatgcttgtgccatcaatgagcagtttgatgacattgactccaaaatccctacctcccacacacatgtctctcctgagacccattgcccactgggcatctgcagtgggatatctctaacatactcaggctcaaggcatcaaaagtgaacatcttatcttcccctcctgctctgcctccccatccatttcccaaatctgttctgtctcagtgctctttttcgtagtaaatatcaccaccattccacccatctgccccagacagaaagagacagcatccttaacaccttcatttccctaatctgttacatgttttctatcaccaagtcctatctcctaatatttcttgcttttgtcctgtccttatttatcctactgcccctgtccttgtccaagcgacctacatcttcccctggaccactgtagtgtcctctcagctgttccctaggctgccacttgtaacccatcacctttcccaaactgcctcccctgtccctttcactggcttatcacatgttacctgaactctacacttcagtctctcccacctgaaaagggctgaaaatattgccacctccctatttgctatgggggttgtgtttttaataaagaaaaggaaaatcagtatgaccaatctagtcaatattatcatcatcactataattatcaaaaatgcagatttctgtatgcactccagcctcatgtattttccctagaatcattgatacttagatttttatatgctatgagaacgtcaaagtaatttttcttccaagaaaaaaatgacaaactgttcttcaaacaatccgtcaaactgacctcgtgtacatagtagactaaaaacctacacagataattactagaagaattgatcacacaatatgtaaaaatttcactgtagccaaagaataacagtaaaatatatgcttccaaaatatactgtccacattataattcacagaaagaaaggtgattacagaaactctgactcatgttcctgacagctgatgaaaaaaattgcccgccgcaaaagtggattcttttttatctcaatgacaggcacttttgtttttctgaagagaaggtcgtcagttccattcagttttataaaatgactgagtttttttattgtaaagtatagagggcacctcattattaattcagcttctttcttagcagatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaagtaagtaatgccattattgcaatggtcagttaaacatgtattcatatcaggtttaacagtctcagcctcacagacagccttgcccagaggaaggtactctgcttggctgtattctggaccagtgggttgagtgagcaggacaaagtccttaaccttgctggctctgagtctcaccttgattgactgattgattgattgactgtagagacagggcctcattatgttgccaggctggtctcaaactcctgggctcatgctatcttcccacctcagcttctcaaagtgttagggttacaggcataagccaccgcacccagcctgagtctcatctttagagtgaaaggtttaaccaagtggtctctaagatctctcccagatccaaaattgatactagatgacaatgatatcaaattttgactttgtcttactactttgtggaagctatgtaatttgaggaacaaaatgactttatttaatgtgggtttatggactattaatgtctccacaagattgattaaacattgtcctgattatccactatgcttcttcttgtatgaacttggtagtgtgatgatgtaatttccaagtgtaacccagaattaaggcaacttcttcctggtatttacttttaaaatgttgccatcccctgagctatggctgactcagtcatgaaggacccactcagggctgccataatgagctctgcaagtgctccataagtccaggagcccttccggatcagaggtcagaaaactacccttgggacaatccaacaacaccctttctgtttttctacaagccaagagttaagaatggtatttatatttttaaatagtttctaaaaatccaaggaatattttgtgacattggaaaagtaaaggaaattgaaatgttgatgtctattcataaataaagttttattgggacacaagccacactcatttgtttacacagttaccttagattgctttcgcaatacagcaagagtggagtagtgcaacaaagatcatatggcctgcgatgcctgaaatatttactgtccagacctttaggataaaagtcgcctggtctctgttctagatcattctaatcacatctctgattttccacttatcaagtcatgttgttgtcatttatcaccaacttttcaagtcacagaaatcttacaaacagttttgattgtattaaccatctactgtttatgcatgtgactaaggaaacagaatacttgagtttgctgttctaacatgggatcaggctgtgtgaaggttggtttcaaggttggtttcaggatggtttcaagatctggcatatctcaggcccaccttagtacattttggggcatctcctgtaagaaggtgtcttttaaggctgggcgcggtggctcatgcctgtaatcccaacactttgggaggccgaggtggacggatcacaggatcaggagttcgagaccagcctggccaacatgatgaaaccccgtctctactaaaaatacaaaaattagctgggtgtgttggcgggcacctgtaatcctagctacttgggaggctgaggcaggagaatcgcttgaacccaggaggtggaggttgcagtgagccgagatcatgccattgcactccagcctaggcgagggggcaagactccatctcaaaaaaaaaaaaaaaaaaaaaaggatgtcttttagggccttgatccaagtaggattatatggtagctttacctaaggtaatttttcatctgaacatgataataccctctttctccccctttaagcacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacggtaagcctgaaatggaatggggcatacattcatgtaccactctgtagctaatgtgggaacaaacaaccctgatgcattgattctctgcatgtgaatctgggaagtcatgatgttcaaaagatacgccgcacaaaataaagttctatatacagaaattttacagaactaacttcagatcttctttacagaaactctgttgacaggatatggtgttgttattggagtgtagagagattgtacacttcactttgatgaagagctttcacttgcacagtctttctctgagaagaagaaaaaaatgtgagcaaggacccaggacaatgaataagaactctatccatgtgttgtttagaattgttctcagcattggtccagttcctgaccatgctctgctgagctaaaggaaaagagtatattgaaactgttgctgaaaaaaaaaaaaaaaaaaaaaaagcttatactgatagtaaagaattaaatggtgccttggtcttctatttccttctacagttatttgtctggggtggtcccagaaatgtctggctctaaccaatgtttgcaattccctatcctagtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaaggtaagctttaaaaaatctttgctggtctaggaaggagatctgctaaaactagaagtcggtatgatggtttagacaaggttttgacaaatccgtgtctaacagaaacaggttgaggcaaaggcagaaacaactaccaccagaaatgcgtggagcagcctgggactctgccattgagcttggccgacgttcagaagtgttctcacaccctcggagaactcatacaggtcccgtgtccactgccagcttctttccatggtccttcggccacctgccttgtgaattaacaatgaagaacttttacacatgccttttttcttctttaaaatcataatcacgctgggcatagtggcccacacctgaaatttcagcactttgggaggccaaggagggaggatggcttgagcccaggagtttaagaccagcctgggcaacatagtgagacctcatctctataaaaaataaaatcaaccaggcttggtagtgcatgcctgtagtcctagctactcgggaggctgaggtgggaggatcacctgagcccaggagaggctgcagtgagccataggtgcaccactgcactccagcttgggcaacagagtgagaccttgtctcaaaaaataaaaaataaaatcataaccactctgattgatagaaattctgtggtcttcaagaacatcagacaattttattgctagaaacaaagcgttattctaaaaccactgtaaagcagaattcattttttactttccctggggaatactaattataggtgcttccagttgtgttcaagtgccactaattggctgcatgagggtctgggatccacaaatcagtgatcacttccttatccttacagttgcttctctctatttccttttatttatctcctcttcacattttctacactgggctgccaaggaaccgtgattggagatacccattcctatgagaagacatagagttgtgagcttggcatttgtttaatttttctgccttcacagtgagaggagctttaactaaaaacttgaaaattgaaaaaaaatacatcctaaagtttgcctgcatcgaagggctcttcatccattattcctccgcttcttttccaaacagctggtctagagacagaggcccacgacctccaccccatgccttggctctatcaccagccatggataggaatccataacccctgctttcctcctccctcacccctcccacctttcacgatgaaactgtccgaaagtaaagaaagggaactttgtgagtacatgtgaaaagcgcaaggctttgcctttgactctctgtctttatcatagcttttcttttacaatgaaggagtctctaccatatatcaaatgaaactaaaatgccaagcaaaacaaagcatattgaagaaatcgtatttgtatttgggagaagtgctctctttactaacaccttgatcagtgccagctggtgggaatgaatttccagtggaaatcattaacacaattggagcaaaagcaacaaaatgcagattaaattcaaaacttctcagtaagcagatgaagcccactttctcactaatatgaaaaaagtggccaagtgcaatggatcacgcctataataacagcactttgggaggccaaggcaggagaatcacttgagcccaggagttcaagaccagcctgggcatcatggtgaaaccccatctctactaaaaatacgaaacttagccaggcatggtggcacacacctttagtccaagctacttgggaagctgagatgggaggatcacctgagcctggggaagtcaaggctacagtgagccgtgattgtgccactgcactccagcctgggcaacagagtgaaaccctgtctcaaaaaaaaaaaaagaaagaaaaattaacggaataataaggctctatttctggttctgaacccgtgctatcccagctgttagaccaccagagatatctttccaacacactggtgtgaggacctgctttctgaataatcagtattacctctattggaactattctttaaaacatatttctgctctctcgtcccccatccctaaaatacaattatagtttattaggtttgttgtaataaacatgggttagtgtatactaaatgctatcagtcattgttatgacttttttcaattaggacaggctcaatccagggaccagggattgtattaagagggttggactgagttataggctacaagcagggcaggtggtgttctgacacccgcagcatccgcatcacagcattggcacgtctctgtgtggaacctggtgatgaatgtgctccttgggaattgtgcagggtaacaggcccgcatgcggaacttttcccaccggctcttgttgaccaccctcatcagccatgacacatctgtttcgctttcaactggatagttaaccagatagtgactttgctgctttctcttgggcccaagcatcaagagcatccaacattctcctggattagaatgctccggtcacactcctgctggttttgttagtgtgtaaggagcacactcggacttttgtcatttgtgctgaagctgctctttttcctacagctgtatcagtcaggattctccagagaaacaggaccaatagaatacatatagatgcacatatcgatacatttatttgtttagaaatattgatttattttaaggcgttggctcacaggatcgtagaggctggcaagtccgaatttataggataggcaggctggagacccacggaagagttgatgtttgcagttcgcacccaaaggtagactcctggcagaattccctgttccttagggtcatcaagacattttttatgaaagtcttcaattgattggatgagactcacccacattataggtagtaatctgctttactcaaaaacctgctgattgaaatgttagactcccattaaaaacaacaacaacaacaacaacaaaaaccttcacagaaggctctagaataatgtttagccaaatatctgcatactgtggcctagccaactggacatgtaaaatgtaccatcacaacttccaagtataccacagtggcttaacaagtatgagctagtcacaatgagctctagtcatcagctatatggcctgattaatggtgtgggccagggctgcttttattaaaacgatttcccaggtcttttcatttcctctgcggacttttactcatcatgagcctacagcacagcaggcccgggaagggagttaactgccattcgcactgcaccctgtccagccacctccctacacacatccccaggctccagccctacccagaaagtccagccaaacagtgcaagaacagttctgctactcatataaaagtggcgtcatgcattcatgtctttcagtgaacatgcagaaagattgagtcaaacaggtggcgtggaaaagtggagcaattcaatgggatcttcactggagggttttgttgtttgtttgaaattctgtgacttacttgaatatcaaatacatttactttgaaatataagaacctgcatgaatctcatagccagacatacgatggtggaatatgtgctgacttggatgattgatgtattcttagtgtaaacatttgaggtacactcagatgattccttcagactgtctcttgtcagggagagtaagaattctgagaccgcttataacatttagcttaagcttctcaacgtagaggtgagaaaactgagttcccaaatgtaagtgatctgcacagaagcagcttaacgatacgaggtttttcccatcacatcaaatcacaactatctaatcccttcccccgaattcccaccttttttttttttttacagatcaatcatcagagttcaaggctaaaatcatcttctggtatgttttgcccatatctattaccgtgtttcttttttctgtgatgggctattccatctaccgatatatccacgttggcaaagagaaacacccagcaaatttggtgagtacttggtgtggcagggttctttattataatagtacacctccaggaggacagaagaggaggttctagaacagattcagttccctttaagggcagagtgaatttaaagttaaatagctggtgaattaaaaaacagtttctgggctgggcatggtggctcacgcctgtaatcccagcactttgggtggccgaggcagttggatcacttgaggtcagaagttcaagaccagcctggccaacagtgtgaaaccccatctctactaaaaatgcaaaaattagctggatgtggtaatgcatgcctataatcccagctactcgggaggctgagacaggagagtcacttgaacccgggagaccaagattgcggcaagctgagactgtgccactacactccagcctgggtgacagagtgaggctctgaggctctgtctcaaaaaaaaaaaaaaaaaaaaaaacgctttctggattagctgactaacagaacattttccttagctttgaaaagatgttctatttaaccaccagattatacaaggtcccacagataaattcaatcatgatccctgccctgcccttctagaagttcaagcctagtcgaggactagaatttcaaaataacacatgaaggctaagatgagagcaggcgctgggaattctgggggtacaaggagggccccaaaaccctacacaggggctcagctctcatgccagggcttggctatgagaggtgagtaggagttaggatccgtagtgcaggcagaagaaacagcaaggtggatgtgtggaaactgcatgacacccctaaacaaggaggctccagatgaggagctagagaagaagatgagactggagagtaggcagtgggtccaagtaaggggagagctggggtgctgttctaaggagctaggcctcattctactggcaaagagaaatctccatagggttttaggttaggagcatcatagtcagtatcaaggtttagatccaaccagatattagttccaggaaaacttagagcggagtaagactagaaacaagaaaagcacctagggaactgtagctttgtccaggggagagaagattcaagtctaacaggcaagagtgggatatcagtctagagagaaagacatggaatggaaacacacttaggaggaacatggccatgacttaatccttcacagtaagaagaagcaagaaagaagaaagaattaaacccacagaggtgggacaatgtgctgaagggttctgaagggctgagcatatttttaacaatcaaaaccattttcttgagaactattaaaagatgtgttcacgtgtacatgataacataccttgtttcctgttagttcagtttataagtttttctatgattctgcctgcattcaggtttcagagttggcttcttaatggcattgggagaccttttctggaaggaacattcacaggagaattgaccacctgtgatttttttgaaacttaaaatgttgtaaaagattgaggctgaaggttctgttttgtaaagttaaatgaaatcacatggtagagtgacaatgaggattgtaactcatgctctcttagataacaggtatctttcatggtacccacagcaatattttaatctcatctgagcttccttgacatgatttagagtttctctgtctaccgtaaactggcagatgaatttccttttttggctctattatagcatgataagaatggtgtaaggggtaaaaaccatccctgctcatatatttccctccttttctacatccagttctcatgcctgtctgcatttcaagtatatccaaaaacagggcaggtagcccaggtaaccacagcttattaacaagtgcatagcaaactataaataaaacagtgtcacaaactctgccacacccagtctttgctactcttcatgtggctgagattctgactttacagaatgtaaaaaaggtcaagaaatgaagcaactcctctgccagttagaagagggggcaccaacgccccagccccagccctggactggagaaatacccacccagcgaatcacttctcgcttccaactatcttttgtgtgtcttgggtctcttgcctcccagtgagtgaggttttctgtatattgcaagcataactttcatttacatgagttggtaagagtaggtctttaaaactgtctggtgacaagatattctacctaacagctgtttttaatgtctctctaaagtgaaaaggtgaaaatcattctcttttctctttatagattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcacatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgatagttctgcttattaattccattcacaaaatattctctaagtacctaatatgtccttcagtgtcctcatctgtgcaatagaaataagagctgccttagggctgttttgaggataaaaagagttggactatagaaggtacttagacctgtgctgggcacatagtgagtgctccctaagtgtttgtcatcatcatcattaactgccaggtcccattactaactgccagaaagaaacgccatttaaacatacaactattgtgattcaaaggcagaccttgtctaactctgtttttcttaccagagagtaaatagtaatttgcttcctactttgtgccctcagattgaaatccttcagtgattcagccacattatctggcttcgtaaaaggggaatctaattctgagttgcttttacatctcttgttattccaagcatgtcagaaatattgagcattctctaattttgctgcttcagttctttgcaacttatgtatatattgaacctatatatatacacacacattcaaacatgagcatacagtagatatttctcatgggggtggcgacatcttcttagatgcggtatatctgtgtgggaggcagctgtcatgcatcctgttcctcctgtggccacgcctcaccatctccaagaagccaccctttggtccgcttcagattccatctctgtgcctgaggttcaagtggagctgagaagttgaagtttcagagtccgacaagtatagttggtcctctgtatctgtgggttcagcatccatggattcaaccaatagcaaatcaaacattcattaaaaaaaaaaaaatccacaaagttccaaaaagtgaaccttgaatttgcattgcactgagtactacactgaatgcacttaaatgaagtgatgtctaggcctattgggcattacaagcaatctagagatgatggaaagtatacaggagaatgtgtgtaggttatctacaccattttataccatggacttgagcatgcgtggattttggtatcctcaggggtcctggaaccaatccccagtgaataccaagggacaactatgctgttcatcttatccctgatcattcccaggattttatataccacttgaacattagttaagttttccttatctaatagaaataaaaaacatctattagcagctccatttccacaccccataaatcctaaacaactggtgaacgaaaataccacctctacaaagtaagtgaaacatagtgccatgtcttcctctcaagaaggaagtgagggaagtgaacttgtcactggagcccataacatgggaaagatttggtgcctgcccatgccgagcccaactggaaggaaatcagtgcagagaaaaactatttgtacagcccagagcacaagaccgccagcttggtaaatctaatgagaacattaaacagaggattggttgtcatggatgggtacccctgggtcattaatcaagttatttctggcccacacattaccacccccacatcttgcagattaatttttgctaaattatcttagaagaacttttcctttttaattccccacattgtgtcttccataaacctatctacagatatttttcaaagattttgctcaaaagcatgtacctataatttttaaaataaatagtgctatggttatgggtattttaacaatagcttttatttttattatagaagatatatattaagatatatgtatacatattcattgtagagtaactagaaataaataggggaagaaagaaaaattacctataatactgtcacccagatttaaccaccataaacatatttgaatagagaaatgattctcaactgggagaatttttgtcccccaggggatatgtggcaatgtctagaaaatttttgatcgtcaccactcaggaggagggtgctgctggcatgtagggggccaaagccaggaataaatactgctaaacatcctaccataacaaagagttatccagcccaaaatgccaa

SEQ ID NO: 12745 - DNA, 22104 bp, Human
tctgcggtccgcgggctggttcctgctctggaggcagaagtgcgggaggatttgcatcaccctgcagggacagctgaggcccacgtggtgctgagggcatcagggcgcctccacaggcctggccggaggagggggctgaggcccgtgggtgggtcctgcctggggctggcagtcaccagaagtcgtgccggggttgacttgggcctcacaggggggccctgggcagccaagacaaccagcctgagctgggcatcttaaaacaatggcaattgattctctcatggttctggaggccaccagtgctgagtcctaagtcaaactgtcggcaaggccaagccctcgagggggatccttcctgcctcttccagcttcggggctccaggtgtcccttggcttgtggccacatcacccaaccactgccttcacccctcccctgtgtcttaaagggtgtttttccctgcgcgtctgtctctacgtccaaatgtcccctttctctatcagaacctgggaatcagggctccccctgctccagcatggcctcatctttacttacatcttaatacatctgcaaagggcctgtttccaaaggtcacattcccaggtcctggggtttgggacttggacatacctgtttggggatgcagtaactgtgctggctccagaggcctaatggggagggccttggccttagcctctgccccaaagccagccccaggggtcccaggacacactccctctcatctctgaagttccccccaactcctgtatcccctcctggggtcacaggtgggcccctctctaggaaatgaaggtttttacagaacggtccattgtcttctcacaaagggcttctgtggtggacacagcccagagcgcctgggtacaaggtgggcacaggagaaccaagggacagccctgtgggatcaggagctgccaggtagccccaggtcggacagggtagggtggctgggggcccacggagacctctgcccagcggcctgtgacccgacgcgtggttccaggagggcagacagaggagcaggtgccctcggcctgccagggcttgtcctcaagcaccagcttccaatattgagttttcagaggagcaatcggagggaggtgggaccaagccagaccgaggtcagccaggctggggctgggcagctgacagatgaggctgtgggcaggggcggagccagggcgctgaggggccagtgccgatccttggatccctgccacatagagaggggctgagatgcccgacctcaccgggcagctgggagacatgagccccatgagggttgagggaatagggctgaggcgcacgcggcctcttctacccccgcttgctgatgtgggagcgccacgggaatagctctgctgctgatgctgtgtgggccggggcaaggcctcctctctctgtgtgtcctgggcctcctggacctcctgggcaaggaaggtggtctctcgtccacaccgcctcctgcacttgagctgagggcacctgtctcaccttttcacctctacccaggtgcacccagggtctccacatccctgtcctgggagcgggtgggctgtgtggccaggggactgcaaggcctctgctgagtctttcggagtttccaggtcatccccacaaaaggcctctggagaaatgtctgcaggtgtggccaacctgaggtgccctgagtggggtgagtagaggaaccaggcgctgacagcggagccccacacatcccatcctcacctgggaaggagcttggttggggcggtgctacagcgagtgtcggagctgcagggggtcgctgggcagggcctggctggagagaaggtccctggggcagagatgcctgggggcagtccccaggtctccttgtgcatgttggctggagaggggcttcccaggggaaagcagagccagccccctgaggggagggaggtggggatgggccttctcagccctcaagggccagggtatccctgcagctctagaggccaccatgcaggatgtccaaggcccccgtcccggaagccccggggatgctgaagaccggcgggagctgggcttgcacaggggcgaggtcaactttggagggtctgggaagaagcgaggcaaggtaagggcaggccccaggcctcaggtgatgtccgccttgacctggaacccatgaggccccatttccttccctggaagctgagtgccagggtcctcctcacccctggggtctgctcccctggggccatattcagagcccccagacaggcagagttccagagctggaaggagtggctctggccggcctcctacctccctgcaataaccgggacccctgaagtccccccgagagatttggaggtgcaaggtcaagtgcatccagggccccacctctgtccagcgccctcggctcactgagggggatgccagcccagagaggggtcaggactgcccaggtcacacagcaggtcaagggaggactggccctgtcccagaagggatattgggggccactctcctcctgctacctgcccccaatgcccagcacctccccggtaccccctgtgtccagcccccttgatgcccagcacctcccagtgcccagtgtccccccatgctcagcacctccccagtgcccccttgtgtccagccccccccaatgcccagcagctcccatgccccgtgccccgaaagccctgagctgcagacctgccttgcagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggtgaggccccacccggcacaggcagcgctcccaccccacagggcagcccgaccccctgactgtccccgcaacccggcacaggcagtgctcccaccccacagggcagccagaccccctgactgtccccccacccggcacaggcaatgctcccaccccacacggcagccagaccccctgactctccaggccatcacgagaacatttcccgaaactctcagcccgtcctctgcagtacccacaggtgcagcagtgcctacgtactggaccaggacctcccccagctgggcctggcccttccttagagctgccccctccactagcagggcccatgggccgccatgagatgtccctgctcccactcacctgggaccagagcacccgggtgtatacagggtgggaccccttggggaagcagtcgggccgccagctgcaggggccagagtccaatggctgggctgttttttgaggcagcttggcctatacaacacccaggagaaaaggacttgaggtttcaggatccctcactaaatgactgtggcaaacccaaagagatcttccagccagacaagggccgagggctttgtcatttgggaaaacatcctgggattctcacccagcagaggcagctggacagagttgtgtcggatgtgtcccggagggagcccggtggggggactggagcccagtttgtgcgctccaggtggggtgggggtgccacttcacaggttctgggcccagccagttctgctgctgagcagccttgggtgggtgccttgccctctctgggcctcggcttccccaccccaccgtgaggcattccccagcacccacccctggctcccaggtaactggctgctgattgggcctaggggttagggcgtggggccagctagggaagacctggggcgtgcggcacaacgaggccctcttccatccccacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggtgcacgtccagctcccagcaccacgaccgctgggggcctggaggcaggggctcagaagggtttgggcagcgggcagagctctgggaggacaggactcgagctggaggaagagcagggagcgggcagagccagcacacggccggcaggtggcagtaccgcatagggaacggccagcgtagactgtggcgcgggccctcaccccctcctgtaccacacgggcccaggccccgagccctttccaagcctgggcaagcagcctccgtcccccatgctggggtctgtctaaggcactaccgagggaggcccgggcagcccctggtggatgtttggacgccagccctagagtcgggaaggaggtgctcccggcagcctgggctgtctccatggttctgtctaaaagaacccgctccccaccgcccctgcccctgactgtcgaaggagggtccccgggccccagctgttcgtccctccttttgtctgaagggtggggaaaccaaggctcgggcagaagccttgtgcggggccccatggcgtggtgtgcacggcctggcagggaggatcccgcagcgggacccagcccaagctgcctctcgagggctcagcctcgtctccctgcatgggcgcaggaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggtgagacccgccccagccacccagggaagccttgggacccagtggggatccagggacccgcctgtgggagagtgggggtgaccgccagggagaagggggagggcttcccaggcagaacgcaccccgcatgcctgagcaccgagacctgggccgtgggggcctgggccgtgggggcctgggaggaggagctgtctgggcagagtggtgaaggaggcacagctggacagagtggctctgactggacagtgacattcccaccagagcaggtgcagttctgttttcactgggccttgccgtggtcagaggctccgggactctaagaggcaaaatgagatcgtgagttgaaagagggctacttcccgccgccaggcgtgaggtatgctgccgccagagggcagcgtcacccgagaaatgggcacctctggccagtcgcacgttcaaaagctggacttactaagaaaacgctagtgtgtaaataatattcataaacaaagcatataattatttataacatctatgaacaatatacaatatttagaaacagaattgtaatttcttggcaaggccaactgagccctctgttttttttttttttttttgaggcagaatctcactctgtcccccatcccccaggctggagtgcaggagtgcaatctcggctcactgcagcctccacctcccaggttccaacaattctcctgcctcagcctcccgggtagctgggattataggcatgtgccaccatgcccggctctttttttttttttttttttcccagtagagacggggttgcaccatgttggccaggctggtcttgaactcctgatctcaggtgatctgcctgctttggcctcccaaagtgctgggattacaggcatgagccactgtgcccggtcaactgagcactctttagaattgaaaacacaaagtctcatcaaactctggggacacaggcagagggtctggctctgctctgcggaagccccgctggcccgggcaccatttggccaggcctgatttatcctccagattcaatcaggaggcacctttcaaagtcaggggcccgcctgcgagcccagttccctgtgggtgattctaaggcacctccaggcagttcactccctcacagaagacaggggcaggtccaggcctctctgggggcttcacatatagacgtctcatttccagcttctgtttgggggagaaacctgaagactccctcctgtacttcttcagtttgctgagtggtcaggcgcagcccacccagcagagctccctcgatggtcgagatgctgcctctgccatgctcagcatgagcgcgtgcagtgtggcagtgcacctgtagggctgggtgctccgtttcttccacgtcactttgtgttttaacagccatatgccagctgttgccacaaagtgcgcgtgctgggtagtgtaggttagcattggagccctcggccctcatatggcaggggctgtaataagcagcctgtgtcacgtggcccagacgaagcccacactttattcggaagagccagcttttggccagaaaatgtggtggcctgagagcctgagatccgggtggtcaccccaggcggagggtcctcaggcctcacgggtgccctgtccacaggcactggcagcatcgagatccctgtcctctgcttgctggtcaatggtgatcccaacaccttggaggtaggggcctggctgaggccccctggctggccgaagccttgtggaggggtgcggtgggttctgggcacccctgggacagggctgaagggatgggggcacccctgacacctgcatccagatgtcgtcgggctaatctggggtccgctctcccctccctccccgtctcagaggatctccagggccgtggagcaggctgccccgtggctgatcctggcaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctggtatgtgctgccccctcccctgtcctcccgacccctcctccgggggtggggctggtcctctgggagagttcctgcaatgcagcctccagcccactcctcccacctcaggctgctgggccccccacccactctcgcttcaggcccacagggagcagagagacccaggcagccccttggtctgcgggtggtcccaggccgggcccggtgggcggtgggcatgcaggctgcaaggctcacctggggacgctgcctgtgcctacgctggtgtctaccacggcctgcctctgcccccgtcctggctgaggcggccccatgggggctctgttctggtgcccagctgcagaacatcacctcacaccagcacctgctcaccgtgtatgacttcgagcaggagggctccgaggagctggacacggtcatcctgaaggcgctggtgaaaggtgagggcgggcagggtgggcaaggcaggcgccattggggggcttcatgctcagagccgctttggggtttggcagcctggccaatgtttgtgacgctcggccgcctgccccttcccaggaaagatgacacatgattcatgaagctgtctgtatttggcaagttttatgacgtgttttttaccacaacttaaaactatacttaaagctctcaattcagtggtatttttttggtgggggggttgttttttgtttgttttggttttcggttttttgagacggagtctcgcactgtcgcccaggctggagtgcagtgctgcgatctcggctcactgcaagctccacctcccgagttgaagtgattctcctgcctcagccttccaagtagctgggattacaggtgcaccccaccatgcccggctaattttgtttttgtatttttagtagagacggggtttcaccgtgttagccaggatggtctcgatctcctgacctcgtgatccgcctgcctcggcctcccaaagtgctgaggttacaggcgtgagccaccgcactagccaattcagtggtttttagtatattcgtgaggtggggcgaccatcacttttatctaattccagaagccttcatcgccccagaaagagcccataccccttggcactcactccccatttcccccagcccctgggaaccatcgatctgcttcctgtctctatagatttgctgacgggcatttcgtgtccatggttccctgcaggcagcgggagggtttgacggttcctccgtgttgaagcgtatgccattccatgcttcattccttttgtaaggcggagtcaggttccagcctgtggacagaccgtggttgatgcgtctgttcacccgctgatggaaaattttgatgagcatttgatgtgctttttgctggagacgaacgcgtgctgaagggctggacgctggcaggcagacacagccccagcagggagaggcactgctaagcaggggctggggacaccttgaggggacgctctgggaagggtgtctggactgcgggtggctctgggtttagaaacctcaccaggacaaggaggtcaaagaaacctccccgtttaggaactcccccgcctcttctcaccagtctcagtttggtcccagtggcctgagagaggcaccgtagtcttacggggtccatggttgtggaggctgaggctggtgagcctcacgtgcgagtctggtgaggacagcggtttccagcaggcgcacccagcccaggtgctgcaggccccccttgagtgaccctggtgacctcaccaagtcatggccaaatgcccttgcccgtggaggaaacgtggcccagcttgctcccccgacaacatccaggaagggtgtcctggaccttcagtgccaggaagtggcctcgaggcccaggtgttagctggggtacccccgttgcagccgaggaagttgcctcacatgggagcagacgggccgtcccgacgcagaccagggcagcacgctttctcctgcggtttgtacaaagtctcgtgcctcctgctggtgctcagaggtggcgcatgtgccccctcaagtcccagcgtgaagttcccgtttccgcgtctctaggcagcgcacctttggggaccctgtgccccggctctgtgaggccctcagctccaccctcaccagtgcctgcctgctctgcccacagcctgcaagagccacagccaggagcctcaggactatctggatgagctcaagctggccgtggcctgggaccgcgtggacatcgccaagagtgagatcttcaatggggacgtggagtggaaggtgcctcccagccctgcctacccacctccccatcatggcactgcccgagctgcccacgctgcctgctcctgcaccctgtgggctgcttggctgagcccgttctgcccagctgtcccaaggtccggggcaagaccaggccacggttctgcccgggcttctgcctcgctcactggcccaggcagagctggctgggtgccggctgtccccaaagcccaagggggttgtgacaccctcagcatttgctcacgactggcccctctgtgcccgccccaatgcagggggcaggctggggtgcaggagagcgagagggtctgcgtgacctggccctggggatggatccccatgctccctgctctctccttccttggaccccctcctcctgtctctcgctcactctcttgtcccccttccctcgggtgcccatggccgccaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggtgagcgggggctccgtggggatggagggcgaggctggggccgcagcaggaggccgacgcccgtgtcctccaggagaagggcccggccaagcggcccacgggccagaagtggctgctggacctgaaccagaagagcgagaacccctggcgggacctgttcctgtgggccgtgctgcagaaccgccacgagatggccacctacttctgggccatggtgagcccaggccgcgggcccagcgcgggggcaggggaggggcggcctcctgagaccaggtctcgtagggccaggaaggtgtggcagccgcactggccgcctgcaaaatcctcaaagagatgtcgcacctggagacggaggccgaggcggcccgagccacgcgcgaggcgaaatacgagcagctggccctcggtgagtgaccggcagctggggccgggcccgcgcggcgggggaggatgtgacggaggggtcggacgaagggtcctgggcctcgccagggctgcctgttaccgccgtggggctccaggtgccctcaggggcctcctccgtaggagaggacagacggctctgcctggggtggaggcggccccagaccctgagtgtgggaccgctgtgcacgtggtgaggacgatacagcctcacaccccgggcatacactgggccctgccgcaggacgagggacatttagcgtggcagaggttccctttgtcctgctgggggagggacagagccggagaaggacggaggttcaggaagggcccggagcaggccggagggggcagaaggcctggctgggccctgcgtgttgaacgcagggtgcggctgcagagcccaggtctgggcaggggatggaggaggggcgtcgggggccgggccgggcatcggcgtctcgtcctagcggccagggcctccgggggcagacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggtgagtgccagctgtcctcgaggagagctgccagggggtggggtgggcgggcgagctgggcccagcttgagttgacttcccagcctgcagctgccctgtcactcccgtcctcagcacagagggggcggggtggggcttctgttcctggaaggcgcccacctggcttcctccaccaggcacactcctcctgcctctggcctcagtggaagtggcacttcctcctctcagtcctccccaacccccaagcccaatcttttccctagtgaagggtacagcagctcaacccacacccctgggatgagtggcccaaggagcacatgcccaccaggacgggggctccgggagggagggctgggctgggcaccccttcagctcacgtgggccaggcacctgggggaagggcattcctggggcagggcgcagcctgggcaaaggtgcagagttggagccgacagttttgccttcacctcaggccttcctgaccaggatctggtggggggacatggccgcaggcacgcccatcctgcggctgctaggagccttcctctgccccgccctcgtctataccaacctcatcaccttcaggtgggtgaggcctgtgagctgcccggccaggacaggcagcagtgcgagtgccggagctacggggagggcctgggcctcgcaggtgctggtggtagcctgactctgtagcccccaagtccagcctccctgcgggtcccactccccacagcccctgcatcccagtgggcactttgatggccaagcgcctggagccaggcaggcgcctctgggagcccttcctgcgggccctgagctctcctgtgctcgcagtgaggaagctcccctgaggacaggcctggaggacctgcaggacctggacagcctggacacggagaagagcccgctgtatggcctgcagagccggtgcgaggcacagggccaggcagggtggaggggactggcgggtggtggctgggaggctggactctggtggggcacccggctgggcgccagcctcaccactgcgaacttctctgcggcacagggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcaggtcggtggccacactagcctaggtcccctccactctgcagcttcaggttgggcaacctaagctgggtcctgccctcgcagggtggggctccccaactgtaaaacaagaacagcatgggggcctcccatcttcccagtcaccagcggccatgatcctggtcaaagaccgagccctgagccctgctccagactgagcatgaccatggtctccctcgtcagagtctgaaccctgacctgtatcacggactgagtccagacactgcataaactgatccctagaccctgggcacaaagaggccctggccccaagtggagactgacctcaccttctgtccccagacagccctggaatagcttcagtggacccctagtcccactggtagcctcggccctggtcatagatggaaccctgatccttacagatccaagcttgtccaggtagggctgtccccagcgagggcggctggacagctgtcagtggactgcccacctccctcccagggcttcttcacagacgaggacacacacctggtgaagaagttcacactgtatgtgggggacaactggaacaagtgtgacatggtggccatcttcctgttcatcgtgggtgtcacctgcaggtctgtggggcccagaggccgtgtggcctcagggcggcttgtgggcaggcttccagatgaagccactcaggttgggtgtggcggtggcacttgtggtcccagctactcaggaggctgaggtgggtgggtcacttgagccagggaagttgaggcagcagcaagccgtgatcatgccactgcactccagcctgagtgacagagcaagaccctgtctcttaaaaataaataaacaaaagatgaagccactcagggcccaaggagtcctggcctggccctggccctgcccgcagccagcatgctgtgtgcccctggggaagcctctgcccctctctgggccccgcagccgcatcagcctcccatcctccaggatgctgccgtcggcgtttgaggctggccgcacagtcctcgccatggacttcatggtgttcacgctgcggctgatccatatctttgccatacacaagcagctgggccccaagatcatcgtggtagagcgcatggtgagcccccgggggccctggccctggccctggagggacagcaaccccctgcctgggccccacccggctggccgctgacgtccctctctctgcccctgccccgtggagatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatggtttgcacacagccagcgggggcaggggcagggagaaattggagccctgtgtgcacaagccctgggcatgaggctctccagagaggtctgttggggccatggagaccccagcctggagcagagatgggagaagtggctgaggcctggtccccaggccccccacaccccaaagggccaggcctggttcctgaggtagaggcagctccagtcacggagccccgacctgggacctggggccttgggctgggaaggagacacaaggagaccccaaggcagccagggctgcctcctgcttggggaggccaagcagcaagtcttgctctgggggtggtctatcggtggggaagggataggcaggcactaagggcacagagtgggcccaaaggctgtcccagccatcatccggggtctgggccctccagctctcctcacagcccctggcctctgccctcccacagggccctgcttggcctagggcacccaccagagcccctacgccgtcctgctggcaaggccccttcgccatttggccgctcctaaaggcaccctggctgctcctggggacccaccccaatgtgtgtgtgtggcctgcccatgcctatgggtgtccccaggccgacccctgtagctggctggggctggtggaggctctggaaactttttcataagccagtgcagtggggagggggcgggggtcagagccgcttggccatgggggcctctgtagtgatgggttggtggggagctctggggtggggcagggacctgtgcaggcccctgggatggctgggactcagtgaggagccccaacctggaaagggacgcacccctctgggaaggtggaccagcagccagcccgcccctggggccctcgaggggtgccgcagacttggagacccggcagagaaggtgcagggaaacattgctcaggcggtgtcaggcggctggggctgcccggcacggggcagtcatggcacaacgtgctgcccaggcctgaccccgacctctgtggagcggcgctcaggaccctcgataaatatttgttgaggggatgacggccagaccggagcaaacacaggcctccggggacaggcgggggcgacgccgtgatggaaaccgcctctcccagcgcggctcatttccttgggctgttttctcagcccccgcagcccctcctgacattttggtgtttgctcatcacaggcattcattttccaggccattagtttaaccagaccctgcctgcctgcgaccccacctcgccctcaccatacggcctccagcactgcccgtccgcagggcccctcggggcaggaggagctctagacgggcgcctccagccagggcagggttgggggtcccctctttcttgagtggctgcatctctggtgggccagtctcagcgactcgtatgaggagacaggcctggccatagcctccttctcgacgggagaaggcagggaaacagactcccgaggggcccctgctccgagtgctgcctcagggaggtctgcggtgctgcggggatctcagagccccgtgctgaaacgcctgcaacagggccagccccggccgcccactgagagtctcagacttgtcacttcccctccctgagctgcaattccttgggctccgttcagctgccgagcaagtatctgggcccttcaggttgaaccccagccactcactgtgacccagcccctcatgctgctaggcagagagttattcactaacacatgctgggctgagagggagactgaggctcagacagttcctgtacagcctgcaggtctcctcagagcccagaacagacccctgccccactctgcactcgtgccgagccggagctggggttgagctgtggtgacgagcttgttctctgggtctccaggccccagggacaatttaatttccagcccggcctggtggcgccttcccaaatcacagagtcggggagggtgtgggggtctcattcctcagagctgcttttatcagacagatttacggcttcacaaacaggctctccaggctggccccggcccgctcctccagagtgcagggaggagagggggtcatcagtctgcccaggaacagattcatgggctggaggtggccagggcggacagaggaggggcaggcctagggtgggagcgtggggagggctggcgctcactgactgccagtgcacacacagacactcaataactcacacacgggccaacgcgtcacactaactcactcgggagaaacaaggcaggaattcaccctgggagggagaacggacccctccagctcaggacccaggcacagaggcaggaacctgggaacaaggagaccccccagaacccaccgcagggcaacctggagctggcaggcactaagatacacttgaatgtgcccgtgtgtgccagtgtgctcacacgcagactcacacatgagcatgtgtgccaggcacatccaatcacatgtacaggctcacacagacacacgccagcgtgcaggctggggagggaggagagagcggagctcccattcggatatggaggggatatgtggtcctggacggccagggcacactctggcctctggctgggaccctgagcaccctgacgcccactgcggctccttcctccctcctccctcctcctgccccgcaggctggggtggggtgagggtccagggttgagccctacaagggagaagcaggtgtgagggtctggttttaagggactggagtgagatctgccacccctccagggtgtccctgcccagggccgagggagctcagcctgcaagctcccagagtgtgccgcctgaagaatgttcttgacttgagtggcccagtgcggggtcggtgccctcagagcttgcagcaagcccagtctggagcctgctggctcaatacattttggaaaggtggcggaattactcgccagcttggggtttaatcacaggcattagtgctgcagaggctctgagaagtcctgggccccatctccctttcctcggcagctctccccaaaccttcaacagcagaggcttttttcggaggaggggtggaggttttaacacatccaacaaccaggagaaacctgggtcccgtgacccctctgtcccccaccttccatccctccaggggtcttggctctacttccagggcctgtgatcttggctgactccagcccctggtggaagctcagcagacatggcagagggggcccagggtggggctcaccacccgtctggttctggtttgctgtgatggggctttcactgctaaaacccaggccgccctgggtgaactgggacagtgggtcacccaaccagcaccccgtcccctgggttcaacaccaggactcagcgctctatctcggggcatttgcctaaggccgcccttgtggctgcccccggtctggtccccacagcacccttgctttccagaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcaggtgactccacccaacccctggaggagagagccctggagcggagggagcagagggtcattccccaacaccgcctcctttgcaacccacctggtgtgctgcagagggtgaggcttggtgcctcagggcagatagaaggtggcatagcctggactgcagggctttgcctgcccaagaccgggaactctgtgggccaccctcccagtcccaggaagcagggcctgggtctttgggggaccggtgctgtggcaagaactctgggcttgtccaggagagcagagtggacaggggaagacccaaggagagtggacccctcgtgacacaccccagaggcaacgcagaagcagtgctgggcctcagtttcaaaaagggctccccaacagcaatcagggtgcagggggatgcgtcccccaagtggtcgtggggagccggtaggtgacggctcagctgtgcccctgcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctgggtgaggccgagcacaagcgggagcacctgggtgaggccgaggtggcgggtcccagggcggggctgtgcgctggaggcaggtctggagagacctggacccctcctcagccctgtgggtcctcagctgggctctgtgcaggctggcacagctgagcccgtccacccgcagcttggccgtccttgcacagggccatgcttgccctccatccctggctgggccccactcactccttctgcctggcccacctcgccccgggaccaggcctgggctctgccactgacgcccacatgctctagtaatgctggctgccacctggctttcccagagagagacctgccagaccccctggaccagaaggtcgtcacctgggagacagtccagaaggagaacttcctgagcaagatggagaagcggaggagggacagcgagggggaggtgctgcggaaaaccgcccacaggtgcgggggcctgtcctgatcactggtgggtatcgggctgtctttaagcggggatgtgccattggcgccagtgacagaggatctgagctggcgaactgaagctgaaggggtaggggcagggctctggccgagcccaggggcctagctttccagcctgacctgtgcaggaccctgctgggacgcctggccaggcaaaaagggagcgtgcacagtgaccgtggcgccctccctgctgtggtctcagggttgggactacccacccctggcttccctccagccctggctccaggggcctgtccccgactgcctgccctgcaccgtctttctgggtggtgcgcccaggcagggatggcaccctagccctactgggaaggcatagagcgctctgtactgcaccaggtgcactttgaggggtcctggtgccaccagatctgggcatgagggaggaagggaaagggccagggcaccccaaactcgggcacacagggaggcctggggggatggggaggctccccacacgcagagcaccgcgtggccatccacagcctgaccacctgctcctgccgcagagtggacttcattgccaagtacctcggggggctgagagagcaagaaaagcgcatcaagtgtctggagtcacaggcaagcgagccccagagctcctctccctgatgggaggcgggtggctgcgtggggctactgggatgggtccacagccctgcccggtcactcacagagatgaggcaggccagagccaggacaggagcaccccagtgggcagaggagcgttctggggaagacaggccgtccccacctgtgcctcctcccaccctgccacttgggaggctacagccttaaatgaggggtctcacattgaagacccctcgcctttcactctacacgcctcacgggagcctcactcacccctgcctgtgagcggcagctctcagagggaggagtcacagggcagcgggggccctggcaggagaggggagatggggaggctgcctgtcccctgctgtcctgagagagccctggagcttcccggacgtgtttcccttctccagatcaactactgctcggtgctcgtgtcctccgtggctgacgtgctggcccagggtggcggcccccggagtaagcctgtttggggagcgtgggatgagggtgggcatgggcacccactctgcagcggctggggggccgtaggctgtgctgtgtgctctgccttccctgcctggcccgggagtctcaggaggccttggctggacgcggctcttcagggtggtgtgggtgccctctgacggagtccctgccttggccagggccgaatgtgcttcactcagactcttgaggctctgcctggcgtgggccctattggactgtcctgctcagcaagcaaacgggcccctcggcctcaagggggctgctttcctagtcccaggagtgcaggcagaggcctggttgtctctgggctccccatcttccccaggctggcctgtggggactcactctgagagccacggcgtcctggcccttgcctctgagccagctacctctccccttcctgggcctgccttgctggttcccaccgctcaggggggccttccttcccagcaggctctcagcactgtggcgagggaagccagctggtggctgctgaccacagaggtggtttagatggctgggaacaacccggggctggccagcctccctcggacacctgagctgcttggcctgccacgtgtggggccacctctcctcagctggccaccctgcacgttgtgcactgacctttgccgacctccagcggaaccccccagggggcaccagccccccagcagacaatggccctcctggtgcctcaccacagaccctcacccaaaggaaccgctccttgtccctcctggcctccccggaggcacagcagtgtcatggggctgtctcccctgacaggcacaactccccgggcagaaaacgtgccccaccgcatccctacctggaaactgaccagcctgcactgtggaaaagctggccctgtggcgtgacgggggagcacccccatccagactgcgaagctgctctggggtctgcacccacccctgccctgacttgtgttgcctgacaagagactcatctttttttgaaacactggtggttagaatttctgtcacttaagacccaaaaggtcctttggggctcaggtgactggctcctggaagacagggctgggcatccactgcatctgtcagctgtccccctgacacccgatggccagtacagcacacactggtgtttatggccccaagacaaagcccctgctggcaccagtggctgctttatcttcagtggagcctggaaaacactgtaccccacgtggcccagataaaactggaccccaggctcaaacacctgcccaggccccccaactgcccactcaccccagcctcctctgtccacacccattttgtcatctccctttcgcttcccaagctgtggtctgcactaggcctggggctgatggcatcatgtgggctttggttgggggagggcagattctgtacccactcaggcccattgagggcactcactggacacctgccactgagccacaagccctagaggaggcctggggtttccaattctcactgtcacctgggtgatgtgctggtgagggatgcaggtgtcagccaccctcgagtggtccggcaccgagggtcaggtgtggggagctcttgctgccaactgagccctttgggtaagcagggcccagatagacacaaagtctcagaaagacccaaaacctttattgtccctaccagggagccagtgcttccagcccacaccccacaccccaggagcttcagcaaggtctctgcttgggaggatgctgcccagaactgcagccagggccaccggtgccacctgcaggcttcctcccattccagctaggcagtggccaggctgccccctgaccagccccactgggaaggcagcaggatggcagtggccagtggggtcaggctgggccatctccctctcagacctcagcacctgggtcctcggggctgctgctcttgttccggaagtggtctcgactccgcttcctgctgccatggaagccaacagtttccaccggcgggagacctggcacagacccactgtggacagaccctgacagtgcctccacctcctgcaggcctccatgggggctgccccactcctcagcctctgggctcccgggcccggccagatgggccagctccacagggccctcgcccctgtctgtggcaggattcccaaggccgcccctgcctggctctcccaccttccccaggaccctcttcctctcgtgtctggcttcgacccctcggactggtttggtgaagatgaccctcccctccccacagctggagggatcctggttgaaggaggacacgcagtcagtgggggcagccaggctctgggagcccaggaaggccagggcggtggcctgattgctctgctcgctgacctcggtcacatcttccaggctgtacttggtccagcgctcggggtgtgccacgtagtcggggaccggaggcacccttggtgaggcagggctccgatgggccctgcccaggccttccactggagaccggcctgagggcgctaggggccgcttgaagcctccgttgtcactcatgctggtgtgggccacagaggatggagcccgtctggccgcccc

SEQ ID NO: 12746 - DNA, 26354 bp, Human
agttagaggcgcctattaagagggagctcccttctactgaaatggaccgaggctgcagttctccactcaatacagggtgcatcaactcatgaattagctggtttcgaagttgtgtctagcataaaataaaaacaaaaataaaaaagaaacacaagggaaagaaatttcagcaggactgtttcattagagatatacacagatgagctacattcattggaaaccttccttctatttccataatggttctagatccatggccagaagttagaaaccttcccctgcacactttgtcttaccccgtgagacaagcagtccagtgggttctagaaaaagctttctttccccagcttccaaatgaaacgggtggttagccagatccacttgcagactcataacttcacttccctagaagcccatttcagcagcttacgattgggatattaagtataggaaaaaattctgccacttcatcacacctctgtggactgttggagaatataaccaaaatattcaacaacaggggactgctatatacattacaaaaatatccaaagataagcctgttgccactgaaaatgaagatttcaaaaaacttttaaggaaacagggaaatgctcaccatataatttaaattaaaaaaggatacatacacaggatatagctacatattttaaacgtaaaatatgcttttgaaatgcatatttcaatgaaaacacgttgagctaatcctactcctggctgttaatccaaatataaagcatactaataggtattttctgcccaaactaaacattcatacatttcaatatagtttaaagataaaatttttcatttcccaaactattattaagcagtacactagtattttctatatggtgtcaatgtccttcatccaaatgtattacaaacccacttattaatttaggaacctataagccatatttataaaacaagcctaatcttactgtgttcattatacaaatatttccttctcctatcttattgtcagttcaattaattatttgaatatgctcctttaagacgactcaaactcaacattttctcaaacattttcaagagactgtaatgtttcaggatacagagttattcgggaatataaaaatgtaattcaccaatacaatctatgtatcatacgattattaaaacctaaaccttgattgaatttgaactacctgttacaggttacacttgtaaaagctgacacagatacgcctaaatccgataccttgagtgtatccagtataccccgatccttaaacgtctggtatagctttttgcgcagttcatcttgactcaacacatcagccacggtaaacatgttggactaaaagacaaaatggttataggttacctgcggggcagagggaacgtgaacgtctgaaaacagaccagtggcctccggggaagccataagaggcctagcggcgaaagtttaacgaacacaaaacaagactttatttccgcccgagaaggggcaggtgtgtctacctgcgccatcatcaggcgtcagctccctccggagcccgcctcgctcgccccgccgcggcccgagtttagtgcccagcccgggcggtggggccaagacgagggggaatccctgccctcagaaccctgcctctgtcccgagggttcgggaggaacaaaggtgctgaacgttctctgcctcgcactcccaactaggttttctagcaaacacgcgagcttcctttcttcgcggttctgaggcaagggcgaggacccaggcacgactcaaaggcggctggagggcggggacccagacactagggactgaaggcagcgaggcaggaccgcctcacagccagtccggcaacttccggaaacctgctaaatatagccttcccgagctgaagagctacggcgcatgagcttggttgcccagcaccggccggaagctccgcctacgtatcgcgagagcacatcccagggtatcgcgagaactgcttcggcgttctggctacaggttcggggcgcgggtctcttccgcggaaactgacattgcgtttccgttgtcggcctcccactgcaggtagggaatggagcaagtgcggcggggggcgggtgttttgagtccctggaggacttcgtagcccctgcgtgacgcggatgttggtcctgtacctccacccctccccggggtggccgggccggacctgccagccctccgctggctcatccgcgcagcccttccacctgcagacgtccgccctctcgggggctgtggtttcgcggttcactgggtcattcagctaacccagggtttcttaacggctgcactgttgccttttggagccggaagattctttgttttgggaggctgtcctgtgcattgtaggtttagctgtatccttgctctctattttgtcagtatcaccttctcccccaagtgtgacaaccaaagatgtctccagatattgccagatgtcctcttggaagcaagatcgctccgggttgagatccacagagctaaacgttttagagtaccaaccattgtgtgctgtgaggtaaaggtgagccagtcctcatgatgcttaaatgtaattagaaaggaaaggaaccaaacctctcagaagcgataatgaaaatgttacagccagagaattgaacaagaactaagatacattgtagactggataaagagtttaaaggggaggtggttgaagatggaagtgatccagatcatctctgtggaaaaagtgtgtctttatcggggccttgatgggtaggattcgggtggtgagcaaaaaggagaacatcacaggaaggggaaaaatgagcaaaggaatcattaaaagaaaaaaaaaagccacgaccttcttgggagcagtgaggaatctagcctgactccagagttgtgtgctgggaatataagccttatatggtatctaagtcctgtgaggacagaattggatgtcagctttgtgtacagcattgaagatgagtacgatgagttttgatctctggctgtgaaaaacttaaagtatttaagaggcagtaagagtgacaggacttcataggaggtggagaacctgtaagtttttgttggaaacaatggaaaaggaggagaggcttagttggattttaaaggatgggtagtggttgcagacagaataaaggagaacattccaggcatgaagagagaaatgatagtagctctgaactcgatatagtcaaagtgaatttgggagaaaaaataagtaaacgagtcaacgctagcagaggtggaacaatagggctgagaaaagacacgtggagcaatgtgggaatcttgaatactagtacatgatcctgtagctgagatgcatcaaaggcttttgagtggaatgatgaaaacagtgttctaaaaagatgttgatatgttgtaaatgttgttaagtagaatcacttgtccactgtttaaaaaaaaaaaatgttcctgaagacccccttactcccacctccacctttggtcccacagttgaatacatgaatataattagataaaatgttctccaaaaactagcataacttctaggggagggagaattgcttataatattaatagaaaaatgtcacattaaagacctatcagtagtattcctactgcccctcctcattgtaatagacatgtcccatgccataccagtttagtctcatgaccccaggtttatggaacaactgaaatcactgctctcgcgagcacagggcagtttttctagaagctcttctatagaggttgtaaagaggcatgctacaaaaatggatgtctttggaactggagtccatgagttttatcttgcatttgtctacaacttaagagacttccaagttcactgagcatcctcccactctggcactgttggtgttccacccaccccttagtttctagtttcccagtgacttcaaatgagcagccctgggcttggcctatggaacggtttggaataagtctgtgtagtccagagtcagcaaatacttggccctcctgtaggtactgcacttccccaaattcatagcagacatggataattgatcacagcattctttcctggtgaccacatttagtctcagaatctttctcagcgccagttcctggcagtcactaccagttgattagaattcgcttatgaaaggaaactcatttgccatccctagccaagtccctttttcattagatagcttatcgtatttaaagatagtactgtgctgtaccccactccctttccaccccaaaaaggtctcccctactccgtttaaacatcctctgttacttcagttgctcttgtctggtttccagagcatttcctagcctagatcctgccctcccttcccctgtaacacacagagttattgatccttttacaatatgattcccagaactgagtaccttccccaaagatgataatattattgaagaggacatcagcattctccctgaccttgctcttaatgccacctagaattgattagcttttttgacaaacctatcagacttttgcctcttactgagcttgcagaacttttgggttgatgtagatgaactgttcttaatctaggtttcccttgtccttttgtacagttgatttttaagcccaagtacagggcttgctttcttatcctcttaacttctatcttgttaatttcaccttactctcctagccatggagatcttttttaatcctaacttctgccttctaataagttagctgcccttggtgttatctttgaatgtgataagttatcttcattcaagttattgattcaaatactgagctagactaggttaaggtcaacctcaaagccttactagagaccctgtgccataaattgacacggagcacccaatgttctccgagtattgacactcaagtcggctatgagccatccctcattcagcaaataatgagtgctttctgggtccctggcactgttgtagctctaggtataccatagtgaatgagacgaatggtgtatctgctctcatggagggcaacattctagcaagactgtattttcactcaggctccaggactccagtttgttcttaggtagataccaaaatatttcgtaaaatgactttctgtttacctaccgtatctcccttcagaaacaaaaaatgtaaatttggtatgacttgttctagtacaaccaggagtatatgaatgaataatctgtttttatctagggattcacattaaatgagttaatgtataataaaagtgcctggcatggcatctgactgaaaataaacatttaatacacgtttctgttggtgttctagtcgctctgaatgtaccctgttatagactaggagataagcctttttcctgtttctgaaaataggaatagcatttaacctagcggatgatatggcatttttcttgcaatttctcaaatgtcactgatcagcagttatgcaatcacatttgttaatccaaggtatataatttgtcaggacctgatgacttggatttattgaaatgtctagatgttttcttttttctttagttatacttttaagttctagggtacatgtgcacaacatgcaggtttgatacataggtatacatgtgccatgttggtttgctgcacccattaactcatcatttacattaggtattcctcctaatgctatccctcccccagccccccaccccctgacaggccccagtgtgtgatattccctgccctgtgtccaagtgatctcattgttcaattcccacctatgagtgagaacatgcagtgtttgcttttctgtccttgtgatagtttgctcagaatgatggtttccagcttcatccatgtccctacaaaggacatgaactcatccttttttatggctgcatagtattccatggtgtatatgtgccacattttcctaatccagtctatcattgatggacatttgggttcattccaagtctttgctattgtgaatagtgccacaataaacatacgtgtgcttgtgtctttatagtagcatgatttgtaatcctttgggtatatacccagcaataagtttgctgggtcaaatggtatttctacctctagatccttgaggaatcgccacactgtcttccacaatgattgaactaatttacactcccaccaacagtgtaaaagtgttcctatttctccacatcctctccagcatctgttatttcctgactttttaatgattgccattctaactggcgtgagatggtatctctttgtggttttgatttgcatttctctaatgaccagtgatgagcatttttttcatgtgtctgttggctgcatagatgtcttcttttgagaagtctctgttcatatcttttgcccactttttgatggggtttttttttttcttataaatttgtttgagttctttgtagattctggatattagcccttcgtcagatgggtagattgcaaacattttctcccattctgtaggttgcctgttcactctgatggtagtttcttttgccgtgcagaagctctttagtttaattagatcccatctgtctattttggcttttgttgtcattgcttttggtgttttagtcatgaagtccttgcccatgcctgtgtcctgaatggtattgcctaggttttcctctagagtttttatggttttaggtctaacatttaagtcttttttttgtttgttttttgttttttgagacgaagtttcactcttgttgcccaggctggagtgcaatggtgcaatcttgactcactgcaacctccacctcttggattcaagcaattcttctgcttctgcctcccgagtagcagggattacaggcatgtgccaccacgcccggctaagtttgtatttttagtagagacggggtttctccatgttggtcaggctgatcttgaactccctacctcaggtgatatgaccacctcagcctcccaaagtgccgggattacaggcttgagccaccgtgcccagccctaacatttaagtctttaatccatcttgaattaatttttgtataaggtgtaaggaagggatccagtttcaggtttctacatatggctagccagttttcccagcaccatttattaaatagggaatcctttccccatttcttgtttttgtcaggtttgtcaaagatcagatggttgtagatgtgtggtgttatttctgaggcctctgttctgttccattggtctatatatctgtttcggtaccagtaccatgctgttttggttactgtagccttgtagtatagtttgaagtcaggtagcatgatgcctccacctttcttcttttggctgaggattgtcttggcaatgtgggctcttttttggttccatatgaactttaaagtagtttttttcaattctgtgaagaaagtcattggtagcttgatggggatggcagtgaatctataaattacccttgggcagtatggccattttcatgatattgattcttcctatccatgagcatggaatgttcttccatttgtttgtatcctcttttatttcactgagcagtggtttgtagttctccttgaagaggtccttcacgtcccttgtaagttggattcctaggtattttattctctttgtagcaattgtgaatgggagttcacccatgctttggctctctgtctattattggtgtataggaatgcttgtgatttttgcatattgattttgtatcctgcgactttgctgaagctgcttatcagcttaaggagattttggactgagaccatggggttttctaaatttacaatcatgtcatctgcaaacagggacaacttgacttcctcttttcctaattgaataccctttagttctttctcttgcctgattgccctggccagaacttccaacactatgttgaataggagtggtgagagagggcatccttgtcttgtgccagttttgaaagggaatgcttccagtttttgcccattcagtatgatattggctgtgggtttgtcataaatagctcttattattttgagatatgttctatcaattcctagtttattgagagtttttaacatgaagggctgttgaattttgtcaaaggccttttctgcatctattgagataatcatgtggattttgtcgttggttctgtttatgtgatggattatgtttatcgatttgcgtatgttgaaccagccttgcatcccaggggtgaagctgacctgatcatggtggataagctttttgatgtactactggattcggtttgccagtattttattgaggattttcgcatcaatgttcatcggggatattggtctaaaattctctttttttattgtgtctctgctaggctttggtatcaggatgatgttggcttcataaaatgagttagggaggattccctctttttctgttgattggaatagtttcagaaggaatggtaccagctcctctttgtacctctggtagaattcggatgtgaatccatctggtcctggactttttttggttggtaagctattaattattgcctcgatttcagaacctgttattggtctatttagggattcaacttcttcctggtttagccttgggagagtgtatgtgtccaggaatttatccatttcttctagattttccagtttatttgcgtagaggtgtttatagtattctctgatggtagtttgtatttctgtgggatcggtggtgatatcccctttatcattttttattgcatctatctgattcttctctgttttcttctttattagtcttgctagtggtctatcaattttgttgatcttttgaaaaaaccagctcctggattcattgattttttaaagggtttttcgtgtgtttatctctttcagttctgctctgatcttagttatttcttgtcttctgctagcttttgaatttgtttgctcttgcttctctagttcttttaattgcaatgttagggtgtagattttaaatctttcctgctttctgttgtgggcatttagtgctataaatttccctctacacactgctttaaatgtgtcccagagattctgatactttgtgtctttgttttctttggtttcagagaacatctttatttctgccttcatttcgttatttacccagtagtcattcaggagcaagttgttcaatttccatttagttgagcagttttgagtgagtttttaaatcctgagttctaatttgattgcactgtggtctgagagacagttttttgtgatttgtgttcttttacatttgctggagtgctttacttccaattatgtagtcaattttagaataagtgcaatgtggtgctgagaagaatgtatattctgttgatttggggtggagagttctgtagatgtctattaggtccacttggtgcagagctgagttcaagtcctggatatccttgttaacctgtcttgttgatctgatattgacagtggggtgttaaaagtctcccattattattgtgtgggagtctaagtctctttgtaggtctctaaggacttgctttatgaatctaggtgctcctgtattgggtgcatatatatttaggatagttagctcttcttgttgaattgatccctttaccattatgtaatggccttctttgtctcttttgatctttgttggtttaaagtctgttttatcagaaaccaggattgcaacccctgcttttttgtgctttccatttgcttggtagatcttcctccatccctttattttgagcctatgtgtgtctttgcacatcagatgggtttcctgaatacagcacactgatgggtcttgattctttatccagtttgccagtctgtgtcttttaattggagcatttagtccatttacatttaaggttaatatttttatgtgtgaatttgatcctgtcattatgatgctagctggttattttgcccattagttgatgcagtttcttcatagtgtcaacagtctttacaatttggtatgtttttgcagtggctagtactgatttttcctttctatatttagtgcttccttcaggaactcttctaaggcaggcctggtggtgacaaaatctctcagcatttgcttgtctggaaaggattttatttctcctttgcttatgaagcttagtttggctggatatgaaattctgggttgaaaattcttttctttaagaatgttgaatattggcccccactctcttctggcttgtagggtttatgccaagagatccactgttagtctgatgggcttccctttgtgggtaacctgacctttctctctggctgcccttaacatttttttccttcatttcaaccttggcaaatctgacaattatgtaccttggggttgctctcctcaaggagtatctttgtggtattctctgtatttcctgaatttgaatgttggcctgtcttgctaggttgaggaagttctcctggataatatcctgaagagtgttttccaacttggttccattctccccatcactttcaggtacaccagtcaaacgtagatttggtcttttcacatagtcccatatttcttggaggctttgttcgtttctttttattcttttttctctaaccttgttttctcgctttatttcattaatttgatcttcaatcactgataccctttcttctacttgatcaaatcagttattgaagcttgtgtatgcatcatgaagttcttgtgccatggtttttagctccctcaggtcatttaaggtcttctctacactgtttattctagttagccattcgtctaatcttttttcaaggtttttagcttccttgagatgggttcaaacatgctcctttagctcagagaagtttgttattaccgaccttttgaagcctcattctgtcaactcatcaaagtcattctccgtccagctttgttccattgctggcgaggagctgcaatcctttggaggagaagaggcactctcatttttagaattttcagcttttctgttttggttcctccccatctttgtggttttatctgcctttggtctttgatgttggtgacctacagatggggttttggtgtagatgttgtttttgttgatgatgatgctattcctttctgtttgttagttttccttctaacagtcaggtccctcagctgcaggtctgttggagtttgctggaggtccactccagaccccgtttgcctgggtatcaccagcagaggctgcagaacagcaaatattgctgcctgatccttcctctggaagcttcatcccagaggggcacccgcctatatgaggtgtctgtcggcccctactgggaggtgtctcccaattaggccatacgggggtcagggacccccttgaggaggcagtctgtccgttctcagagctcaagcaccacgttgggggagccactgctctcttcagagctgtcagacagggatgtttaagtctgcagaagttgtctgctgccttttgttcagctaagccctgcccagagaggtggagtctagaggcagtaggctttgctgagctgcagcgggctctgcccagttcgagcttcctggccacttgtttacctactgaagcctcagcaatggcggacacccctcccccagccaggctgctgcctcacagttcaatctcagactgctgcgctagcagtgagcaaggctccgtgggcgtgggacctgccgagccaggcatgggagagaatctccttgtctgccggttgctaagaccttgggaaaagcacagtatttgggtgggagtatcccatttttccaggtacagtctgtcatggcttcccttggctaggagagggaaatcccccgaccccttgcactttctgggtgaggcgacgccctgccctgcttcagctcgccctccatgggctgcacccactgtccaaccagtcccaatgagatgaaccaggtacctcagttggaaatgcagaaatcacccatcttctgcgttgatcacgctgggagctgcagaccggaggtgttcctatttggccatcttggaacggatccctagacgttttcttaatatacctatcttgaggttcgcagcctgcctaaccttgtttcttccatgcttgctatttgaaaagtcatttaacagagaaaatggaagttaaacaggtcagcatccaccattatttcagtgtgtagcaagcgcttgaagcagttgacccttctcccttgctttttcctgatcgtagcctaaaaagcctctttttttttttttttttttaaatatatattacacacttcaactcattgtaggcctttgcccttctgatgctagcctcactgatttctggtcccgtttttatgttcattactagttagtgtcctacttcttacatcttccatgtggcctctttaaatttaaggtagtcagagagctctttgtatcaccaagtttatttctttagtcttctccttctcaaaagcccaggtttccctagccactgaagacagctgctgtttccaccacaagtgagagttctggctctcacttgagagccaaacaagaatctgtttccttgtactttccagcttctgggggcctcctgcattccttggctgtggccccttccttcattttcaaagctgtcaagatcacattgctgtgaccattcttctgtcacttccccctgactttcctcttttgcttccctattctacttttaaggcccttgtcatgacattgggtccacctggatgatccaggacaatgttcctatcttaaggtcagctgatgagcaaccttaattcctctttgccgtgggccctaacatactcacaagttgcagagattaggatgtggatgtcttaggagaggggccactgttctgcttgttcacctcagctagacatatggaaaccatcctagattctcctcttgtcctcaatttcccagtttaatctattcccaaattctgtgtagctacctcctcaacacctctgggccaagcctctcttggagatgcttcaaaggcccctatttaaggcgatgggaaaatcgagcagaccatacatacacagtcatgtcaacgcaggtaattcagtaatggcagttgctttatctgtattatatattggaattctaagtaatacttgtttttgttggtgaagggaaggtggaggaagtcacagaacttttataaaacgtttggaatcaggccgggcatggtggctcatgcctgtaatcccagcactttgggaggccaaggtgggcagatcacttgaggccaggagtgtgagaccagcctggccaacacggtgaatccccgtctctactaaaaatacaaaaattagccgggcatggtggcacatgcctatactcctggctactcaagaggctgaggcaggagaatctcctgaacctgggaggcggaggttgcagtgcgctaagattgtgccactagtttggaatcattgatctagagctgtgctgtctagtactgtggccactagccacatatggctatttatgtttaattaaaattcagttctacattctcactagccacatttttttttttttttttttgagatggagtcttgctctgtcaccaggctggagtgtgcagtggcacgatcttggctcactgcaagctccgcctcccgggttcacaccattcttctggctccgcctcccaggttcacaccattcttctgcctcagcctcccgagtagctgggactacaggtgcccaccaccacactcggctaattttttgtatttttagtagagatggggtttcaccatgttagccaggatggtctcgatctcctgacctcgtgatccgcccaccttggcctcccaaagtgctgggattacaggcgtgagccaccgcgcctggcctacactagccacatttctaatgcacactagctcacatattggacagcacaggtgtagaacatttctgtcctcgcagaaagttccatagattggacagcgcagaatcctagcgtgtgtcttacctttgctccataccctcaagtatttgctaagtgtttgcagctgttcccctcccgagacaatgaggtcattttctcccagggttttcagttcttccacttcacctgtcagtttttccttggcagaactgaatgaaaagctacagcccttcttgcttcttcagctgtttacaaaatcaaataattggcagctgaagtcaagcatggaatgtatataaagaaagctctgtctcatcttttgcgcagctgggtagttggtaacagcatcctcatgcagtcggtctttgagttccctttctgtcttcctgctgacttagcgccatgctgcttgcccattcgtggctttccatataggggtgagtgtggggatgcatgttatcttgcttatacatatgtgtacatatatttccttctgctgctgcttttgcttttttttttttttttttttttttttgctgctgcttaaatgtactgaagaaagtaagaagcccttcccttggcaaactccagctctgaaatctagtccagcaagaattcatgatatcattgtttacttggttcaaatttcaactccctgtccttcccttcactttggagaattattgccagttcttctagttttgcatagcttttttatcattccagctcgtctttgttatccactttttctgtttggacctttttcttatctttcccctaaaacaggggcaaacattttctttaaagggccagatagtaaatattgttggctttgtgggacagctggtctgtgtcacaggtgcttaactctgccattgaagcgtgagagcagccttagatggtcgcaaaatgatgggcaaggctagatttggcctgcagtctatagtcccccacccctccacccctgccccaaatagcattttaaatcttacgtcatcatgccaggagttctgatctgccttttcttccatagtcatggccttccaattctagagttaaaagtgccagctgtgccttgatttcctttataaaatgtgtcattcattagcaagtacatatcagatttcttctgatttcattgtgtgttctgtgtgaatcagcagaaggcccaatgaggcttgctaagtcttggcttctaacacacctcagatgtatgttctaggagactgactgtaactcccggtttacttgatttccactccgtgttgagaagttactagtcaccacatcccagtgtgcatacggtctcccatgttattccactaacattaattgagcatgtactgtgggtcagacactgtactgggtactttacatgcattagattgtgtgatcctcataagtgcaccataaggtgctacagtgttagcactatttaacagatgagaaaacggacattaggaagttaaggactgcctgtggtcacactgccagtaagtagcagagctagacctgaacctaactttgactccaaagtccttgtgttaaaaatacacaccgtggggttaccttggggtaaatccatccatgcccccacccatccatcattcatctagatttcaattatctgtgctaaaagccatggaatcacttatatttttccccccagtttctcgtagtttcatctcttctgccaatctgttttttttttttttttgagacagggtctcattttgtcacttagactggagtgcagtggtgcgatcttggttcactgcagccctgacctccctgggctcaggtgatcctcctgcgtcagcctcctgagtagctgggactacaggcacataccaccatgcctggctactttttgtatttcatgtagagatggagtttcaccatgttgcccaggctggtctcgaagtcctgggctgaagcaatctgcccatctcagccctccaaagtgctgggattacaggcgtgagccactgcaccgggcccaacatgttaaacttagttccaagatctttcagtgcctcagaatgtcttcctttatggattatttcttccatcttttctagaatacaaaactcttcctttcttataaattggtatataaagaggcatatcataggctcttagatttgcaaagacttacatttatagcacacatacttcaagtagaaagaagacaaatacagcacacgcagtctgcgaatcagtgatacagtgtctgtcctttctaggtaagtgacatgaggtagagttggttttagcttcccccgacggatgcctcctggaaatttctaaggcaaggtaattacttccttggtcttcccactactctgtattgtccttgacttaccaccaccttctgttaatccttctaggtgtccgtgctgctactaactggtccagtccaaatgaagcccagcttactctaccagacacttagggccccttgagctgaatgagccatattttcagatcatgagaatgttgtctttgtgatttcatgttagaggtcttccagtttacttaagaaaatacattagattcacagattcatatcatagatacataatttgtttattccagaagctacgtatcttcgctagtatactggaaactgccaagcttagtagcatcttcctctacaatgtcaggtttaaatttaaaaaagaattctacacttcccattagtcattttttaatttgaagattgactactaaaaatatgtactatttttcacttaattaggagccatatattgaagaccatgtctgggagcttctactttgtaattgttggccaccatgataatccagtttttgaaatggagtttttgccagctgggaaggcagaatccaaagtacgtaagaatttttatgctattgtaatgatatggtataatatgattttagaactggaagatctggacagataaggtaactgaaatccaccacaattaaatgaggcttgctcaggagcccacagactgatagaagccagccagggtatgtccttggagatgtttattcatcctttagttcagcacagactagcatgacgctctggcattcccatcatactcagttcactatgtcacccaccatgaattgctgttgcttaagcacataaagacatagttcacctgtagtggattgccgccttgaaataccatgaaagtccaggctgttttcatgaatcatgtttttcatcaggacctactgggttagaaaagacccttacttccctgtcttcctgctgccactgggtctgcagcacctcacttcaggggccttctgcagcacttcctggctgggttgagcctgtatgctcccctccccagtgacaccttggccatacacaggaagctcaaaagcagcaccagaggtgataccacccaacttgcttgtcaagaatggttccaaaaaccaagcttagctcgaggacatattgccattcagacccatagagtattttttttttttgagacaaggaaatggaccatatattttaagaaagattaccatcccaaatgcttaaaataaaaccatttggatcttatttatttattctttttgagacagagtcttgctctgtcgcccagactggagtgcagtgacacgatctcagctcactgcaacttctgcctcctgggttcaagcaattctcctgtattagcctcccaggtagctgggattataggtgcgcaccactgtgccaggctaatttttgtatttttagtagagacagggtttcgccatgttgcccaggctggtctcgaactcctgacctcaggtggtctgcctgccctcggcctcccaaagtgctgggattgcagacatgagccactacacctggcccagacctgtagagttttgacacgagaagagcccagttctttccaatttctgtttctaataaattgctgacaagtttgctatgtttctcccaacctccaaaaattggctttaatgtcctttaaggaattgatgttttaagttaattgtaatgcataatatatggtatttttcaactattcaggccttgccaccaaaataagataggcatttgtttacgggattctctatgaggtggagttgtgacattattttctcatattatgagaacactactcattaaaacttgtttttgaggtatctctgtaccagtactgctttgtgggatgcagctacttgtatgtaatttctgtgcactccactgcccttgtgttggacaaagcacacataaaaatactttgttgcataacttgattttagttctttctcctgctaccactcactttcttaaagcgttttcagtttgctcctaattcttcaggattgatcatcattgtaaaagaaaacactgctgtgagccagacacaaaaacatccatttctctaaggattcacttagctttgtcatggcaacatgagtgaagtaaaacatgctttaactatgcatgggattccacggcaacgggccgccctcctccagcccaggcatgagaacagcctccttggcaaggaagccgtctcagtttcctatggctgttgtaacaaagtacgaaaaactgagtggcttgggacagcagaaatttattgtctcagttctgagggccaccatctgaaatcaaggtgtcagtggggccatgctccctatgaaggcacaaagacaagggtctgtccaggcctctctcccagcttctgggagttccttggcttgtggcagcataactccagtcttcatgtggcatttttctccctgtgtgcatctctaaatgttccctttttctaaatacaccagtccattggattaggggcccaccctactccagtgtgacctcatcttagctaaccacatctgcaacaaccctctttccatataaggccacattctgaggtactgttgcttaggacttcaacaaaggaattttagagaggaaacacttcaacccataacaggtattctttgaaaaatggcttgggtttttttgagacggagttttgctcttgtcccccaggctggagtgcaatggcgtgatctcggctcactgcagcctccgcctcccaggttcaagcaattctcctgcctcagcctcccgagtagctgggattacaggcatgcaccaccacagccggccaatttttgtattagtagagatgggatttcaccatattggacaggctggtcttgaactcctgacctcaggtgatccacctgcctcagcctcccaaagtgctaggattacaagcataagccaccgcgcctggccaaaaaatgtattttcaaagaactacattggagtaagactgcattccaagttctgaattccgtcttcacattatggtcagacagtcccaccttctgttcacttaagccatttcagcccaggaaaaggacactcccagctctgacaggactgtgtcctgctattgacacaggcgactgctcacagctggggctgagcatcacctcccactactcctaggtcccgctgtcatgtaagctccatgcactggaaagaggcctctggcaggccgttataagcgccatttcaactgtctctactgcttacctggtgccactgtgcaggaagccccgccctctcagtttcctcccagaccttgaggcctagtgtgaatggcacctcttctccacaggatcttgttttttttttttttttttttttttttttttaacatagtatcctttttttacatgtttagatggttacagaattcggtaacttccttcttgaaacatgaaaaaaaatttatatgaaaaagattttcaataaatgattttgtataaatcctctatatacacatttcatttattaattggctgtttctgttgagatgtagatatcaaatttaaaaatagaatataatatgaaaacagatcttttataagtctcatgacaataacaaagtataaaagcaaactgttttttccccacaagaaaaccatctatagaatttacagaatgaaatgtcagcattctcgatgccatatgcaaatgttaatctgtggttgctcacactgtcatctaggacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatccttaccttcttagtaaaggtaactaactaaagtttgggctcacaaaccagaagaacatggaacatagatgccaggctctgagtctgtagacttcacagtcaggtgaaaatgtaagtttccatttatggggctacttttctttttttaggggggaaaaacattttgtttaatagctaattttaaaactaagtctcatacacaaaaagagtttatctggaccctatcaagggtgattttactttattttacagttattttctaactttgaaagcttatgttctctttatgataaaactaagctaattttaaacccagtttatatattcaacttttccatcacaaatacactgcatgtgactaatttgaagaatactgtatcaacgaactggttgctttttgtttttcatttctaagaaagattatgccttaattatttcacatatgaggtttattatgcttcatgacataagacaagaagatggaataaagaacttctttactgatgtttatgatttatatataaaggtatggtatgttctataatttttaaattctgatgagaaaggattcgacctttgtcaggaaactggcctattgaagtaactcccttaggctgcagtttacctttcagactagctttcccccatcagaactatctctggcaactccctccgcaggtaagtcttcacagccaggtgaatatgtatttaggaacacaacttcatggtagttacctttagatgattgtgaaggtaaattggtttcattcttcaccttgttgtcctcatagctgattttattagggatccctaaagacagcaagaaagcagcctatataagggaaaattacttcataatttaatctaaaatgtttccatctactttacaaataagttacagtgcaatagagatcataaactggcaggaagtgatttttatatgatcaaatagccactcaagaagaatggcgccacttgcatttcttgattttgaaaaataaaataataataggacgtcatggttacactgcagtgataacaatagtatgttttgttttggagacagtcttgctctgtcacccaggctggagtgcagtggcgtgatctcagctcactgcaacctctgccttccaggttcaagcgattctcctgcctcagcctcccaagtagctgggaccacaagtgtgcaccaccacacccagctaatttttgtattttcagtagagacgaggttttgccatgttggccaggctggtctcaaactcctgacctcaagtgatccacccgccttggcctcccaaagtgctgggattacaggcgtgagccaccatgcctggcccatatgtttttaataatttaaataagttctgtatttggacagaatttcttgcatatcagcacagtaatacaatttaacagtattcctagtcagaggtagtaagtaatatttagccctcttataaagatgaacaatgtcaagtgattaaggtataaaaatcagcaatgcctttcctcattagtgattccatttaatgattttctgtcatgcgttatgatacactaatttgagaagctgatcatttagcagtcttgtgttaaaggagagtattaaaaacctgattgttaaaagattaccacacaagaatagctttttctgaactctgagcacatggcagatttttttgttttatgtagccaaagggccatagagattaatccatttatttataatgaatatgagtatttcacacacacggtaaattctgaaagttaactgacacaggcaacatttatcatactgccattagttttgccacagatacttctcaaaaccaaaacaccaaaataaaaatttccttaagaggatgttattaacaatgcagcattttcaataaaacttaaaaatgtggtctttagactttggaatgtctttggtttttaatttaaaactttaaaatgatttcctttcagaaacttaagatttgtcagcttttttgcttcactaatactttcttctttcctagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaaaaatagtacattctgtctcatgtcacgtatcaatagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctcaagatcgtggtagtttaatatccatttttaaagtgctgctttcgtcctatttctcctattgatagtctagtctgcaaactaatatgatgtcttcacctgttatagagctcagattgactcaaactagatgccagagctttgggagcagaaaaatttacatactcatctagaaatctaggagtaatttcagcaaacgtgtatttttttgtatatagttggcccctccctcaatgagcatatcatccagagggctgtgatgcagggcagccaagagcagcagggtgattgattgagagcaggaagacttggctcagctgcacaacagtggtaccctgaaaatagccttttctccaggctggtgaaggtgaggtaggcactagtaacacacttgtgagtatattactaaagttaaatgccaaatttcatgtgtgactgagtcttcaaaggagctggaagggaagtggagcattgagtgggacctccaaggtaggctgcacaggaaagcattgcaggtgtgaaggtgtgaagagcacttgggcacatgggtggaactgacagctgattgattgatagatagataggagctgatcatgaggaaagctaagctggcaaagcttggatctggtaggtgatgttccttgaaggttctggaacacaagagcaatggggtgaagtcagtcttaaaatcaggctctcctgagcacatgtatgttagcacaaagttggttatctgctttagtgctccaaaagtgatccagataaaacgtacaccgagttttgtcatcttgccatagccagaaacttactaggatgcttcctttggcatggacatagatcgtctcagtctctgctctgcccatgctattacccatgcgctttaatttttcagtcacttcaacacttcctggttgacagtccagagttccagaaaccactgactctccagacaccacctttcactgggtaccacactggtgtgtttttctacttaacaaacacttcactactctacaagacacggatattgtgtgagaacttgcatggtggtgtcacaatattaaaatgaaaagtttgtacagaaatataaaaaggttttcttctaagacaagtaatagtaggaatgttttaacttcaactaggaaactttccccaagggtgaaaaataaaaacatttagtccattaatgaattgtaattttgtatcttccacacagcacattgtaattgttacatcagttaacaaatgcaggtttgtctgttctccagttcagtagtttgcttttttttttttttttttttttttgaggtggagtctcactgtcaccaggctggagtgcagtgatgtgatctcggctcactgcaacctccaccttccgggttcaagtgattctcctgcgtcagccttccgagaagctgggactacaggcacgatgcccaactaatttttgtatttttagtagagaccgggttcaccatgttgtcaaggatggtgtcgacctcttgacctccaaaagtgttgggattgcaggcgtgagccaccgcgcctggccttgccttttttcttaaaaccgaactgtatctctgctgggggcagtggttcactccctacatgacagtcagctcctctcacccagcatgtcctttgatatccccatcactccccagttgagggtctcatccacactcagtctaggctttggttagcctccatagaatcagatagtcaccaaccacacagcatatgaacttcatccacaaaagaccacaatttgctttatcaagtctgatcactgcaacaagtctttttctaacaaaaaatctccttgagagcaaatcactaaatgttcagtaatagagaagacactaagtaaatacattgccgaataaagatgtcttcgtttaccctctcacaaagtacaatccttcttagtatttcttctgagagtgataaagtcagcttgtgtcttgtgttataaaggaatgttttaacttcaattaagaaact

SEQ ID NO: 12747 - DNA, 55328 bp, Human
ccccgtctccccagaaagcgcggccgcccgtgtctgtttttgagggtctgtcgccaggtggttgtgtagttagtggaatcggcggatgtttttgtttggccggcccagcgccgtcccgagtgctgtgtgctgcacacaacttcgcacagctcagcggccgcggcccctgtggccttgaccgagaggcccggcgcgtggccggcttctccctgggcgggcggtgggaagatggaagcggccgtcttgtgggcagccttccccgcctgtggcccgcagggctcttcgatgtacttaagggaattattccttgagaagctacgtgtgtgcccccgcggatccctcccagtggaaatgcttgtcccagtggaagggccagggacagaaccggcccaggggggaagcggtgaagcagaggaggtcgtgggtcgccctgccctgctgagggcctactttccccgggtcccagttgcatgttgagggtatggagctgctgtggccgtgaagccttcggttcagttctccccttgtagaaagtgttgcgatgaagagcttcacggctccctgggagagagtgggtttccaggggctgcttgtcgttagggcgactcaggactttgctgtcgaggggaaaatgacaggttcgtttctgatctggtgagtaaccaactgttgcttctgccccacctcagtaatgacgcgtgtcggcgtcccgggtgcactagggtcgctctctgcaggctgtggtgtcacctctgcagggctcacggggccggctggggggtggctgtgctgacagctccccaggaatccagggttgagtgggtacctggaggccctggagatgcagggggtctgaggtttggccgaccacattttctctcctattcctttctgtaggtaattgcaatctagtttcaacatacaatgaggatttctgtctgatacagagaaagatacccagtgtctggagggtctgtcttaagaagtgctcttgaagtctgctgggatttcctttcgggactcacagagggaagcctgctccctgagggctttttctcaggcccaatagatcagggtaaggctgctgtgggtgcccctgatccccctgggccccgaggccaggcgtccctgacgtggcagggctagatgcagagtatgccttgggcttcagctgagaatatttgttttgcgagtcagtcactgaaaaatcattttgcttcctgtcagtgaagtgtggcgctttggagggaggcactgcccagcaggcggtggtcttcacaggaggtgtccacacaccaggcaccctggggacagctaggaatagacgcagtccgtggtgttgggacagcagaggcctctgccacgaggagctggaggtatgggaggcagctcactggttttgcctacctctggaaaagcagattctcctaagcctctgtggccaagtcttcaggcacctgagccagcgctggcgaccctcctggtgagggtctctgcaagcagcgaggggttcctgggggtcacccctcgctgtggagcctgagtggagcgtctgccttcacgtgtgccggggagaacagagattccctttggcgtcatgcatgtgtctggattctctcagaaaggaggaggacgtggaaggaggaggacgtggccagcaccatggtctcagtggggcttgaggagtgcccctgaggggaaggggcaggttggctcagcctgtggtggtttccatggtggtcactgccaaggctctgcagaagcggggttggggcctcccaggggccaagactgtcccctcagaccagtacagggctcccctgttggtcccctgtgccgtgttgtgcgtgtggagggcctgtctatagaggatggacaggctgtgatctgtctcctacccctggccccagcaggaatgctgcaaggactgtggtgactctgggctcatgggagtgctctcctgggagtagtggggaggggaagagtggtttagggggagcatccgataggaccaggtagccactgagcatgcctgtctggtgggcatagcctctgtgcctggtggggtccagccctgtatgtggacttcctgggggaccgcctgcatgctgggaaagtcctgcaactgtgggctctgggccggacccctcctccttggggagcgttgctgtggtctccgcagcctgttggtgtggtctgagaggggactggtgtgtggtggtagggacgcaggtgctcaggagggctcctcaggctgcctctctgcctgttactgctgctccctccctggtcctggggactcgctcaggcctggatgtgtggttttggacaccttggaaagaggttagctgtgagttttgctttgattgggctttgagctgctgagctagatctgtccaagcatgcttttgtggttttctcgagtctttggtcaccctgcgtagaattacctttacttttgccttcattttaggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggtaagcgtgtccaagcattgagtccacaaggagcctgcagtgtgggaccctgggaggacgtgggcacagcctgcagggcccgtgctgtgtggtcattgcgtttctagttggcgcagcttcctaatattcccctgaagtgtggttctgcttgtttaccacgtctttttggggaatagatgttgtaaaagattttagtctgtaggcttggaataatctgtagttttctatgtttttttttttggagacggagttttactctgtcgcccaggctggagtatagtggcgcaatctcagctcactgcaacccccgcctcctgggttcaagcaattctcctgcctcagactcctgagtagctgggactgcaggcgtgcgccaccatgcccgacaaatttttgtattttttaagtagagacggggtttcaccatgttggctaggctggtctcaaacgcctgacctcaagtgatctgcccgccttggcttcccaaagtgctggaattacagcacttgctcagccttttttttttttaaatagggttttgctctgttgcccaggctggagtgtagtggcacgatttcagctctctgcaacctctgctgccaggttccagcaattcttgtgtctcagcctcctgagtagctgggactacaggcgtgtgctcccatgcccagctaattttgtatttttagtagaggcggggtttcaccatgttgcccagggtggtctggaactcctgagctcaggcagtctgcctgcctctgcatcccaaagtgctaggactataggcgtgagccaccatgcccagccgtgcgtgaagatttttaagaatttcagtgactaaactttaagaaggaatgaagcccacgcaggaactctgtatgactttcaacccgaggggctctggcctgggcttcccagtgactgccggcatcgggacatccactgctgtggccttggccccgtttcccgtgctgtgccccccacttgctgcagatgccctgaggaaagggtggccaaacaaggggaggagctgtgagcacagatggggcctgccggtcaacagggcgggtagagccagcctggtgctgagcttgcagcttggctgggggagacgcctagagccccagtaccacacagaccctccaggactgccgggggtcagtgagcaggaccctctgaggtgtcagacctgccccacatgtgaggggaggacagcacaggtgggacgcatgcaggctgagctgcatcgggcggtgaggctgggaggttgcagtgagctaagattgtgctactgtaccgcagcctgcgtgacagagtgaaactgtgtctcaaaaaaaaaaaaagaagttttaagtgatttttgttaatattactctactttaccaaagtgaagtccagtttcttttcacagagctgtaaatactcagataattagtcaattcagacagaatgaacaaaaaatgctcataatccttcccatccagggaaaaccctgtcaaaaccaaggtgtttgtctttgtaaattaatctgactttgaagagatggttttgcttggatttctacctatgagtcaaaaagtctagggtttgtattaagagcttctgtataagaggtctaaaaatttcagctttactgaaattgaagcaaaataaacaaaatgtgatctaacaaaatgaagagccaaaagtctgaagtgctcccttccctggccagtaccagatgatgacctgctctgggagaggccgggcctggccgggccgcacgctctctgttctttggctcctgatgttgggtaggcaggactgaaggaggcagtgtttgcatgcaggacatgggggctgaagtggccagggctgattgagaagaaaactcgacctaaatatttgaaagcatgtattggagctaaaccgcgtactgtgtggttctgttcttttcctaacttgggaataaactattatttcagcttcgagtagagagagagaaacaaacctggacgagtgttcctggccgcggtctctgcagtctgggtttcccagtctccaggagatgctggtgcttcaggccaccttgccaccagtggaggagctcccagtgcgcctggcctgttggcaccatggtgctggacccacctctggggtggttgtgaggggcaggctctcaatacagtactgactgctgcctgaaaccgggtttactgccttgctgtggtctgagaggcagctgatctggcagccctgttcttaggccctgggcactacccctgggtgcatgtaggaggcctcagctgtgcatttgaattctgtgtagatgagggtgaagcttcttattttttattttatgtttagagacagggtcttgttctgttgcccacgttggagtgcagtggcgtgatcatggcttacagtagcctcaaactcttggactcaagcgatcttcccgcctcagcctcctcccagcctcagctgggaatacaggcacgagccactgtgcctggcccatggtgaagcttcttgatgtgcagccgtgggcggggatgctgagtctagttggttatggtgtgcactaaccaatggctccggtgtaggacccacctagagcatctgaggatgttatgcttcaggccagccagtcacgctggaagggagatgagaccccatctgagcagcgttttagagattttagagaaagaggatcttccttattccctgtggacagaacagaatctgccttcagggacggactgcttttataattctagtggtttaaaaaattaaaatttcaagtaaaaaagatagttcttttttttccccccttttttttgaggtggagtcttgctttgttgcccaggctgcagtgcagtgcggtgatcttggctcactgcaacctccacctcctgggttcaagtgattctcctgcctcagcctcctgagtagctaggattacaggcacctgccaccacacccggccgatttttgtatttttagtagagacggggtttcaccatgttggccaggctggtcttgaactgctgacctcaggtgatccacccgcctcgaactcccaaagtgctgggattacaggcgtgagccactgcgccaggctaaaagagatagttttaaggttataatctgtttttttgtaagtttgatatactatgattaaataataacagcggtaaataaacactttgaaaaacaggcagggctgggtgtgtggctcacacctgtaatgccagcactttgggaggccgaggtgggtagatcacgaggtcaggagttcgagaccagcctggctaacatggtgaaaacccatctgtactaaaaatataaaaattagccaggcgtggtggtgcgcgcctgtaatcccagctattcaggaggctgaggcaggagaatctcctgaacagagtcctgctcttctgctcagacgggtgcagtggcatggttatggctcactacagcctcgacctcctgggctcaagcgactcccccacctcagcctcttgagtagctgggaccacaggcatgtgccaccatgccctgctaatgtttttattttttggtgagatggggtcaagcaatctgcctgcctcggcctcccaaagtgctgagattacaggcgtgagccaccatgcctggccttacattgatttattgttattttttcttttctgttcttcttttttttcctgagatgaagcctcgctctgttgcccaggctggagtgcaatggcataatctcggctcactgcagcctccacctcccaggttcaagcgatcctcgttcctcagcctcccgagtagctgggactacaggtgtgtgccacggtgtctggctaatttttgtattttttttgtagagatggggtttcaccatgttgtccaggatggtctcaaactcgtgacttcaggtgatctgcctgccttggcctcccagagtgctgagattacaggcgtgaaccaccgcacccagccctattttttcttttcacttcctctctccagcatacatcagtttttattaacggattgagttgcacctgtatagaatgacattttttttttgagacggagtcttgctctgtcacctaggctggagcgcagtggcacgatctcggctcactacaagctccacctcccgggttcacgccattctcctgcctcagcctcctgagtagctgggaccacaggcgcccaccaccacacctgctaattttttgtatttttagtagagacggggtttcaccatgttagccaggatggtcttgatttcctgacctcgtgatccatctgcctctgcctcccaaagtgctaggattagaggcgtgagccaccgagcccggccaggaggacattttgtctttagtcttaaaggaaaagggaaagtcttttccatttgcaccagtttgaaattagggctcccttaacatggattactgcaggactcattcacatgagagttcatacatggggtgaaaagacaaacagggtttcctgataactctttttggttattgcatgaaatgagggataaatacacgcataatctgtttaacaaaactcctaggttcatcagaatgcaaagtagaaagtgtcttaaaagagactgtgatcagcaggcagacggcctgtgtcggtttggttcctttgactgcttcagatcttctaggaggagctcctctactacgagagcctggacttcagcctcacggacaagaacctcagataggcaaggctttgtgatgggtgctcctcctaccttcattcgaatgaggttttcctcccgccttcaccctgatagggtgctcctcccgccttcactggtgtcattttattttgagtttaaaaggatgaactggtcttggtcagccttaggaagggaagcatcactcaggtgaaaatacgtggcgaactttaaatacctagatattctcctcatgcatttaaattagagtgacttgagctgttagaaaagttgactgggtgcggtggctcaggctagtaatcctaacactggaaggctgaggtgggtggattgcttgagcccaggaggtcgaggctgcagtgagttgtgatcgcacctttgtattccagcctgggtgacagagtgagaccctgtctctaaggggttttgcatggttatccagagcagtctcttgaattttggttgtctttgacgcagctgcatctggagatcctctatgtgaggcatgtttagagaaagagaaacattgacccctggaattgatattcttccaagaaatcttttagtcttgttggtaaaggcagtcctcagatggtaccggtccctttgttagtggtgagcctacagagatggtgcctggtgtgcagagcgatgtggttggatggaggtgaacagagcagtctagggcccctgggccgcctgctggtcctagcccatcacagcacagtcattcagcagacatgctgcaccagctgattgtttgagcttgggcttggtgcacatgatggagtttgtctggatctcctgtcttggtattccataggaagatgagttggtccagcccatgtcctaatagatgttgttagcaggaagtctgaacttgaactatctcacatgaagaaagttccttctgctgcctctttttatttctctttggcttcatgaacagtcatgcacccccagtgccatccttttgagctccccaaggcctctgccagacacatcacctccaggggtgactccttgacccaccgtgccatcaccactggctctgcaccccttctgagccattcctggagcttgaggcactgtgaggtcaggggaaaagggtcagcgtggcaaggagagatggtcacccaagctggggtcatagagcagcttatggatttcctggaagtcagtgggaactcatttgggaacccccaaaatgagtccctgtggggtgtctgaaatggtggcagaaggggcaggaatggggtccggcagttctcttccctcaggtcctggcggatggatagcaaagtcctgtgtagacaaggtcacccacaggtggtatatgccggctgctaagggccttgggtggcgggccttggcccccgcagtccagagagtgtctgtttactattccctgcagggtaggcaccttgggccccagaattcggaaggcacttttttcctacctggactcacttcctgcagtgttggaggccacctggccctagtctattttatagagacagggtctcactatgttgtccaggctgatcttgaattcctgggcttaagcaatcctcctgcctaggcctcccaaagtgttgagattacaggtgtgagccacctcgcccagccccagccttagtctgtagtctaatgctggagggtagtatgttgactctggaataaagatgtcactattctggaactttttctggggtcactgtcgggaggcgttgtctcccttgagcacttgctgcagccccaggctgttgacctgcacagccgtcctcagagggtggggaagctgttctgtcttgggggcgttgagtccactaggtaggccctgtgaggatcccagctgtcacctagtgggtacctgcagaggttttgttttgttcttttaattgaggcggggtcttgctctgttgcccaggcaggagtgaagtggcgcaatcctaggtcactgcatccttgaactcctgggcccaagtggtcctcagcctcccaaagtgctagggttacggattagagccaccggccgcggccccctttggcttgtgtttttaagtctttttttcctccatgtttctggctgttaattttttataaaagtttgtatctggcatggattgaagcaggagacactggctcagtgcccagtggggagagccctgtgtgggtacctcccgggcggtgtgggtgcatgagttggctgctgcgggtggcaccgggaggccctgtgtgggtgcctcccgggcagtgtgggtgcatgagttggctgctgcgggtggcactgggaggcatggcaggggccatgaggccacaggtggcagctccctgtgcttgacctgcatcgggtctggagtggcgggcactcgggaaggaagcgccaggacgacacattggaaggaggagctgcagggcaggtccagccagtgcctgggagctcgggagggcacctgggtggacgcagcctgcaggagcgcctgctctcctgtatgaggaacagacctgaatgccgtttcagacactgactcattcctgccctcctgtgactttgttggttttctgggttttagtgcagattgtagctggcagctcacaacagagcccttcctggtgcaggctgacaggcaggagggattctcctctacagaaatggacattactatatctggaaacagtttttttttttttcttctttttgagatggagtcttgctgtgtcgcccaggctggagtgcagtggcgtgatctacgctcactgcaacctctgccccctgggttcaagcgattctcctgcctcagcctcccgaatagccggaattacaggtgcacgtcaccacgcccaactaatttttgtgtttttagtggagatggggtttcgtcacgttggccaggctggtctcgaactcctgactgacctaaggtaatccgcctgccttagcctcccaaagtgttgggattacaggcataagccactgtgcctggcctagatttgttttaattgaaaaagctgaagcaaataaaaattgtgctggggaaaactctgagtgctcagagcatgggctgcgtttctcactggcctcaccgcaccttcctctgcactcagactctcctaaagatgctggcatttactgaactaaaggtagcatttcgcagagcagggccgtgggccatgaaccacagtcatctggccatttagacagctctgccctgcccccggcgacttgggtacccaaccatgtcattcccacccctagctttgtggggcaacgttcctctaggccgggttctcttccctgaagcaccccaggcatgtagaagatgttctcagcagaggggagacaccacagtgtagctgatttctgtctctcttcactttcaccatatttacttacttttggtagaagtggggttgaaaatttatgtgaagttttctttactactggggacagcggggcagattactgccacacataatcacctctgctccagcctaggtgctacctgctggaggcgatggtggctttcctgagagcacctcctgggctcgggctggtggggagcttgattttacctttttatgtggaaataacttcaaatttacaaaatattcacaaaaataaagagagcagggactacccaggtgctctacatagagttgcctgttgctggggctgcgtcctcttttgcacaccctgccccgtcggagaggatcccagatgtggcccttgcccatgcacgtcaggcatgtgaaaagagcaggtgtcccctggcgatgggcagcaggctttgtggtgccccagccttggtgcaggagtcccctgaggtgagattcagggctctggccggctggtctcatgtgtttcctgagcgatggatgtgggcacggcgtcctccacctcgcaccacctggcatggggtctgcgtgtgtgtcatgccagggttctgggcctgcaccgggggctcctgccctgcctgtgcactgtttgtcgggggcttgtgcccgtgggtgagtgtatcttttcatttttagtgatgtctttaaaatattcttttttagtttggaaatctttggagagagccccctgttctttcactcaactttagaagttatacgcacctggccagcctcccctctcccattccttccattccattgttttgaagcgagtcctggccatggaattccgttcgtgcacccgtcagtgtgtaaaggttctgaaaagcagcctgaattttctattgtctgatgaaccgaagtttgttcatttcatcgtactcctcaaatttatcaccctttccccatgtggcatgtgcatgctgggtctgcttgaagaaactcgtccccactctgcagccgtaaagctgctccctgtatttcctctaggagtctttacaaattttttttttttttttaaatggagtctcactctgtcacccaggctggagtgcaatggcacagtcttggctcactgcagcctccgcctcctgggctcaagcgattctgcctcagcttcccgagtaactggcattacaggcgcctgccaccacacctggctaatttttgtatttttagtagagatggggtttcgccgtgttggccaggctggtctcgaactcttgacctcaagtgatcgcccacctcggcctctcaaagtgctgggattataggcatgagccattaatggctcctggccaaaaatttttttaataaaaataaaaggctgggtgtggtggctcacgcctgtaatcccagcactttgagaggccaaggggggcggatcacgaggtcaagagattgagatcatcctggccaacatggtgaaaccccgtctctactaaaaatacaaaaattagctggtcgtggtggtgggcacctgtagtcccagctactagggaggctgagaggcaggagaatcgcttgaagccaggaggcagaggttgcagtgagctgagatcatgccactgcactccagcctagcgacagagcgagactccatctcaaaaaaacaaaaaatagagatggcgtctcactgtgttgcctaggttggtcttgaactcctgagctcaaatgatccactcacatcagcctccgaaagtgctgggatcataggggtgagccatggtgcccggccacctcgaggagtcttgagccctcctggaattgctgtttggtgtgaggttgggtcaggcctggtgagtcatctgggttgtgagccagcctgcttggcctcctggtctcaggccagctgtgacctggaccttgggccacccagcagctttgtgctgagcctcagtctgcggttgggagggcaccccttgtctccagaatggtcctggcgtgtgaggtccttggtgcgtccgtgtacagtgggcggcaccttgtctccagaacggtcctggcgtgtgaggtccttggtgcgtctgtgtacatgggcggcaccttgtctccagaatggtcctggcgtgtgaggtccttggttcgtctgtgtacagtgggcagtagctttaaagttcctgcttcaccttgtcagacttctggttagagtcctcccgacattagtgttcctttaggaagcttggactctttacaccgttaattacactgttaatttcacttaaacatggaggtggcccagtttgctgcccatgtaagactacttttacttttttgagacaaggtcttgctctgtcgcccaggctggagttcagtggcatgatctcagttcactgcagcctccacctccagagttcaagtgagtctcatgcctcagcctcctgagtagctgggattataggcatgtgccacgactcctggctctctctaggacttctttaatgtcataatagaagctgatggttttctccataaaagtctattagatttatttctaggcacttgttaatatagtacttcttaaaattagcatttttgtttttagctatgtgttgtagatggatacaacatgttgtaagattcttttggatcgtctttgtggacagtatctgtgaagaatgactcctgcctcagtctcccacttgaacccaggaggtggagcttgcagtgagccgagatcgcgccattgcactccagcctgggtgacagagcaagactgtctcaaaaaaaaaaaaaaaaaaaggagcagactgtgctccttgccataggattttatccatgttcttttatttctgcctctcaaatactgtttaatcttaacgtatttttaaattttgtgtgatttttctgtttttgagaggaatttttgatatgttaatactatagatcttagtatattttaaaaactgatgatgtttgatacatgccaaatcatgtgtggaccataaatgtaaatagcaatgcccacaaacccacccatagcctaggaattgggagactcagcaccgccggctgaattcgcctgtgcggtgtgtcccattccatccctgttctgccgcccgtgggggaattttgtcagcttcactgagacacttagtaccctccccttacctgtggttttgctttccatggtgtcagttgcccatggtcagccatagtctgaaagtattaaatgggaaattccagcagtaagcagttcataagttttcagttgtgcaccattctgagcagcgtgatcacagtctccctgtcgtgtcctgcctgccgggagcgtgaatctaacctttgtccagtgcacccacgccgtgcagctgcctgcaccttaacccgcttagtagcaggtaccaacatccaggctggcgctcggtcctgttccaagtttcaggcagccgctggaggtcttggaaccatcccccttggttaaggggggactcttgtcattcacacaccatgaaatttacccatgtgaagtgtacagttgagtggattttagttcacagagttgtgcatttatcaccaccaccaattttagaaatttttatcacctccaaaggaaaccctgtgcctcttagccattaccccaacttcccaccttctcatcctcccccagccctggcagccacccatctgcatcctgtctccgtgtatttgcctgttgtgggcatttcatagaaatgtgtttttttgttcttttatgaaatgtgttttttttgttctttcactgagcatgtttccaaggtccatccatcgtgccccctgggtcggtgtgccattccttttcacggctgcgtaatgttcattgtatggataggccacgtttaaaaaaatctgttcatcttttgatggatgtttgtttttttcctactttggagctattatgaacaatgctgctctgaacatttgtgtaacagtttttaggtagtgtgtttttatttctcttgggtatattctaggagtggagttgctgggtcatgtggtaatgctgtttagtattttgaggaagtgccagattgttttccaaggcagctgtacccctgtatattctcaggcgctgtccttttgatgatacccattccatggtgcaggggcagcgatcgctcgggggttttgctttgcagttccacagtggctgaagatgttgcctggccatttgcatattttctttggagaaatgtctgttcagatctttgccatgttttcattggttagctgacttcttactgttgtcataagagttctctgttctgggtactagactccctattagatacatgacttgcaaatactttctcttcattctgtgggtcatcttattgttttattcagtgttctttgaagcacaaacatttacaagttggatggagtccagtttatctgctttctcttcggttgcttgtgcttttggtgtcacatgtaagaagcctttgcctaaccaagggtcttttaataggagttttatttatttttatatgtgcacatatatatatattttaagagctggggtctcactgtgttgcccaggctgttctgaaactcctgggctcaagcaattttctcgccttggcatcccaaagtgctgggattacaagtgtgagtcaccgcgtctggccactgttttcctatatatgataatttctacctttacctgatagcagtctagaagcatgtggggcttgcttgcttgctcgctcgctttctttctttctctttctttcttttttaaccaaattaattttttaaactcttgatatccattgcttgtgctgtgggcaaaggacgtgacctgcatggtacgcattcattctttgatgcttgttgagactttatggcccaataggttatacattttttataaatagtccatctgtgcttgtgaatatgtgtgttctttctttctttgatgcaatattctctatgagcttgttgggtcaaatgtataagtcatgcttacatttttaatatccttaatttatttttgcgtgaattggtttcattaggcttgtaggtttaacagttctcattgtagctcctggaggttttgcatttgatattttcaagatgtcccgttaggcagtgtgtacgcatttggaatttggtcacttccttcgatcatggtccagtagccctcatagccctcttcactccagtcatggtgtttctctggcctcagttcagctgatcggtcagcagtacccactttctgctccttaatgtacacctgaacattttccttatgtccagcttcagccttgctgtggtattttaaaactggaattacatatatatatatatatatattttttttggagacgaagtctcattccgtcacccaggctggagtgcagtggcgcgatctcggctcactacaacctccgcctcccgtgttcaagcgattctcctgcctcaagccttccaagtagctgggattacaggcacctgtcaccacgcctggctaatttttgtatttttagtagagacgaggtttcaccatcttggctaggctggtcttgaactcctgacctcatgatccacctgcttcggcctcccaaagtgctgggattacaggcgtgagccactgcacctggcctaaaactggaattttaaatttttaaccagattgacaacctcttcattagcaactttagactgttgacttatgttggattactgatctattttggatttgtttccatgatcctttttttccctttttctttatttttcctctgagactgagtcttgctatgttgcccaggctggagtgcagtggtgtgatctcggctcactgtaatgtcttcctcccgggttcaagcagttctcctgcctcagtctcctgaatagctaggattacgggcgtgtgccatcatgcctggctaatttttttgtatttttagtagagatggggtttcaccatgttggccaggctggtcttgaactcctgacctcatgatctgcctgcctcggcttccaaaagtgctgggattacaggcggaagccactgcgcccggctcactttttcttctgatgtattgactcagatggttttgctgttttggagtcgggggcatttttcctcctctactcatttggaaggtgcacattccatttaactctctgtattcaagttttttcagtattttactgtggtcacgtacacataacataaaatgtaccatcttaatcattgtaagtgtatagctcaggggcatgaagcactttgatattgctgttgctgtgcagccatcaccaccatctatcttcagagcctttttgtcttcccagtctgaaactctgtcccagttaaacaggaactccccattcctccctccctggctgcgggcgttcaccgttctactccctgtctccatgaatttgactcctcttcagtccctcacataagcgcaatcaggcagtatttgtctttttgtgtctggcttattgcactgagcacattttcaaggcttttccatgtcattgcatgcattggaacttccttgccttttaaggctgaataaccctctgtatgtggagataagcttttgcttacccattccttcctccatgggctcttgggttgcttccatgttttagccatcgtgaataatgctgtgaagaacatgggtgataagtatctgagcctgttttcagttcttttgggtgtatacccggaagtgggattgccaggtcacacggcatttctgtctttaagtgtttgaggagccacaacactgttttccacagcggctacacctttttacgttcttgccggcggtgcgcaagggttcagggtttccacatccttaccaacattttttttttgttttttgttagtattttttgatagccattctaataggtgtgaaggtgacatcatagtttggatttgcatttctgtgtttattgagcatttgcacttttgaagaattgtctatttgagtattttaaccagttttgaattggattattttttgtcaagttttaggagtttctggatattaatcccatttcagatacgtgatttgaaaatatttcctcccattcactctgctgtgtgtcttttaatgcacacattttaacatttttcatgaagcccagtttattttttctttttgtttcctgtgcctttggtgtcttattcaagaaatcattgccaaatccagtgtcatgaagcttttcccttctgttttaagagatttatagttttaggtcttatgtctaggtcttcgattttgagttaatttttgtgtgtgaaatgaggcaaggtccaacttcacattcttttgcatggccatatccacttgtcctggtgccatctgctgaaaagactgtcttttcccctctgaatggtcttggcacccttgtcaacagtctctgctggatacgggagggttcgcttcagggttctctgctattcccatggtctatatgtgtgtcctttcgtcagcaccgcactgttttgatgaccgtagctttgtggtaagttctgaagtcaggaagcgtgacttttacagctttttcaaggtgatttggctgttgggtgttccttgagtttccatatgaattttagggtggattttcctatttctgcaaaagacatcattggtattttgataggaattgcattggatctgtagatcactttcggtggtattgacatcttaacaatattggtcttcctatccatacgttccctagtgcatttagtgggtcccatggtaaagtatttatgtgtcagcatgtagactgggcttaacaaaaatccaaggaatacttgatgttggaactctggtgacctccctcatttccggggttcttttccctggtgtgggttcttttttttttttttttgagacaaagtctcgctcttgttcctcaggctggagtgcaatggtgcgatcttggctcattgcaacgtccgcttcccgggctcaagcgattctcccacctcagcctcccgagtagctgggattgtaggcacgcaccaccacacccggctaatttttgtatttttagtagcgacggggtttcaccatgttggccaggctggtcacgaactgctgacctcaggtgatccgcccgcctcggcctcccaaagtgctgggattataggcgtgagctaccgcgcccggctcctagtgtgggttctgacttgtctgcagtcatccctgaggtgggcattgcggctgctgcccccaggcctccttcatcttgcccgtattgccggcatctcagtccacccagccctcagggactgctttctgtggttgtcatatgtatgtctttgcttagttttcttatctgaggtctgtttccccttaactcttctgtccgagttgagtgggggtgctcatcgcctcagctgggaagctgctcttccatgctcttcctcactctaattttggggttttcagcctcttgctcacatgagctccctcagcctcccaagtagttggggtcacagacgcacacctctgcatctggctcttaagtttttaaagcattttcatcaaagcctttttgctcacaacttgtgggctgttgacatttccagaagccctgactctggagaagatggtggcttgttgtgatgaggtcagaattttttctcacatctcatgggtcagaagaaataaaaacaaacagaatctttctttctttcttttttaagagatagggctggctgggtgtggtggctcatgtctgtaatcccagtacttcgggaggctgaggccaggagttcgagaccagcctggccaacatagcaaaaccccatcttcactgaaaacataaaaattagctgggtgtgggccgggagcggtggcttatgcctgtcatcccagcacttgggacgccgaggtggacagaaacctgaggtcaggagttttgagaccagcctggccagcacggtgaaaccttgtctctgctaaaaatacaaaaattagctgggtgtggcaacgggcgcctgtagtcccagctactagggaggctgaggcaggagaatcgcttgaacccgggaggcggaggttgcagtgagctgaaattgcgtcactgcactccagcctgggcaatagagtgagactccatctcaaaaaaaaaaaaaaaaaagactcactgaaccagaagagttaagtgttgtgctattgactgcacatggtttgcctcagtcccaagtggtaaaaacagactgctcccaaaacagcaggccatgaggtgaccaggtccagcccagcccagcctgcagaggaggagccctgtggggctgtgatcagagcccagcgtcccagtgcacctgccgatgccctctccagcctctggcttccttccgttggctgtccttggagggctgtgcttcgtgggcaggcgtttggtgtcctgagcatgcagactgcccttggagtggtgggcaggattgttttagcctaaaggggttccacatctgcacgggagctcttgctgatgggtcactctggcaaagttcccccggcgggttccctgtgagaaggcacctcacggtcagttctgggtctggtgagtgttctcctgcaggctccacgcttgagccaggttctgccggaagaggcggcgttgggttcccttggtggatgagaggcgccgagggtcttggtggctccatgtgcccccaagggcagcactttgcatttcttgggagacttgaagatgactgatgtcattttagtgagcacggtaaaacagcacctgttagcggcttataccttgagctctgtctctcttcttggaggtgacatggggaccagtgcccacctctcccatggcgtctgagtggacagtgtctaaggttttgggcccgctgacacagatgtggttgaagtcagcttgtgtgcagatggggtcacatagaaagaatgaaaactgttgaaggctttgctcagcatgttttctttttggatattcaatctgataaatgttgtagtgaatgagaagtggatgaaatcttttttttttaattttatttttgagtcagaatctcgctctgtcacccaggctggagtgcagtggtgcgatttcggctcacaccaacctccacctcccaggtttaagcgattctcctgcctcagcctcccaagtagccgggactacacgcatgtacctccacattcagctaatatttttgtatttttggtagagacggggtttcaccatgttggccaggctggtctcaaactcctggcctcaagggatccccccacctcggcctcccaaagtgctgggattacaggcaggagccactgtgcccaacctaaaaagtggatgaaatcttcaaatggttggagatcgtgaattttgttttagcagcactagggatagtagaaatacaggtgtcatggcttagggagaaaaagtatgaacacatggttttgttagcagtagtactgtcatttctagtttatgtgatgaaacatcttaatgtactgcttcaaagatacactgagtgtttgtgttttaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcaggtacgtggctcgtggcccccacagcctttctgcgtctctcacccccaccctccagggagagggcacctggttcaggctggtcacggtgctgccccctgggctcaggctccccgttgggaagcctccgtctcgtccagccctggagctgtaggaggagtcgggtgcactgggctctggatctgcgactcggggggtgattctcatccatgcctgtcactgggtgtttcttccgttttgagttgcgctcccccgccctgccctgcccgcacacacgctgatgggcagtggccagctctggggactggggatgctcagggatgtgttatgctgtggctgcatgagcgtccgggctggggacagcaggagtgggacccggtgagcacacccgggccatgtgggtgggggtctgtgtgctgggcctggagggtgggttttggaaatatgtgaggagtggtttatttcgagggccttgctctgaaggttggtttagctgggactgtggtggggtggggagggctcgagagagctgagagagtgggagggaaggagcaggacttttcctttttaaaagaacaaacccaaactcttacattttgatagtaggtttgagtttatagactcatctgatactgtgaaacagttctgaaaaaatgggtttacagagtgaagtagcttctgtgagatgcacaaaagtaattgaaaacacaagcagctctgcacacggcccaggacctgcggccagcgccctctgcccacgctgcctagtgaggagccgctggtcttttggaagagctgtctgctgctggcgtcgcgtggcctgagtgcctcttggaatttcctcatggtgcttttcactgccatcctgggcacgaagcgaaaccatcctgctctgctgtgaggtggtgacttgctcacaggaagcttgagtctacagggttcacggttgggtccccgtgcggtggtgcggtggccggtgctgtctctgcctcgcagactctgcctctgcagcgtgagccctgttcagtcacctgccgtggctgccttgtgctccagggaactacagagtctggtgctctggtctggcaggtggtggtttgtgggtctgatttggtgtggtggggtccaaagttttctgacggccttggtgcgtcttggctgtggaatattccaggtctcccgtgccgtccacctgggttgccccactgtgtgtctgtccatggaacttggggctccccgggcaggtctgtgagccagcccctctccaagtgagatcctcacgtgtccacagagttgaggcttcagtgaatgtcttttggctgttgaatgagttaaccgcatcttccgttccatgatgtgacttggctttccatctctcctctgtcctcacctcgtagcctccagggctcctggaaaggacagcacggtttggggggctcttaagaggccagagtcaggaagtggctgagcggcgggaagctctgggggctggaggcattggtctcggcccccgcgatgttggggaaaggaagagagtggaggcattggtctcggcccccgcgatgttggggaaaggaagagagtggaggcattggtctcggcccccgcgatgttggggaaaggaagagagtggaggcattggtctcggcccccgcgatgttggggaaaggaagagagtggaggcattggtctcggcccctgcgatgttggggaatggaagagagtggaggcattggtctcggcccccgcgatgttggggaaaggaagagagtggaggcattggtctcggcccccgcgatgttggggaaaggaagagagtggaggcattggtctcggcccccgcgatgttggggaaaggaagagagtggaggcattggtctccgcccctgcgatgttggggaatggaagagaggcttttttgggaggaagttgagggttcagatcttgggtcttatctcggggctggacagaactccaggtaagtcacagaggagctgttgaagggcagattccatggaaagtgggcatggatgtggccaaacgggacgtccagcggtgggaatcatcatttctactctcataagctgggacacgagggccagaatccctgcagtagcaggacacgtgggccagtgggcaggggccacggggacccaggcagctgggggtggcctggggcgtggtggagccaggcaagggaagggggagggttgcaaagaagaggtgacccgctggaacctgccagctgggccccctctgcttcatcgctgcctgttaggcctcacgtcctgttgtgtgcagaatacgtttgtaaggagagaacatccccacagcccggccagagcagctcttctggcagagggggcagcttctcgaagtcacctgggaaggagcagaaggagctgcctggacttgagccgcagcagagcagtcggcgtggagagcctggaaacctgcctctgtgtgaacgggctattgggagagactgtgcttctgccttctcctggccagggatggccacggcttggtgtggtttcatggttttgaagctttggaagtacctgatgcatttgattcctctgtgtctctgtgtacctgccccagcctgaccctgtggtgggggcaggtggatgaactggacggggtctcttgagaggccagcaggcgccgagggtgctgcagcgatggcgggtctgtgctggctgcgcatataggccctggtttttgttctggtgtgtgtggccgttgaaggccgcagggagaacgggggcggcagcttagctttataaagggtgagcagcgatttgtgtgtatgctggtggcgtcccactgtctcctgctcccgtggcccacccttcctgtcctgggagcgcatcctgcagctttcccagtgtctgtcctgtggcatgctgggcgctgctgcccacatcgtccttgctgtgctgcgtgtgtggcctctgccagtcccacgcacctgctggcggcattgggcccagtggcaggagctgggtgctgttgccaggaggcctggggtcggccactctgtaacactgtgggccctcaccccaggagctggcctgtgcctcccagcagaggcgattttaacctgaccgtcgcctagccctgccctgtgtctcccccatgtgtctggaatggacgcggaggcgctcagcttcttcccggcagtggggatgcctgagtgcttcttcacttctgtcctttctcgtggagcctcccactgttgatttttacatgggaaatatcgagcccttgagagccgagtaaggaaccttgatccttctgagtggatgaggctgcatgtgtcatgggaccttgggcccaggtgctgtcaacggggcccctgccactgccgatggcgtttgttaaaccaggttggggagcagactagtaagtttgcttagcagccagtgcgtgataaagggcttcctggtgatgaggagatttcttccgcttcgtaacagattcccaggccaaatgtccttttggccgaggttttcagaagtgtcgattgcaagctgagggacaggcaatactcagatgctccggggagcttggtttttggagcccacattttcctgcctttgcttgagttgatgtggatcttgttactcttagccccgatttcctgcctgagggtgttcagcagcattgaggaaaacccagagatcctcacttcaggggacatcagcgcagcaacgctctgcctcgccatggagaggcctggccttgggggtgggggtgcggggctcggcctccctccttgagcctccttttctgagcagtttggagtccggggtccttgcatcttgtagtccagcagtctttgccttcacaccctcggtcctttgaaaagctatgacagtaccctgaggtgggcaggtgggaacccggggacagaggcgttgggggagaggagggtctcagggctgtgaagcatgtgccagaaactgatggccacggctgtcctgaggctggcagggcgcgcgtgtcctgcagctgtggaggatgacaggtgttgggggcccactcaggccaactccctcgttgacttcctctcccctttgaggtagggtcagggtgccccggcactgtgacgagcaggcctcatgcggccaggcctgggggacatggtgaggacagggctgagggcagacccaggtggcctactctcctgcgaccatctgtgtcatggcctttgcagggctctgattttcttctgatcaccctggtgtggatgttggctgggttgaggctggcggcctgtgctgtctggcgcactcttctgtccactgagaagggagcaggtgctatcaatggaaatgggaccctggctgtggggaaacgtgtgtcgggatggaggcgctgtgcagggcagggcagcaggtcggctgtgtgccaggcccccgtcatgctctgtccaagccaggatgggcccagcatgtggttttctgtgcacctggtttctttccagccgctccctccattcccagctgtcctggaggtgggtcctcaagggtcccccattctgtcctggccccgcctttgtgggcctttctggttctgtgaaggccccccccgccgccagcttgcggaggcctctgtcctctctggagggtggaacctgtgcaccggggccagccccctgctcaccttggcctggcggtcccctctgtcccctccatcccctctgtctcctctgtcccctctgtcccggtgctgtcctggggctctctagtgagggtggtctgttgtcctccccaggatgggcctgcaggacccctgacgtggatgcctcttggggtctcacctgcatggtatctgaggccttttgcagaaggagcctctgggtttgactgacggaagtgttcactgttctcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtggggctgggcctgtcccgcgtggagtgcaccactggccacggggcgtgggtgggacgctggcagctcctgcagagggtgggctgcacccggtgggtcctggcccacagcagtgccttgctcagcccaggctgggtgcctggctgccatgggttgcagagccctaagtggaggctgcgttgtcctatgcctggacggaagcacaggagcctgtgggggctgcttgtggctgtggggcgcgtggtggggctgagacgcatgtgcggctccctaaagctgaggctctgctgggcccccccaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtgggtgtttgcggcgctcgtctgtcctgccgcatgtgtgactgtggatttgtgctgccgtttgaccgggaaacgtgtgattggctagagtacatcccttgtgttcttaattctcgtttttatttaacgtatttgtttttaaattataaaagtgatacatttcattgtaaaatactgaaagtgcagtgggcaagaggccctgtgcagacagtaccctgggctgtggcagcatccgcccggcaccctccagcgtgctttagctgaaggagctggggtcgggaaggtccctgcagtacttgggtcttatgtctgtaccgtctgcgtgtctgtgtgtggctctcagataggatgggcttgtgggttatatggaataataaatatagagtcaactaatatcctgttttagtttgtaaatgattctttttcctccctaaaattaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacggtaagaactggcgccgtgtccggaggaggtggaagacgctctttctagcagactctgtcctgctctgtgttgccagctccctatcagcatggtccgggagccactagcatgcaaccgcatacatcatttacattttctagtagcctcactgaaaaatggaaaagaagcaggtggaatttactttaataatatgtcttattttactcagtgtatggaagagttgatttcaacatgggatcggtaaacgttactgaggatatataagcttttcaccttctttgccatctgatgtgtattttacgctcagcacctgtcacttcagactggctgcgttttgggtgcccaccaagaggactgtgtggctgtggctccctatggggtggccggtctcgacgatgcagacccagaaagcagcttagttgggggttttcatccagagtgggcctcggctaacttctgagggtggcgtgaagccggaggatctctggctttgcctccagccctttaacttcgtggtttgcgcatgttgtagaaagggctctgggagtgtgtccacggcccacctggactccagcctgggcttgtgcttcttggttgcccaggcacgtgttgcagccatgtgtagtcacctgcacccttctctagactggtcctcggaaaccggggctgtcccctgcaccctgcttgttagtcgcacctctgggattgtctgtcgaagggtgtgtcctgcccacatgggttgtcaaagcacatagagctccagcacctcagctccagctctgagccacaaactgagcagaaatcacggtgtgtttggcttatttgtctaaaggtcccatatccctgatttcttggcctaccctttctcttgatgaatcactgacccgtgctaggtcgcttcttctgggatgaggcctggccctcttcctctcttccacgttcccgccatcgcggggtccacgttcccgccatcgtggggtccgcttcccgccatcatgggattcaaccaagctgggccatcgttgcttcgccctctgttcccctcatggcagcagtgctgggctccctgcttcccgtggggtcccgcagcactcggcacctgtgaggattggaggatgggctgtactcttttaaagactggggatagggccaggttctgtggctcatgcctgtaatcccagcactttgggataccgaggcgggtggatcacttgaggtcgggagattgagaccggcctggccaacatgcagaaaccccgtttctactgcaaacacaaaaaattagccgggcatggtggcgcatgcctgtaatcccagctatttcggaggctgaggcaggagaatcgcttgaacctgggaggtggaggctgcagtgagcggagattgtgccattgcactgaagcctgggtgacagagtgagaccctatctccaaaaaaaaaaagaaaaaagagagaggccgaggcgggtggatcacgaagtcaggaggtcgagaccatcctggctaatgtggtgaaaccctgtctgtactaaaaatacaaaaacaaaattagccaggcatggtggcgggcacctgtagtcctagctactcgggaggctgaggcaggagaatggcgtgaatccgggaggcggtgctctcagtgagccgagattacgccactacactccagcctgggcgacagagcaagactgtctcaaaaaaaaaaaaaagaaaacacaatggaaatatatttttattctttgtctctgattttctgattttaagagtaacacgtttttcttggagaaatttagaaaataaacacaggctccaaacagtgctgctggctcttggtgaacccgggtggagctttaacccctctctgaagctgcgctctccaggctgatcagaccagctatccttttccgaaacattcccttggggacctgagaggagccagggctgagccgcctcagagtgagcccagggctccatgggctcatgcttgtcctggaaggtccttctctagcctctggtgaccgtgggaaagcttcccccgcctcccacagccatcacgctctggcttggatgccttgcctgccatcagctctcagacgcccacctggtgcccgctgctggctgctcaggacgtacgctggttgcctgcccttcaaagcaggaagatgcatcactcttggactccctgtcttcttagcagcccggagcctcctttgcccctagggccctgctcctgtgctcccccacatcatgctcccagcaccatgccacctccctcgaacagagcaggtgtggaggcctctgagtgtcagcgcctttcagatcatggtcatgcaagttgttaagtgaatttctacacccgggtttttttgctaaggagaaaatgaaggatgagaagtcctggtttctttctttctcagtatttgggagtgcacaggtgagccagtggccatggtgtgccttgagggtgcacctgctgctcttctcagcacggccgacacctcccattgcctggagcctgagccacagacctggaggccgtgggtctctgttttgaaagaaacagacgtttcgaggctttcttcttggggtttcaaaggatatgtttttttgtatgaacatttttgagtattatctatgacatttgttcagagtgatgttatggatacgagtcttgaaggactgatttgtttctctctactactttatttattcagccaaagagacagatgctttcagtaaaacacctgtttctagatgaagagagttcatgtgtttttgggcagtcttacttttttttttgtcttctctctccttcttgctctggttttatcttcagatagctctgaggagcagtttcttttcttggccatctcttacttatttaaggtaatttgtgctttataaattttggtgtttttgaaagcgaagtttctagggactttgtagtaaatacgtctgaaattcagaatgatctgtgaattttacaacccgtttactaaagccacacaatgatcagcatctgaagacttcagctaagacaccacttaggacgtgcaatggccctaacttaacacatttgccagtcgtcacctctgtttgcagagccagcgcaggtccagctgagttgtgctgggttggtggagcgtgcgcctctctctggggtctgtgtgctgtgccctcacccaggcagccaggctgtctgcacaggcagcctcagtgggtcctggtccaggagaggttgcgatcttacctggacgctgccccttctgtgctgacagtgtcatgggagtagaaattctccatcaggagcatcccagtgtgttcctgtagcagcagctactcgtgggttcagagtgcaggggaggggcctctggtgagcagggcctgggcctcgttgctaacagccactctcagggccttggccgaaggtgatttgaaagacgggaccggtgatgtgttcccagaaggtgcgtgggacctgatgactgacagcatgtgtcctttggttcagtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaaggtaagccacggtgagggctgccccgctttcttgccgtcacggctcaggctcaggcacaggcacaggcacagacccagacacgggcagcagcgttggtgtgcacggaggctcaggttagcgccagttccgtaaaattcacaaatcccggaacacttgattttcccactgggctgttgtttccttttaaggagacgttatcatttgtgctgtctgtgttttctcacataatcagttgataaaatttaaggcacagaataaaatttttctctttaacttgggcctgagaaactatttgaaaagaatggtttagatcttacactgtgttgaagagtaaaggtagcctgaatgatgagagtgagaaatgtttttgttgcattttgtaaattggcggggagccatttaattgtgcgctaggccatcaaatgcagcattttgaaagggctgttttagattattggcacttaaacactcctccctgatgttgtgaagggagggacggtacctgcagaggccttgtctgccccgagggtccccggccagctcctctgcagagttggtaggtagcagccgtgatcgttgccaaagaatgtctggggaaaggtccaggcagcaaagatgtttttatgactaagaaataaatgtaggagaagaaatccgcctatctagaaggagaactagcaaaacccagggcaaatgcaggcttggcatggtgaggagggagtttacgagcgatggtctgtgtacatctaggttggcagggtgaggaagtagagctggtgtgtcccatatttggtgaaagaggaattttaaaactaaatcggatttggagacgttgatagaaagtcattgccactgtgttttgccgtgtgtctctgcagttgaccttgacacgctccggttacacgaagcagacagtagggtcagaccctcttgccacaacattggcagctggttctcagccttcttgcccttcccctgcacatccaagtcagaacagcagacagttgaaataagacacagaattgttgtacaattttcttttaaaacaaagacgttcatctcttatggacgtctgtgctcggagtgacgcagtgtcttcatgatgccacacaggtcagcgggtccccatggtctcagggcccttttcatcccctgaacttcttgtggctcctgtctgcagagcttcgccccttttatcctgttttacatttgggcaacttgaatgagagccattaagcttttctttctcttagaaacttactcctgtgcacacagctgagaatttcttatgcatccttttgctcattttgtgcctgtttgttgttctgttctgggattcttctgtttagttcaccatagtatagtacccagactctagaatgtctcttttggggctggcgtcaattacgttaggtccatagaataaaggcttttctatttcaaggtgagcgcttggttttctcttctcccaaaggctgttattgttggcacgtgatccctcctctgctttgggggcctcgtgttttttctgaggaacgtttgcctacaggaccctctggcagccatacctgtccgggccctgggccgccccattgtgcccaggagtccaggctggtgcctggtcccgcagcctttgcttccgtgcagcccaccgaggcatcctctggctgtgtgggcctccctctaggtggactgcccttctgtccttgtcttctgtgccctgaggactgagctgtgaggaggttgccagcaggtccactcaccattctcaaaatagcttccagcgcttctcttcgcacacagttgtaccattttcactgtagagcagtaagttacctttttagctttttttttttatcagtggcttcctccattgccattgggtcacagggctgaggaccccgcacggttattgggtcacaggactgaggacctcgcatggttgaggacctcgcatggttggagctgcttggccctccgctgtggtgagcgtggctcctcataacacccaacgcttagcaggagcctttggagaccatttttgttgctttgtagctctggaatcattttatttttattttttttctggggccattgtaaggaaaacacaatgtgactgagacacaggtggcctcgaatcacctgttacacccaatgttcacaatgactcaattgatgaaaagggcgtttcctgtgagctgatgggaaggtgggtggagaagcaagtggcctgaaagtccactccgaggtgaggcgggtggggtcctgcccctcagagaagttgggggtctctggagaggtggggcgggcggggtcctgcccctcagagaagatgggggtctgtggagaggcgagtgccagactggaatggggaagtcattagggaagacagccacaagcaagcttgttggttggtatagaaatgtgacttacgatacttataataggatgaaaaccaagaatcagacatttaaaaacccagcatgaacgttctcatcagtaaagcctctccatcatttttcttaaatataaccacaatattttcacacctgaaaagagtaattcctcaatggcaaatacacagtctcacttaaactgtaatttaacagtctgtgtgttgtgtttatattttgcttccacttgaagcagcttgaacaaggctgtagccgttgagtgccaggcccctgagactttagtgtctgaaggaaggagatgcctcctgggctgcactgttggccccggtctgccccttgtacaggccctcccgcaggctctgccgtagccgcgactcagtctgccgagtgcagaggttcgggctgttgctgtgagctggccctgccagggctgacttccccggggctgcgtgtcagctgggtgggggccacgccacagctgggattccagcctgtctgatgagcctgtgggacggatctgcagctggcagagggcttgtctccaccctgtgctgaggttggtgtctgctgacatggtgaggcaggtcagtgcagtcaggaggagcagggtccgcaccgtgagctggtgaaaggggcttgcatttcgagtccttgggatttccagtcacagtgatgcccttgccagaggctccggggcgtcccctttagtccagggcagctgtggtcccttgaagtgcacgtgtggaagtccccctgccgtgcacgggcgctgagcacgtggagaactgtggccctcaggaaaggaaggatgcatgttcctcggggtagaaggtgcggagtacgcagctttgtcccttcaggattgcagaggacggaggcttgaggcagggttgttggagggacagtgtggttgctgctcgtgagctgaaatgtctgcctgtgttacgctgtgattttccaaagcgtcttgtggcttcgatacagaaacctttgattgacatagcaggtggccaggtgggcaaaatattgcggaattgttcttgcagacttaactaggttttagtttcttagagtagctggtttggattagataaccattttgccatttggaatatgtgacaagttccagggactggaattctaggatcctgactgatacattgacggggtctgagaggcttatgcccgagttgtatcgagcatgttctgagcttttcccatgtgcagttcagtgacagcctgagatggcccagagtcagtgagctttgagaggagtcttccttcttgtatgtcaacttccagtcacatttccactcgagggacgggttgggcttgcctgttgtgtcgtggagcctggaggctcaggtcctgtttttttctgattttatggatgaggaactgaggcactgaacggtccgggggcctctgtggtcccggctgggggaggggcctgtgtggtcccggctgggcaggtggctgagcacccagacgacagcgacctctgttcctgaccacggcctcctttgtgcctctggtcagtgctgcaggaacgcatcctttagcctgcgtgctggcggctggagcccggcctgcatgtggagctgccgcagagaggccaggggcgtgtggggtgcatgcatggctgagacagggccacaggggcccgctttgggatagaccaggggttagggaagtccctgcagcgtggagatggttatgagtcccacatggggcatcctagctgggccgagagctggaggtgtggaggaggggttgtggaccatggttggggagggcctgctgcaaggcagggacgtctgcacgtctcagggctcctgccagacaggagtggtggttctgagggttgcaccagaagcaggagatgggggtttacggtgcccgttagatagctgtggagaaggtgggctgtaggtggttgggggaaggggggtctcccggaggtgctgggaggagactccttcaggctccatctctgctggccgggtgctgttgcacccatagaggccaagactggggttgaccactggccttggccctgcagaggccattgggattgcagtgagcagttgaatgtcgtaatcagggcgagagctcggggcgggggggggaggctaggaggtggaagaggaggcaggaagtgaagtgaggccccaggccctgtgccccagacaccagctgcgtcaggacgctgcaggctcagtgctgaatcccctcctgctgctgtacaggcaccagggatgctcatgagcagcctttcagcagcccttctccgcattgcccagttccctccggccagtgttcccaggtgtttcacaaacaccttttccttaagcctgttggcgacattgaacaggagggagggagttttgtcacctcgcatgtgcccctgccttgggatccagcattcccacatgacagctgtgctccctgcggctgacacgggaggctttttgttgaggtgaggcttcccccttgtatttgaattggctgtgaggtgctctaaggcgccgagtgtcatttaaaatcagaggcacctcgcagccgaaagcactgctgcccggcgtcatggcccagccttgggagaactttcttcagcctcaaaacattgctctgagtcctgttaagttgtgtagttttgtattttcaaaacaactttttgaatgacaatagtaaccatacatacttcaaacggttttaggaaagtttgcaggtttaatgaaatgaaaactgtacccagtgataatatatactaaggattatttaaagtgttttatgtcactttaaataatcacaaaatccttggttttatgtcacacttcctgttgtcagtaccggtcctgcttggaaggaagcctcagtggctgggcttggcttgttgtggcgtcgcctcgccctgttagcctcgtgccagagcctgtccggccccctggactcgggacagtgcacagagccccacagaccagccccaggccgtcctcctgacctcgggctttttaccatttcacacttccggtttttataatgtcaaaaagactttaaaaagaggttaaagccgtctttttccaaagacttcttatttttaaaagtcagatttttttttcctgaaagctcccatcacaatatttgggaacgtggcacggacttctgtgctgtggggagcggggcttttttccctgcctttcttgaaaatcatccacagccactcaccactccctgttttttttgtttgtttgtttgtttttgcatttttgacttaagaccttgaccagagatcagatttaatgttgccttccttttatttgctaacttcgtggcccagtagagctctgtgggaatgcccgtttaaggcccctttagttatgtgagataccttttcttcctcaaggtaagtgaattattcattgcagaaactgtcatgaactcgagtgacgtgtttaatattggcgcatgtgaaataatctttcacagtttttttcagagagtaactgtgtgcctgggcactgcacccagggccgcagcctttggcgttagggaagcacacacagtgtggcccgagcccacggggcccacactgccgagcagacagtacatgcgatgccttgtttccttaactgaattagtattttggtggacttcacatttatagtaagttttataatagattttataatcttcagttttcaaaaatcactttatttataattttttcaggagataaatctccccctaaacttgaaccatcagatgcattacctcttccttcaaactcggagactaattcagaaccaccaaccctcaaaccagtagaactcaacccagagcagagtaaacttttcaaaagagtcacatttgataatgaatcacatagcgcttgcactcagagcgcactggtaagcggacgccctccagagcccacccgcgccagtagtggcgatgtgccggcggcggcggcctccgcggtggcggagccagcaagcgatgtaaacagacgcacttctgttctcttctgcaaatcgaaaagtgtaagccccccaaagtctgccaagaacactgaaacccagccaacttctcctcagctagggaccaaaacctttttgtctgtagtccttccgaggttggagactcttctgcagccaaggaaaaggtcgcggagcacatgcggagactccgaggtggaggaggagtccccaggaaagcgcctggacgcaggtaaatgccgcgggcggccctgagaggcgcccttgccgaccagtgcctggagcgtccttcaggatcattggtgtgacgggggggggggggtgtccagcttctgtttttgcagcattctcttaatttccagagaagacaacagtgcagtgttttctttgaaaagccttgagttgcgggtctgaggccggcgccttcgtggggggcctgtttgccacgagagattgtgcaaccttgctgggctgccctgggccaggggtcgatggtccttggtcctgtcttctgccacatacttcctctctgatttttttttaagagagtcttgctttgtcacccaggctggagtgagtggctcactgcagcctccaactcctgggctcaggtgatcctcctgcctcagcctcttgtgtagctgggactacaggtgcacaccaccactcccagctaatttgaaaatttttggtagagatgggggtctcgctgtgttgtcccggctggtcttgaactcctggcctctgactcccaaagtgttgggattagatgtgtgagccgctgcacctggccccttctgatctttaaaaaagtactgagaatgaattcaggtgtagttttaattggtcatcttgactttgctgtgcacatctggataagctggtgactggccgctcccagcacttgtgggagctcgactctgcaaccctcagtcaggtctccttgcagccccacagacctaggacctggggttgagcctggcccttccctggacctctgagaggacctgcccctgtggtaaatgcagtactttgcagttgatttcagcaacatttactcattgttttatgtggccctcttagccacatatgtgatgaggtattaggacctgctgaaatagcactggaaagcgcttctcatctcttgctgcgcttttgtaactgaactctgttgaattcctcggtgagggtgttgccgtgtgtgtgctgtgctgggagcactttgaggaggccgctgtgttcctgcagcctctgctccccgcccctcagaggaagctgaggagtttgtcctttaaagaggagcagctgtcatcggtttgcttcttcggtactggctgcgcttctggaggtgccggctcaggttgccagcgactcttttctggaagcgtgtctggagcatgtttgtcattttggtttttgtcccgagtcaaggcttggttcccgtctgtcctgtctgcctgttatacctagataaggagatgcgcattttctcctggctgtgctggtgtgccgtggtgcctcgtgcacttgagcagtgagagagggtggggctgggtgggtgttgcttatttcccagagtggcagcaagtgagtcctgtgtcatggagcctcaccaggccgggtgcagatggaaggctgtggtgggcaagacctgcccaggccactccctcacatcttgtccctgttccttctgctggtctctggcctgaagcgtccggggaggggagtgagaccaggcactgtcaaaggtctttgtgcagaaggaggctcacttcctacccttgccagcaagcaggtcatgcgtcttgttgccaaagtaatttctggtaaatttcattttgatttgtatgaaaattttgcacgtaactgaatgtgtagaaattttctacccatgtccttttactttgatggattgatgttaaattggcattttaaaataatttgaaaaagcttttttgctttctaagtaataggaagctattgaaatgtttcacaagataccaataagaatagatgtccttgactcaggactgggggatgtgtcttaaccacgttggtctttcttagccacctttggtgaaagactctgacctggttttccaagcaccccggaaattctgtgatgaatcgggtcagggtgctgtgcactgggtactagaggttgggtcagtgtaattgtgggcgtcccctctgcatgcagaacttggagttcggctgacgctccacttcctcggggtttcacgtctgtcggcggcagaggtatggggctgcgtgcgtggaggccctgccggccgtggggctggggtttgaggcggcctcccgtcgacactcagcaggatgctcacgtggtggtttccaccaggtggccccacctgaccgggccctgccccagctgtgggctcccactgtggacagttttgccggctggcggccacgtcctcagcaacctctcaggctcgttcatcagatgtcccttgtagaagagcacgtgtcccctccgggccactgtcttacattggagtggagtgttttgcgggcttcccgtggtgacggtggtgtagagcagtcttactgcagaccttcagtgagcgtggcccatggtggcttttgagaatcatggtgccctctgatcctgactgaagtggagatttctgctctctcatttccgagtgacagtggatttccgtggaggtgcggtgagttcctgagctctctcctgagcagccgggagcctcagcagcattaagaccaggccctcgggagtgggaggcattccactgctgtggccgaggcgcccggggaagggctgggcgtgctctgaatggtgccagtcccgccatccgccctcgctttggtttcaccggaaccttctggtgctctgcacatgggggatttcttgcccagagctgcagttcttcgcagtcttaggacaggaattatccggaaccttctgatgttttccatacatgcatctgtgtgctctgaactttagggagttatctggcattttccagcacacgcacaattctgagttaggctgaacagggtcgctggtcctgaggcgacgcactcactgtgggcctcctgcccgtgtcgcccgcgggccggctgtgctgtgcgccaggcttctgttcctgcgatggcccagccccagagtctggccctgactcgtggcttccttcctccgtgactgcacgctcaccagcagtgaaccgtcacctgaagcggccttccactcgccgccgttgcggagacccctgctgcgagtctctgtgtgcacgtgctggggcgtgtgagagcgtgggggtgtctttgtctactcgccgccgttgcggagacccctgccgcgagtctccctgtgcacgtgctggggcgtgagagcgcgggggtgtctttgtccactcaccgccgttgcggagacccctgctgcgagtctctgtgtgcatgtgctggggcttgagagtgtggggatgtctttgtccactcgctgccgttgcggagacccctgttgcgagtctccatgtgcacgtgctggggcgtgagagcgcgggggtgtcttcagtgtccttcggctgttcagggaggaggctgagctgtcctgccctttcattcagactaaatggctttttcactgttttccaggttctcactttaaccactaatgtgctgggtagttcactctttggaccctaatcattttctcttacctcaacttggactggagttctgctaagcggccgttttggaatgcacaaagatcactgcatcttgcctttcacttaattcttgcggatcacattggaatcatcagctcaaacatcctctagacaaaatcacaaacagcagccctggaggagctctcccccaccccagcccaccccctctgtaagtcagagcccggcagtgggaatggtgctggcgcccggtgcacgcctggagctggcgggatgtcgtggcacctcagccttccctctggacagtcacgaaggacgcagaggagagcccggcaccgactgggagcctgctgcagctgacgacacagtggacagcattctgaggctgtcctgagcatgtgcggagccgtcccatagtgactggtggtttgggtgtgacggccatgcccaggcgcgttgtgctgtgtctgtgccatggggtatggaggaacttggctcggcactgtctgaggatgtggcatggacagtgcgtgctcactcactcgctagcatcttctgtatttctgggttttctacctgatttccttctccccttacttccccttcctctgttttttccccacaatgcccagtggattcttgagcagtgctgctgtttgtctcttgctggtcaccacgctgagtgcccctgcggccaactgagaagtcctgctcgtggggtggggcatctgtgcgtgggatcttgtgcaggcgtctgtcctgggccttgggtctgtctctgaccatcccagctgcattgtcatggagctgggtcccagcaagagcaggtctcgtgcaggcgtctggcctgggccttggttctgtctctgaccatcccagctgcattgtcacggagcgagtcccagcacgatgggccttgggtctgtctctgaccgtcccagctgcattgtcatggagcaggtcccagcaagatgggctttgggtctgtctctgactgtccccagcggcattgtcacagagcaagtcttgtgcaggcatctggcctgggccttgggtctgtctctgaccatcccagctgcattgtcgcggagcgggtcccagcacgatgggccttgggtctgtctctgaccgtcccagctgcattgtcatggagcaggtcccagcaagatgggctttgggtctgtctctgactgtccccagcggcattgtcacagagcaagtcttgtgcaggcatctggcctgggccttgggtctgtctctgaccatcccagctgcattgtcgcggagtgggtcccagcaagagcaggtctcgtgcaggcgtctggcctgggccttggttctgtctctgaccatcccagctgcattgtcacggagcgagtcccagcacgatgggccttgggtctgtctctgaccgtcccagctgcattgtcatggagcaggtcccagcaagatgggccttgggtctgtctctgactgtccccagcggcattgtcacagagcaagtcttgtgcaggcatctggcctgggccttgggtctgtctctgaccatcccagctgcattgtcgcggagtgggtcccagcaagatgggccttgggtctgtttctgaccatccccggctgcattgtcacggagcaggtcccagcaagagcaggtctcgtgcaggcgtctggcctgggccttggttctgtctctgaccatcccagctgcattgtcacggagcgggtcccagcaacatgggccttgggtctgtctctgaccgtccccggctgcattgtcacggagcaggtcccagcaagagcaggtctcgtgcaggcgtctggcctgggccttgggtctgtctctgaccgtcccagctgcattgtcacggagcgggtcccagcaacataggccttgggtctgtctctgaccgtccccggctgcattgtcacggagcaagtcttgtgcaggcatctggcctgggccttgggtctgtctcggaccgtcccggctgcattgtcacggagcaggtcccagcaacatgggccttgggtcggtctctgaccgtccccggctgcattgtcacggagcaggtcccagcaagagcagggtgctgttggaatcttcttccgtgtgtgtttttgttgagaggttgaaaaatgcaccaaaactgctcttcttttaacgatggtaaaagtgaaactgaaaacaggagatagtgggctctcctttgtcactgcgtggggccctcagggctctggtcttcagggtgcaggctcagcccacctgcttcatacggccaagcttcccatgagccggagaagccgaggtggcagcttgggtgccagcggcaggggcgggcaggggcgggcttgtatcccgtgttgtggggttgcgttcccatggctccgtgccctcaggtgtctcggcagccactgatcagggcctggtgttcttacacctgtggcctggaggatttgtggtgtccacatgggttgggggctgggagcctgagaccagaggagactacggcccatcagtcagacctgcaggcctccgcctccccaggtgggccctggggcttctcttccctgtggggaggggcggtgtctcagccgctgtggccttcagtctctcagaagaccctttggggacctcccgggacagtttcaggtgtgctgtggacgtacctggtgacgggcaggcttccggggactgcgcttggctgggctgtgggacacctttgcgccatctcctttgggggcagagagggacatttctgtgttcagtctttggcctcctaggaggtcactgggaaggcccttgagggtgggtggaccctggccgctgtgggaattccgtgcagctcctgtgttgatggggcagcggctctttcctggcagccgccgcctcttttaacgtatttctcacagtcaccagctttactttcagcgttaaaaaaaaacctcgtgctgaaaaagttgctgaaagttgccccttgctatttacatgatttagaggcttgggctcggcctcagtgcctgctgtttgcaaatgcctcatggaccgggcacccatctctgcagaccttaggccctgggttccccacgttgggccccacctcaaggctggcctgggcttcagaatgttctgggctgaggtccttgcaggggtgctgaggtgcgggtcatggtggacatctcccagctggctggaagagcctcccagggcgggagttggcagggccgagattgagagatctcagaaccatagctgtcttagattattttctggtggtccaggtggaggctgggagggtccgggcagcgcaggccaccttgcagctcccccgaggttctggggactccaggcggtggctgcagagcctcccgggatgtgtctgtgtcctggtctggcttcttggcttcctgggtgaccccgcactgccgcagcccccagaccgcctgttagcaagccttgcagctgtcccacccccgccaggcctcctgctgggtggtgtctcggttgggctgggtttgtctgtgctgcccacgtcttcccgggtgctgtcacattttcatgggtgacacgcagaacctctgtgtgttcttgcgtcatacgcgcactcactgaatgcttaggaaaattaagaggggcattttatcattctcctctttctgagaattaaggacttgccttgtgttttaatccccttcctggccccactccatgcacacggagccggggccgtcgtggctgctgagtggtctgtgcatggcttggctgtgttggtgctggcacagctgcgggtgatctcgtgctagggccctcaggctggcacctctgggcagtcttgtgaaggccgcactggtcatcgtcttcccccaagtggccgttgctcggccaaccagtaactactaaaagcctccccacccaggccctgggctgcgtctgttcagcctggagcaggctcaccctgcacctggggtctggagtgtgctgggggccgggctgtggggtgtgggtcgccaggctcgtggctgctctctggagacgggtcacacgcgttggcagacccctctccgggcctgtgggctgaatgctggcaggggtgctgggctccgtccgtccactgctgatgcgagctgggtgggcttcccttgccttcacccactcaggttggagtagggatggagtcgctgctcctgaggggttctcgggggccaggacgggacttttaattccctcttgagacatcttcggggcctgagtgtgcagggtctgagcccactctgtgatgagtatggggagcatgtggagccccagggcagctcagcgtgtggctcaaggccttctcctgtaggtttttaaatttatttgttcccttgccagaaatgagtatgacacccccaactggccacagttcctgccttaaaatgaccgaggttaaaatgagaaacacagagcttcccttggaggtcacggtacattccagtccaggagagacggagccggtgtctgacttgagtctgtggagggcagcagtgcacccgcccaatctgtgcattcccttctgagcttgatttagcccctctgtttcagtcagtcatgctcattgagaacagacagcaagtgtatgaagcgggtggaggctgattcagcccctgtattgaaaagtcggtcgtgctcattgagaacagacgggaagcgtacgaagcgggtggaaaatcccgcagtccagccattcccttcaaaacatgcctcccagccactcaggaggctgaggcaggaggatcacttgagcccaggaggtcaaggttgcagtgagccatggagtccattgcactccatccttggtgacagagtgagacatcgtttccaaaaaaattctacagaaatgctctatttacaaatttacataatttcctttggaaatagatttaaaaattttttaaggatgaggtaggtaggcaggaaaacggggttctttttggataaaaaaattcacatggccgggtgtcatggctcatgcctgtaatcccagcactttgggaggccgaggcaggcggatcacgaggtcaggagattgagaccatcctggctaacacggtgaaactccgtctctactaaaaatacaaaaaattagccaggcatggtggcgggcgcctgtagtcccagctactcgggaggctgaggcaggagaatggcgtgaacccgggaggtggagcttgcagtgagccaagatcgtgccactgcactccagcctgggcgacagagtgagactccgcctcaaaaaagaaaaaaaaaatcacacacccctttagctctgacacccagagggcccccagcaggaacatcatccccccgttgtgactcccatgggggacctcatcggggggccttgggcagatgtgttgtttcccgttgactgacaaagtcaggatttttagggggaaaatactgagatttgccttattttttaaacattgagatgatggaattgtgagtggtgttttgtttagctgtgtacagtacttgcagcttcatggtgagtgaggccagacacactcagacacggcgatggccccggattttgtgttttaaagtgtttcgtcagcatttttgacttcatgttaacacttgtcttttgaaccaaggttttttctttttaaaacctgatttcctattccctggagctctgctcctgtgaacatgtttttgtgtctttggtggccccttcggcctggtgaagtttccgttcaaacgcggccggtgcccacgtggacaggccgcccccgtgtttgcactcacaggttgcacatctgcccccatggcaggctcacggcatcctttctttgccttcacagagcctgtctaaagacccgggcttgtcaagaggagcatcttcatggtgctcagcaaactactacgatcggagccgactgcagtttgttaagttgatttcatttaacgagtaactttggtgtctgcttactgtaaggactatgctcgggaacttgggagtgaaaaggaagatgctgtcttacctgtctgtgaaacgtgctttgtaagatgtgttccaagtgtaacgtcgttgagtcatgcttcagtgtgccctggttgtgctgagctcagggcctgcccgcctgtgttccaggtctcaccaacggctttgggggtgcgaggagcgagcaggagccgggcggcggcctggggaggaaggccacaccccgacgacgctgtgcctccgagtccagcatctcctccagcaacagcccgctctgcgactcgaggtgggcaccgcggccctgcgcttcccaccacgcagctcccagcaccgcccgccccgcctggctgtcctggaagccgggacattccagctcccatcttagtgttctctgaaaaattctggcctgggattcatgtgtgctctgcccttgtggacagtttcccatgctgcatattaatctgctttatagaattcaagcagaagtaggaaaaacactgcgtgaaataggaacacaattttagaatctgcaatgaagttttacacttgatctttacctcccagaatctggcaatgagcacagccctgcctgtctgccctgtgaaggccactttggcctcctgagtcccccctgccacaggttcactccctccagacctgcgcacccacaggcccgtctggccgcgggggtgtcaggcaggatgcgtggccagcttggtggcggacagctcacgggacgaagcccgagtgaggctgaaggcaggggcggggcgcctgactccctctgctcttcctcccgaagctttaatgcgcccaaatgtgggcggggcaaaccggctcttgtgcgacggcacacgctggaggaccgcagtgagctgatctcctgcatcgagaatgggaactacgccaaggcggccaggatcgcagccggtgagtcgcccggacctgcctccatggctctccacacctcctggttagcgtcttagggctcgactgctggggactggactccggctcagggagcatggtgccctgtgtggagccccaccctggccaacctcccggggaagggttcatcacacaccgaggggctctgggctgtggccctgccggggtgcctgcggaggtggcgcctcctccatcctgccttcgtttccctgtggaacgtccagctctgtgtggctgctggttgccaggcactgtcaaggctgtctggggttgtttaggttcagtggtcatttgcagctgcacaggggactgactgcagggtgggtgccctcaacttcaggcccctgggggagggggaggccccagggtttggggtcgcacagccctcactgtggaaggcagccatgctgtgagggggcatcaggacggagatcccccaggtgggagggacagcagggagctggtctggcggagggggagccaggactttggtttcccatttggggtgtcagttgtgtaaatgaggcaggagcatgctgggagccccgtccttgcggcaaggagggctcagaagggactgtgctgggcacctggagttggagccttgtagcctggagggcaggagcttccctgggtccgtgggaggctggtggccccaggtgggctgcagggacagtggggatgcaagggcctggaccccacaggggaggcagtggtgctgccggggtggctgagaaaggcctgggagctgggctgtgctcgggggacccaccctgttgctgcaccttttgtgggggggcggggcgtgccccgtgtcctgctgacgcctgtgtcctgctgacgcccctctccgcagaagtcggccagagcagcatgtggatctccactgatgccgccgcctcggtgctggagcctctgaaggtggtgtgggccaagtgcagcggctacccctcctacccggcactggtgagtacggctctcgtggcgcctgcgggtccagaggaggctcacacagctgcggggcgggggtggtccgaggaggctcacggcggtggtccaaggaggttccacagctggcgggggggcggggttggtcagaggaggttcacacagctggaaggggcaggggtggttcggcgaggggggcgtgggggtggtctgaggaggctcacacagctggggtggggaggcgggggggggtgccagtgacaggtggggttgtttatgggtgtgagcctcacaatgacctcagcgggtccttctcgtgcagatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggtgagttgagaggccttagactccggggaccggctggggtggttgggggccgtgggctcggtgacctgagtgtccctgtggtgagcagcgtctttgtctgctgggccctggcacagctaaagtcggaggtgagtgctccgctgtttgcctggtggagaagggcactgcccagccccctcgccgggactgtgggacgggcactgagcaccgggtctgtctctgcccgatggcttcctctccctctcgcctgagccccattggtctggactgtctcttccctactccttacccatgtgtccgctccagtgttgggggtccctctgctgtgctcccggacccctgtactgcaggacatggcccctgcccgggcctggcctctggccctgttcttagagccttctgtcccagcatcatccagctctgctcagacatccaccccatcacaggaggctccccctgtgccctgagctgcttttccccagagcgtctgggaccctcatgtgccagggtttagaccccaagatccctctgtgcaggacacgctggcagcacatgcctctgggaggagctgtggccccggctgtgccctgcgcacgtggcccgggcaggtgcttcctggttccccgtggagctggctgcacttgggacctggcgcaggggctcggggccacctgcctatggtgtgcctggagcaggactggcagcacaggcatccctaccgtctttctcttccttgcctcgacctctgcctctttggccacgtggccactgcttcttgtcaggccttgagcgaggcccacaccttgtccatccgagggcccctttgatggggtctccccaaccaccggcctctgctccagggcccaccctgactctgggcttggtgtgtgcatgtcttgtcactaagcaggcactgggaaacgttttggaggtggaggaggaggtgatggtttttatgccttacttagctccccgtatccccaagtcggggaggggaagggaggggtgcactcctggcctcgggcctgtccctgcacggggcccagctgtcttggtggtgctgagcagggcccctttctatcggagggcagtgaatttgttagatgattacatggagcctgctgaaataccatgtgcaagcaatgattttccgcttgtttttccttttaaaaaggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagatttggacggtgtggccattttattcctacagccctagacggctaggtgagccccaaggacgggtggggtgctggctgcagggggcggggacacgcctttatcttgaaaactgtcatgggatggcattatttgttatttcacctgatcatatttttattttaaaacttcagttacataaaagttttaaatgctttttttaagcctacaccgtttgtaacatctccatagaaacttggaaatcaagtcttccttagatagttgctgtcctgcatctggcaggtgcttcctatctgtcgtggctctccttcccacagccagccccgcccggcaggcccctccccaccacgagcagctggtggcccccaggatcactcaccgcccacgcagaaaggaagcccacgcagaaaggaagcgggtgcaggagccaggtggggacaggccgtggagcactcagggctaccaccgagaagcccagctaatggcgggtgcagtttgcaccccttctctgccacccacagcctgatcgtgctgtcgatgagaggaatctgctctaagggtctgagcggagggagatgccgaagctttgagctttttgtttctggcttaaccttggtggattttcaccctctgggcattacctcttgtccaggggaggggctgggggagtgcctggagctgtagggacagagggctgagtgggggggactgcttgggctgaccacataatattctgctgcgtattaatttttttttgagacagtctttctctgttgcccaggctggagtgtaatggcttgatagctcactgccacctccgcctcctgggttcaagtgattctcctgcttcagcttccggagtagctgggactgcaggtgcccgccaccatggctggctaatttttgtatttttattagcaatggggttttgctatgttgcccaggccggtcccgaactcctgccctcaagtgatacacctgcctcggcctcccaaagtgctgggattagaggcttgagccactgcgcctggccagctgcatattgttaattagacataaaatgcaaaataagatgatataaacacaaaggtgtgaaataagatggacacctgctgagcgcgcctgtcctgaagcatcgcccctctgcaaaagcaggggtcagcatgtgttctccggtccttgctcttacagaggagtgagctgcctatgcgtcttccagccacttcctgggctgctcagaggcctctcacgggtgttctgggttgctgccacttgcaggggtgctgaggcggggctcctcccgtgcggggcatgtccaggccgccctctctgaaggcttggcaggtacaggtgggagtgggggtctctgggctgctgtggggactgggcaggctcctggaagacctccctgtgtttgggctgaaagcgcagcccgaggggaggtccccagggaggccgctgtcgggggtgggggcttggaggagggaggggccgaggagccggcgacactccgtgacggcccaggaacgtccctaaacaaggcgccgcgttctcgatggggtggggtccgctttcttttctcaaaagctgcagttactccatgctcggaggactggcgtccgcgccctgttccaatgctgccccggggccctggccttggggaatcggggccttggactggaccctgggggcttcgcggagccgggcctggcggggcgagcggagcagaggctgggcagccccggggaagcgctcgccaaagccgggcgctgctcccagagcgcgaggtgcagaaccagaggctggtcccgcggcgctaacgagagaagaggaagcgcgctgtgtagagggcgcccaccccgtggggcgaacccccttcctcaactccatggacggggctcatgggttcccagcggctcagacgcggatcctggcctcgcccgccgtccaggtcgtgcgctctccagggttctgtctcccagggcgcgccctcgccgcggtc

SEQ ID NO: 12748 - DNA, 70263 bp, Human
tgaaactctgtctctactaaaaatacaaaaatgagccaggtatggtggctcatgcctgtagtcccagcttcttgggaagccgaggtgggagactcacttgaacctgggaggcagaggtcacagtgagccgagatcgcgccactgcattccagcctgggcaacagcgcgagactctgtctcaaaaaaaaaaaaaaaaaaaaaagaaaagctaaaagtgatttgacatgttcccagtacaaagaaattataaatgttcaaggtgatggaaatcctaaacaccctgatttgatcattacacattgtaagcatatatcaaaataccacatgtacaatcatgatgtatcaataaaaaaaataaaagccagaacccaacctctattcatttgccaaatgtgtactgtgcctataccacatgctaggtgtttgaggacatagctgggagcaaacaaggcaaaaatcaattatagcagaaatctgtgaaaaaagaaataggtcatccctcatcttggaaaagataagccacaaaaagccctttccaggaatatgtaataaaaagtcacaattcaggatccctggctgagatttgggatgactggagatgatgataagaactaaattggaggaggctttcaagaggaaaaagcctccagcaagagacagccccacagtgggaactgcagcctccccttctcaccaaatccctcccgaatggtgtacttcgggaccactcttcagtctctgtgcaaccgagttttattttagcccacgggaccctggtttttctggcagggggcactgcaaagacgggttacaggccgaacacctcacaacagagacagcagtattctctctaggataaaaagggcttgtgtttaatcctctgtcagggcaggggggaaatgcctctggaatccaagtctgtggaaccggctcagcagagagatgtggctttataggcaaacaacgtggcatagagagaggaacctggccaattctgtcttataagagtagttatgttatgcgttgcaaggactccacattccatggatttgtgaactcagatggaatcttgtttgtccaggcctgcatgaccccatttatctaaaaattactaacttcctagtttatagtttacaatcctgtgcccgccgcctccctccccccccccgccacgcccccatgagctttctctctattactctcagtctctcaggttaaagccttgctcagtaattcagctgtggaccagttattctgattatttcctcatctatcgtcttacagtcataataataataatatctgagataatatgagcatacaacaagacagtatgtccacaggagcatctctaagatcaggacagtgatttcttgctcatggaataagaaggatttatgttaaagcaagttataagaaagcagtttaatactttacgaacgttaagtttaaaaaaatcataactcgctggaatcttttctcctctctggatattggagaactcgcccaggtttgggaaacgttagccagctcctgcaaaacacctcctccctcagccctccccgcgccccctacgaccaggcagaaagggtgggaaggggagcacagctcagcatttatttctggatccagctcactaaaaatacctcggctctcctgtttgatcactctcccttttgacctgaatggatcgcgggagccgcgccgcccgccccaccttcggcccgttgccctttaaaggaaaagggcgtggggacggattcctgccgctcgagggatagaagggagctgggtagtcaggggccgcggccatgctgacgtcagggcagccggcgctcagctccgctcgctgccacagtgcagagacctccctgagggagggggacagcctcgcgctgggattggctggcctcgcgcgagcgccggcgcggagtggctggcgaggttttagagggagtcccgctctccaattaaagcggcccagctgcgcctggctgcgcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaaggtgagtggaaagctgtttgtatttacccagattcttactttttcttgtttccccttcccatctgttcgcggaaacttcccaaaaggtaatgagaagggaactctttaaattccaaaactgcatggaaaacaaatagttgggaatacatgtttgagctaacaggcacacacaccccaaacccaatgttgtgtaaaatatttgcaaagggtcttatgtctttggtgatgctagttaaagtttaattaaggttttacatatatatacaatatatataaaatgtatataaaatatatatataaaatatatataatatatattatatataatatataaaatatatattatatataatatatattatatataaaatatataatatatattatataaaatatatataatatatattatatataaaatatatataatatataatatatatatatgaaatcttatggtctgtaaaggaaaaacccctagcttcctcactccctgtcctcaggtggctgaagtaagggttgagagcatgtaatatttactcacagtctcccttttgctattatcccagtgttttgtgtgtttcccccaatacacacacacacacacacacacacacacacacacacgcacgcagtttctttagttggtgatgttggcagtggcagcagttccagcataagggaactgatttctgtccccagggtctgcacgtttcccttacaagaagggctggcccggagcccagaaggtcacgggtaaactcctgcacaggagcctgcggctgtgcctatagctccaataccacttgttgcctacctgaatgcagctgggagaaggcacaggctggagacttagagaacatgtgaacgggaagggaacagagagacaacctaggctttacagatcgggaaactgaggcccggggtcacagagagttggttctaacaggcagctgactgtaaggcaagccctaggcatccagactcagtccctgccactttttaactgcacatgattcaccaggtcacttttctgagcctcagtttccttgtctctgatgtggggaggataggcctaacctccctcatggcagtggtagcagggatactgacactgtgagttaatttcccaaagcagtcattgttaaactctgatttcacagggtttagtcttgaagggcaaagtcttccttaaatatctgccattaacctgcagggtagaatgagagggggaaaaacaaaagacgtgagaatcaaactaaagacacaaacagccactcagaggcacagcatgcactgtctaatttgtagctgtgctcttctgtagaccacctgcccagaccctgtcacagagtccagtggatccttctaaatgtgggtaccaagtcacattgaatctgggcatttgtctggaatgtatcatgcctcactgcatttgccaagctatttgcagaatcaagtcatttcccctcctacagaaattaccataacattttagactcttagaagatacctattaattgctacctagtagtgagttatgcatgcaatgctcttatttctctatacatttttctggactccttgagggcaaacctgtcttgttcatccctgtttgaacatagcacaccatgccacacagcaggactcaaaaacctgtgggtgactcatgagaatatctgtccagctaagaccacactgtttgcataggcttcattttatgcattattttttaacttgtagcattgatatttgtgtgtctgaactgcctccccaagttcagacacagaatagttcacggctaaaggtggcagagttccattgtcctctggaaagtgaaatgattctgagtatttttaatataagctggttgatagttactgtatgaggtgagatgaggtatatggagactcctcctcctcaccacagtcctgtgttgccacttggaggaagccttgtttttattttcctttgcataggggagtgtgattatcctgattagaggtggaacatgttctccttcttgtcaccccctagtgccaacttccttggcctgcaaagggtttgttttccatttagatccaattacaggcttagagaaagaatgtggtgggtagagatgaaagggcagattttttttatctcttgggactgcgacaatcaggaggaagatcaccattttgtaggttaaccaatgccttcaactcaaaatgtggaggggagggaggagagccgagaagctccccttgctgaactgaatgtcacagaagtgattaagtactacgtgatatcagcaacacgctgaaaagcttttactgcatatttattttttaaatctgcaacagtatgtgggggaggtttataacatttggcttcaggatgcataatcgcacttagacattttgaaacaatttcatagactcttagagctacaaggggcctatttacaaaatgagaaatggtttaaaatggcatacaggctgtttccgcttccctacccccgagggggctggggcgggaatccccaccaactggaaagtcataaaaagatcttcagcaaagaacataaaatctaaaaactggagtagacttaaaggtcatctaaccaaccccagacaggctggggaaagagactcactgggggccacatacatacatcgtggcagagcttacaagttccctaacttctctctttctttctaagtaaaatgcttccaccggctgctcttgaaccatctttttttttctattaggaaagagaaggtttcctagcacagacagttccctgagaatggtgaaatcgccaacatttcttggtaacaaagggccttgaaggccaaatgccatttttctgggtgaaaccaatctcgactatggatttgttcttgtttattaaggatgcaagttattagtgcaggctttggcttcagatctggtttaagtcccagctcccccacttactagctgtgtgctcttgggcaagctaattaactttgagtcagtatcctcacctcatttgaaagttgaagaaacagtaacagcatctacctcccaagatggctgtgataattaagtgagatgatgtacataaaaggctcagcatatgggcactcagagttagccatggcagtccttggtggtggcggtacatttcagtgggtgcatggatgcggaaaggaattttctggtgaatgaggacacttttatttataactgccccatctgaagagcacctaactttcattcagctgaacctaagccattgctcagctttgacaagctaagacaatgaccaaatgctgttgccttcattctcacccaacgggtgcaaaatctgcttacatggaacagtctttccttctgaacatggattgccagttattgagcatttcactttggagttatataatgttaggcctcgaaggggacttggagtgccttactttttagataaggaaactgaggcccagagggatcaagctccttatcagaagttgcagagaaaatgtactgaagcctattaggctctgcaagaatacagaccccttgactgtcaaggaaccatctgtaggaatttagaagggattagaagaaagagagctaggaacctgttcatagttgactgtgcagtcaccagtgggctggctccagagggatccaattagaaattctcacccctcaacacaatgcccaaggggcattaaatgatggtacttctaagtccattgccaggtccacctggatgtctctctccatgcttctctacatcacatccctcttggctttcctgtccttcaggctaggccttccctctgtactcagcccttcctgctttcacctccacttcctgcagtgtgccaaactactggcacatcacccgggtgagctgatccaatgtaaacacagctcctcgtgaattgtcgttggctctctcaatcttaaaaacatattaaactgtcacttaaagaccttaatagccaagacattggagacatgcccataggtgtataagcaacttttttgccataatagagccttgttttttaaaaacagaaattatccaagtcccttttacatgctttctaaaaacagatgctgaaaccattactttgtgaattgcagatttttgtcctaagctgcaggtgtgtctgactatgcggagttgggggctgacagttgactttcaccaatgtatctgccactgtggtagtgggaggcaggaaagagcttcatcagattatcttcaggctttaatctaagcatctcagctccaaggctaggaatttgctcagagcttaccaacactcctacgagttggaaagtggaaaaatgactttggcattcccctctgaggatgcttggtttgatcctctcttcatgctaactgaccaaaggtgacaaggatgaaaaaagaataggctgaattcagcaaaggctggggaccaggaaggaggggctgcacacaggcttttgtgtgtgtctttccttccgcccttacgcaggccacttcccaagaggaaaaggtaaagagtagagaagtaagggaatagttcctctcgcaactcactagagctgacagggctccaggagaagtattcaatttgactttaggaaggcaaatcgtcctctttttagcttgcacattcaaaatagtttgtgtctcataaagtggagatttgccttgataagtaacagaccttgagagctcttatctcccaaccattcatccaacaccatttaaatctttattttaagaacagatttctggcaggggcgtgagtcattataataactgcaggcgtttactcactgggtgactttggataggtcacctttcctaggaagtggcagaatttggatgagaaccagggttccttctgcctccagcccactgacttttcctttacaccagatcatctcccaaataacaaatgattatgacaaaataggcttaaaacttcgttccactgaaagcggaattgtggagcagcttttcaggacatccaaaatgaagagacagctgttgctcttgaagagccttcgtttagaaatatcctcatatcccctaccatttgataacaggaagaggatttggccagcagctgctactgtctcaccaggtgcagggccaccagccacttttgcaggactccttcaagagcacaacatttccttaaatccacgtggaacaattggtgtgtcccaaaccattgttggatgtttacatatagcaatagcatagatctgcaaaagctctagaaaatgctctctataaaacttttatagaaagagttacatatgaagttgagtctcctgtgttcaccaaggctcctttagtggctgaaacacaaatttagtatctaatcctgtatatttgatgcagaaattgtgttttcacaaaaacagaagagacaaatcaattgtagtgctttgtgaaactcccaaatcaactccttgtctcatatctgctcttctgtatgagaagcaaacccttttacatttttttctcagaaaagagaaaggagtctgttcttacttttattatctatttggattcttgcctcccaacagacttgttctctgttaggacaggcaagtttggggctaggcaaaagagaggaaggaaagacatctctaagggtccggagatgattgacattttcctgtgtgttagctctttagcttcaaggactaccatgcaaaaatattggtgtccttttttacacatgagtaagttaagactaagagtttgaaacgacttgtctaaggtcacataatgacagattaagaactcaaactcaggcctctctgactccaaaacttcagttcttttcactctgcaagaaacagaaggcattcgtagaaagcagaaatctggtgaggagggactatgattattactgtgactttcatacacagatcaatttcttccagcccactgaactcattgatagtctggttcagaagcttcccagcatttgcaaaatgttgctaggcacctgtatctctttgatatctcttggtcaccaccaggagtatactgtcacctacaccaaatcagagccatttctcgggtatagaataaagactttcttgatttctcctggttttccagaaggctaatggacatctcccggcagaagactagtagagagaccttttaaagaataatacatgttatcctaatactctaaaaataattctagagaccttgtcccagagctttcaggaaactctgccctggggataaggttggccttgacatgtgcatttctacatgtctagtcagcctgacccatggcctacccaataatatataaatcatgaccaagccaaacatggcctgggcccccaccgggacatgctttaaaaggaaatataattgctaagggagaagaaacaaaggctccatttggcaagtaactctattgaaggacaaaggagtgccagtgtccaactcaaggtggctgtttcaaatccacatgctttgtgtatagattttgtctcctcctcctgtttaaaaaatattgaatcctttgtaaaatttatctctggagacaaaggctaatgagccattgtctaaaagagctgagcagaatcttgttatctgctcattcaaccccttcatgtcacaaatgggacagggggagaaatggcatatctgaaatttacaaagaaaaaaatggcacatctgaactttacataagaaatggcatatctgaaatttacaaacttacatttacatgagtggtgccacaaccaagatacattgactcacagcatcttttatgaatgaaggagaaaagagtgtctgctgtattctgtcacttccacccccagagtatcccagttttgtgtcaacctcataccttgaaactcagaagttcaggtggacattttggctgtgaacttagctttggccacaaggtccagaagccacttcgaggagccgttaaacacacaacatttgcaagcacaaagatctagatgtgacctgcagctcttcaatttgccaggtctgcaaacttcgccaagttactgatcctctctggacctctggttcctcatttgagaaagatagctcaccgtagttctacatttaaacgatagtttaatgaggtaaagtgcataaagtgcctggatacataatatacccttgataaacatttcctcctgctgttatggataccccctctcatcagcatgatgcaaaaatcccataggttattaagtattgggatgtggaagaccaaattcagtttacctacatcacatggggcttctaagctctcagactgcaggaccttctctttgtagttaaacttggacctagccataaatatactcaggccacatcacattgcaaaatcatgagaatagccacaattcgtcttgggtgtttggtcgctaccctttccatagcagccctcccctgctccattaccagtctttccctccaatgtcttgcttataagatagggcaacagtcactcatttctttatatagcaaatatttatttagcatctgttatgtgccagccactgtgctaagtactgaatacatgacaatgaataggaaagctttgatccctgccaagtaaacttgagtctggtagaatttatttttcataaggcaggagacaggccaaataatgtcagtgttctgtgagtctttgtgttccttgacctctcccctccccaacacacacacatacctctccttccttttccaaccaccctcagattttccaggacacacaccttcagagccacatctcaactctggtcatccctacagtgtaacagtagaatgagtgtagtagtcctcccagttgtcacattttaaatagggcctttgggaagaaaccaccagtggcactgagtgaaaaggaggctgaggcaagggggactattggcagctcttaggtcccaccagcagccagtggtccctcagccttcctacagcgatacagtggtagaccagttgtctttgctcagcatatgttttcagaggcagctgaatgtttgggttgtatttttcacagtactgatgtcagggacaccaaagggcaggagcatagggaaagggctcttggctgactaatgacctcataagaaacctgcccttagaagagagcatctgtttgggctgtatgactcagtggcgtttctaggtactgattcatgaggctgaccatcgaggtgactgacccgtgcaatctgctggctgaaagaggtgaaggcaaagtagatcccagctctgccctcatcctggaggagagccacccctcctaccacggcacacgggtgctccccaccccaaccctggctcggccagccagtctccttgttaagaggatctgacactaatgtgggcagaggtcagcatctgggggcttcttattttagaggaagtataagagagagatgttttgaaatcttgttagtgaatagaggacagccttttaacctaggatctgtagatagaattgagggtgtcagggaacttaaattaggaaaagtattgcattttttatccctaacctataactgaaatttagcatttctttctactgtgaataaagacaaacgccctagaagtttagcagctcctatgcctttgataccaatggaaagcaggtatttttatatcacattacagctgagatagatcctcatcctacaatttatactcatccctgctctgaaatggccataattatacccactgctagatcatattcattaacttagtaaaggcacatctgttagtaagtcacaaatttgtttttatatattgatactatctcagtaatattggttttctttgtatttttatcttatgcatttaagacatttcctaagaagagatattctcatgtcagatagacaaagaacctaaaaatataaagactctttccacatcaagctgaggcattagcagcattacacgccacacacacacaaatatacacatctatgcataggtaaacatatatgcacacacatacagctgtagtggattgaggtctgaggctcttggagtaaacaaactcaattcaaattccaactctgccactcatttcctattacctcgaacaagtcatattagttctgagccttagtttcttcatcaataaaaggggcctaaaagttattgtactcacaacaatcatctaagttcttggcacagtacttgacatataaggaatgtgtgttaaacacaaggcatcctcaccattaaaagacctaatgaaggtgaaatggtaaagagaataaacacattactttgttgaaactttttaaactcacctttgatttggccaactctaagaatttattttgtctaaacctgtattacacaaatattatatgccagggactgaggtgggaaatgaagaaataaaaggaaaggaattttaaaatctgatggtctcagaaaaggaatagcctaatcaaatcatcaaagaatcatagcagtgcctaaagaccttgatcggggtacatgtgtgggactgagagagatcagaagaggaaatacttaatcttacctggggaggtcaagaaaggcgtcccaaagaggggacatttgagctgagtgttgaaagacaaggatgaatgagctgttaggatcaggccatagtccagttttatgccttctgaatctgacacccatattctccatcctatttgatttccaacttggggaatatcacccatcttggactgtggagaaatacattccactgtattcatccagccacaaatgcacatcttttatcttcttatctgagaacctgttcctcttcctctcaagcaaaacccactggggtggcaggatagcaaggcctgtcaggctgcacatagaaaacttctcatgatggtgacttgaggctctcccaagccctgcaatggagttccagcaaactcccccaagttgagtttgaatttttgcaggaagatacaggtctgtgttttgacagcaggaaaaaaaggtagccaaaaatatgcaatatatatggaaagaaaggaacacacacgtatgtgcacacacatatacgtccgtgagatccagcacatggcacatgtgagcagaacatgaaaacaccgttcagaacaccacagcatgtgtgtgcaccctgagcttcactctgaagccatttaataacaagaggaaaagaaatctcaagtaagactttttgatgttaggaagtgaggaagcaaaccagcattctgaaatatgggaccttggttaacaagatctggaatcttgcatcaaaacaatttctttcacacagttcttacttcaaatatctgacttggtctgaaaatgtgagttccttcttgctgtattctagagcaggcgatgcactgaaatgaaacacatatggcttggatatctcagtgctgctaggatgattgtccttgatttttgtcagttgtacatggtacattaaacagagaaaaataaaatcccagatgattccctggcaattatctgaaaaataacattatggtgatcatccctgtgtttacaaggacatgaagaaagggcaaggtttgatggaaaagctttgtttcctctaatctgtcctcctacacagccaacagacctcaatggcccatggggaagatacaaccctataatgagattcccagctaattaaaatggctgtcatcacccaccttccacatttccatgagcccagcccagaaatgggaccatcacaggggaaatcatcctatatttatttgaataatgtttgtactgtgtatttcagcaattaaaattaacttttaagaggtaggaagaggcttagggattctctaggtcaactgccttctttaacagatgaggaaacagacccagcaaagccagatgacttgcttgaggtcacagagctagttagtgggagaggtaggattagaattcaaggtactatggcctttcaagttcagaaagacttttaaaaactgtgttgtgtagaatcacttccccataaacacaagatgagctgggcagctagttgctgtcagaataccgctgaggaacactcacacctcctgaagatgtctaatttttttaactcctctgattattggaaagctctttgttattttgagctaaaatttctctgtatgtaacttctccttattggttttctttatttccttggcagattcaaggaggtaatggccatttttttctgaagtcccagtcccagttaacctactaagtcctacatattggtcaggatgaaggtcagagcatctatattttgggtttcttcctaccttcagggagacctggtgtcagttcttagctgagtgagatggccagcacgcatcccccagggtttgtctggggatccatcttgttacttgtgccagctcctccacctggctaggataattccctctcctgtcctcactcaggtggggaagcccttctgtgccaccagctatcctgtttcttgtaagaggatttttaatgtgggaaatcatggcaagaaagaggtgccaggcagctttaaagcaccaagagaagaactccaaacccatgtcataaacactcaagaaaaatcagcactgttctacatgcatacatgtagaacatgactttcaaagaaaaaagggagggatgtatacaaaatcaaagaaggctaaggaggcaaagaagaaatgattgataaatagaggtaatatcaaaaacttttaaaaattatttgtaaagttgtcatcgcttattactatatggaatgctaaaacagtaacagggtaatcaaattttgcatgcttgtgtcttttcctctggaggcagtactcaataaataactatgaaggctggccattaaaatgaacttgctttcatgaaaagataccactaagaaagtgaaaggcaatccacagaaagaaaatatttgcagtatttatatatactgatccccagacaaaccctgggggatgtctgctggccatctcactcagctaagagctgacaccaagtctccctgaaggtgggaagaaacccaagaaatagatgctttgaccttcattttgaatatttatgtgtgtgtgtgtgtgtatatatatttgtgtatatagatagatgattgatagatagatacatacatacatacatacatagagagatctgggttgtattcagaatatataaataacttctacaaatcaatttaaaaatccaatttttaaaaaacaggtgaagacttgaataagcatgtcacaaaagaagatatctaaatagctgaaagtataagaaaacatgttcaacatcattattcattacagaaaaacaaacgcacaatgagacagtgtcacatacccagcagaatggtaaaattaagtaccaacaggacagagtgctggagaggatgtggagcaactggaactcacagacattgccagggagaatataaaatgatacagccaccgtggaaagctgtctggtagtatctaaaaagttaaatatatatccactttgtattccaacaattacacttctaggtgtatgtccaaaagaaaggatcacagatattcacaaaaaaattttgggcaaaaatatttggagccatgttattcattatagccccaaactggaaataattcaaatctccatcaacgggagaatgaataaaccaatcattttatatttatacaacagaatattacttagtaacaaaaaatctaatatatgtaacaacatgggtaattttaaacatgttagacagaaaaagaaaccagacacaaaagaatacacaccgtgtaatttcatttttaccatgttcgaaaacaggcaaaactaatcaacagtgatagaaatcagaatagcaaccacctttataagaagaggtgtttattgaatagaaagtggcctgagggaactttctgggccactgaaaatattctacgtgtttatctagatggtgatcacatgggatatacatataaagtaatcgagcgaatactggagattggtgcatttcgaccgcatgtaagttttcctttgaagtactgttagataataatagaggcagtatttgataaacagttggaaagtgatatgtatccaggcagcagattaatgtgaggccaaagcatggaaagtgagttcctgctgcagccccctggaggtgtcacgttaggggagaactttgtctccaggagctgccaccaggaccctttcaaatcttgccattgaatttagcctggcatccaggtttctttgtgatgggtcccttttcagccacatcttccactacaacattctgctgccccagaatgtcactcattccctgaacatacttttcttccttgtgggcgtgctgagagggtttcctcctccacggccccaaatcccaccccttcctcagtgccctcctccataaaaccatcagttctgactaagttctctgtcctgtgaagtcctcgtgtggacttactctcctgctgaatgcacgtttacttttctgaatggccctgaagcatctacagtggctgtcttgcctgcttaactcctgtaccatcatatcctgtttatgctgaaattctccatgttatgctccttgagaacagagaccattccgtcttcccctttgggtgtgccctggaaccctggcacatgttatgggctcagtgataataatggatagaaaagggagtgggatggaatcgggaaataggagacggaaaggcatcaaaagaggtaagagcagctttgttctcctttctgacagggacaaggaattctgaggggttagaaagaaggaaagagaccctaagagcgggggatacaaaaacaaaacagctgtggaatagaggaggggagaccattaacctatttaagcacccctcagtgtggccccttcccattctgcaccaagatcagaactggcaaagtaggagtgggtggggggagtggggaggagacttcgtggtagcatttaggaggaatcttaagatgaaaaggaaatgaaagtgagagaaattggggaagccagcgcaccaaaccagaccctgaatttttttatgctttcaagttttattctccttcttcaagcttgtctacaaaaagatgggctttaggatggtggacgagccaggccttgattcatttccctttttcaaacaactaacttgaaccttcatctgaacctcgaggccctctctttctggctggacatctcttgagaacaaactctagtgatttccgtggtctggggaagcggttggcctggatcacggaacaacagcagctgcatctcaggaggcttggccctcctgagagacaagagccggagggacaaccgaaaactggctgaaatttagtgcaaacctctcatagctcagacagctatctactttaagtttctagtccttgatgaatatttataccaaaatagggccagtggaaaagttccatctgcctggattttaagacttttgcctttcctcagccacgttgaccaaactcaggaaagtggcggaatcattgccaagtacatgctctttgaagtgcaagaaatcctgagaaggccttgaattcatcatatttcttcttatcctgaaaacttagagttggcactcctttaaaaaaaaaatgcttaatatcagcacctctcagtgctttataattttagccaagcccttgacaccatgttgaccacaacactcttgaaggagtggataggtctattcaaagttttgcagggagaaattgctttgttggttgatatttttaaaatccgaatgatccaattattcactttaattctcctctttagtttgctagtaagaaaaatggccccaagttttatccttagtgttattagtcatcctctactcctcagaaccaaaacaccagaaatttcaaccatgtcgtacctttgatgtgtgaagataaaatagaggccttactctagcacgaggcatagtgagtgctcttaccaagcacaggccaggtgccaggcattgtgctacatcattttttgctgaattttacaatcatcccattttgcagatgagtaaactaagatccagagggattaagtcccatggttacatacttagtcatggtgaatgtgaatgaaatgtgggcaattcaacccatagctcttccttttccttctgtacagtgggaggatcccttgtatgaaaatctgaaatgctctaaaatctgaaacttcctgagtgctgacatgaagccatgagtggaaaattccacacctgacctcatgtacatacactttgttttatgcaccaaaattatttaaaatattgtataaaattaccccccaagttgtgtgtataatgtgtatatgaaacataacaatttcaggttaaggcttggatcttgtccccaagatatcgtattacatatatgcaaatattccaaaactgaaaagtattcaaaatctgaaatacttctggtcctaagcattttggaaaagggatgctcaacctgtactatgtctaacctatatctaacatgttttcagtgttccagaagtttgggtcgtggacttgttggtctaaagatgaatttagttgatacacaggcatgcactgacaacattgaaccatgttagtcagcatctttctctcatttcagttctttcattcttctgattatatcaaggaggaagtctccttctgatgctaaaacgcctttatcatcccaaacacttgctgaacttcactttaaacaattggcaagtagttcccaggctcagaacttttaaaaggcaatcatacctagctagaatttaatgactcatatttattgcatttgttgtggttaccatctaatttttatacactttagagataatttttttcaagaaatatgtttttaaacatgtgtttaaagaaaagtcaataatcacacagatggtatatggagaacaaaattcatgaaggaggaacatgaggttttataaacatataatgcttaattattcttggttttcaaagcatcttacgtacattaaaatatttgattcctacaaccacctcatgaagctcatagggattatgatccattttaaagatgaaaaaaaaaaacaaggttcagagaacagaaactatttgccagggtccacacaggtagtaaaaatgtagccagggctcaggttcaacactaagctccaacatgcacagagctcccccaacactttgtcagcaaatcattcaagggcaggagtggatcaagggatattccaaagcaatgagcccagaccagaaatgccatggaaaggctgcaaggcttactgactcactgattgccttgagttttcacgatttcccagtgcttgtctgtattctatttcatggagaagcctgcagcagagtttttctagagcagtctgattttctctctctagtgagtcatcttccagaaggtcaagaaactggctgtcccatcagagggtcatctcctgccttctgagtataccacacaagggatgacacaaactagaaacggaccacttgatgaggaaaactgggttctgcagcaagaagacagcatttctttccaagtctccttgccttgagcagttgactgggattcagatgtcaggtctgggtggctggacaggcaaggataccataaacataggagaagcagggagagagcgagttggcagtctcatccgtctatccatgaagagattccaggagctgaaaacactcctggagataaagatgagagctggagagaatagttgaaactatgagtagattctaagaagagaggagaagagccagtgggagaaccttggggagagaagaaagttattgaggaaggcagagaaaggggtagtcagaggggctggcgtaaccagaggaggctaggatcctggaaaccagaggaaaccagggtgcctctctttccttctaactccccttttgggcatcatcctcagatgcaggatatctaacatatattagcttttgatgtgccaagaagcatagatgatggcatagatgaagcatagatgagggcatgggtgaagcatagatgaaggtgttttatataaatgtttattgaggagccactatgtgcaaggcattattctagacactggtaatagagcaatgaactagacataaagtgaccctgccctcatggagcttacagtctagcaggaaacaatgacattgaggagttatatacataattaaataattaccatcatggtagatactacaaaatacaaggtacggggttttctaagaccatatgataggagtgtctgagggataaatagaagtttgttaggtaaaggaagagagaaatggtctaaacagaaggaactgtatgtgggcaggctcagaagtatgcaggaatttggcatctttcctgggacatatggttaaatgaataattctgaatgtactcaagagataattttctggaaagtaacttggcttctgtagttctgttttacatctgaattgtggcaaatgagttttaaaaacaagaccttgaaagtgaattatttgcaacgtgaaggaccgttcactagtttctgtttcataaaactgagcttagaaaaatgtggcctaaatactctgtaagttccttttagtcctaaagatctatgactttcttacatgcagaatccaagtatatatagtgtgtacaattagatcattatgcagggggaaaatcaaggaaaggataaaacatctgaaccaaaaagtgtatttagtgttagttttaaaaacatatgatagcaaaaaaaaaaaaagaaaagaaaagaaaaaggagtcttttataagaaggatgcttgtttaaaaccaggaaaacatcttgctgaaggcactacactaaaacacaagtggtattttaccatcaagactccaatgttggttgaaggaaatccttttccatgtgcacacacgtgtgtgtgtgagagagagtgtgtgtgtgtgtgtgtgtcaatgcttccattgtcataatagttaacccaggaatttaggtgtgagattcccagcaggaagcatttgcataagcaaagccttaagacttttaataatagtgctgtacgtttatacaacacatttccttttaagatactaagattcagacaggcaagattaaaaatccaccaacttggtgtgttatgtctcccctatttccaaaattaactccaataaaagtgtgttatccttggaaagatcagtaggactgcaaatttggaattcagacacatgcatgcacaaacacacacacacaccaaatgacattcctacaggatgacattcttaagacatcaggctgctaaaatcaggagcatcttataaaactagggaggtataataagtaggtattgctgacctcaagcttacagatatatccttgagaaggagtctgttaagggcagaaacctaagaaccacaaaaccaattagattttaatttccaagtgtaacctgaagacactaggcctggggacaccaacagcttgttctaatttaggaaaggcagggtgggaggggagtaaggggtccccacagggaccttattttcttctatcttgatttccctcaagctacttggtaaatcactaaataagattcccagggagtttggataacttgtggctcatagtgatgctggtggctttactacattttccgaaaggctgacagggcatatctagggaaagaaaaagacaactccaagagaaaaaacaattgtgttggagcctctggaagcatttagtttggcaagaaatgccaggtcaacttttgccctataggaatccctttcataggcaattaaaacaatgcccaccctttgggactctgagtgatctcaaaagattcattaaaagtccacaaatggaaggagatcagaggaccatcctctcactgactgaattaagcaggtagcccctcaaataacgggctgacttttctagaaacgtggacaattctgaaacagcggaaaatggttttgcttcttggctgttttctcagtctgcctttgtacaattcactattcacgttagcctgagcagtgtctgtagctagttcaaagggagctggtgtcaaaggaaaatattagttcagccttaaaaatcctatcacttcagtccagtggggtcccttatacgtaagatttgtgggcctgctttggatacaacaacatgtaaacatcagctgtcagcaagaagctggcagccaaaaaggctggtttcctttccccctcagtcatcttcgtgttcgccctgccaacagaatgttcaacaaggagcccgtgtcctgggccaggactgccagattcctagatgttccatgtgccatcacacagatccagtcacccagcaatgaatctttgaatttagaatttggaactttttgcctcgttccatactcctctttttcaaagtgaccccaactccatcccctttgacagataaaagagagatcctgtgactttttccatgcttccccttctcaaaggctgtcgcccatgccaactgggagaaggagcccagcctgcgaatgattttatagaattgcttatagctcctctgtccaaacgtccctcacatcaggctgttccaagagttgcaaacccttgaaaaatgtgctgatttgagtcttatcacctctttgtctatttttgatggaagtgctaaaaatacaaaagagtaaaattatccaaaaggcagacagaagaaaaagaaaaaggggcagatagtctcctatcttggctagcagagcactcatggtgtcttctcccttatgccaagtgatactgtgatgataggtagacagtgctggtagattcggttggtagaccagatgaccgagggaactgtgattgcaatcatagattcttaatcagaaggagagttgttttttcattttggttttggtttttgttttttttcaagatggatgcagatggtggggtcagcttctcaggtggagtacagttttagaaccaccaccatcacccaacccctcaaaaggaagcacaggcttctatacacttacttctttcatggcccagggtctgggtgttttggctttcctggaaccagtctcaaatcagtgaagcttggctagcagagatgggttggggggaggcaggagcaaggtcttaaacagagaaagctttcattttgtatttccctttccacatatggatttacttttctactctgtttttatagccagattaaccccttttgttcacagatgatgtcagccttggtggtctccaatcatcccctcccctggaggggaaggcagagctacacaagtgattacaagctcagcagtgttccatgaaagggcatccatggtggcttggagactgcagcggggaggagagtgggtaactagtctaggaaagtcaagagtctgccctgcggagctgataggaggaattggccggccttttccagaactgccccaggggtgtgttcctcaaggagcctgaacacggtgattggaacagagacttcagggacagctgctgtgggagtcacagaagcaacagttcccttccatcagttccccaaagggtctgggactaccatgcttcactccagcctctcacatgctccaccttggcaggttgggcttctgtgaatttattcctcctttgtgaccaacctgattttaacttaatctcacccattagacatgacatgtccagagagaggaacattaaggagaacatggtatatttggccccaaacctaaattctcccttgagttgaacctggaaaaactaatcctgagagaggaaagaaaaaaaggaatgattgaacaatttaattaatttttaaaaattaaaaattaaagggaatatatcatttgtcatagagagtaaaaactattctttcattcagcatttgcttaaaattttatttgggacaccagaaactcctgacatcacgagataaatccatctgactcttccaactacaaccagtccacgggataaatttaacacacacaaaccatgtaataggaaaaatcatggaatctttaccctgaagggctgccgattcaggcacttctgccatcagcacattatccaccaattgtgttctcattctgttgctttaaatagtattgatctttaaaagcaaaacaaaactaaacaaaagtttccatccatagaattctaagtactagatcagtagggctcatctcaatttgtttagtctgtgcatttttatcttcattacacaattcaggaaaagagtctctaaattaaagggatttcttcacatttgtgcttgtccagacagaggaataggaatgcccaaggagcaaccctggagtagaaatggtagatttgaacacacatacacactctcacacatacacatgcacacacatgcacaagcacacacagctccctgaagagcatctgtcatatgaccccaatgtaaacgaggtctttgttgctgtctgtgtgagactcactgtgttttaggatgcactttatccaagtcatttttttggttgatttctgccataaaagtgggctgcaagtctcactctttcatatcatacttgggaagacaggattctcttggccacagcctgaagccctagcgtgggggcttcccaaagcttggggaggtgagtgagcaagaagccaaaggataaacatggagcagcggttctgctttaagattggagggagcaagatggggaacatttgttttacattacaacaggaaaaatatagattgtggaataggatgcaaaaagtcaccctgatgtttaagagcaaatagactggaaagagtcattgttcaccttccctcagcatccctggctttccaaccccctggcatcctcctctggtgacacacaggacctgtctcaggaggagaggtcaggcagaggatttactttcaggaagggcaacaaatgtagactttaagttatggacaggcagttatcgtattggtaagtatgttgattccattactctgttaagattgtgtaaccctgttttggcaattccttgcttcaattcttgggagcttcaaacaatggaagaagtccagacccttgtcaagaccccagtcttccttttttttaaacttttaatttttgtgggtacatagtaggtataggccccaggattcttaagtgggaaagtgaaaaaagccttcctggccagggcactccccagaaaaatcatacttcttaaggaaaaaaaaaaaaaaaaaaaagacttcccatgcagcttgcaaccatttgggtgttgcacattcccaggttgggccccctcatctggtgggaatcctcagtcgaagcttccacctgaagttggggagggtttggggaccacccctcgcctcaggcagggcagagggtctcagtatccatgagtgccccagagaggagtcagccagtcagtgaaatttagaggaagaggaagggttgtggtttcccttcggtctggttaagagaatgactgcatttggcaccaaaacctgtggggcaggcttgtgccagggctgatgctgaaatgacaacaataaaagccagacttgctgtaaaaaactctccttgtagggaatggtggtccacaagctgcttatgaaaagggaatttttttcagccttattgaggtataactgacaaataaaaattgtatgtctttaagaggtataacttgatggatttgtgatgttgctgttgttgttgttgttgagacagggcttcactctgtcatccaggttggatgcagtggcacgatcacaggtcactacaacctcaacctcctgggctcaagcaatcctcccgcctcagcctcctgagtagctgggaccacagaagtgaaccaccatacccagctaattttttagttttctgtagagatgaggtgtcactatgttgcccagactggtctcaaactcctgggctcaagcaagtcaccctccttggcctgccaaagtgctgagattatagacgtgggccaccgagcctagcccaaattgatgttttgatattcatatacattgtgtactaatcaaactaatttttttacatggtgagaatacttaagatctaccctgttagcaaatttcaagtatagaatacagtattgttaactatagtcatgatgctttacattagatctccagaacttactcatcctgcctaattgaaactttgtaccctttgaccaacatcctcccatttctcttaatcctcagcctctggcaaccacagttctcttctgtgtttctatgagtttgactattttagattccacatataaatgagatcattatttgtctttctgtgcctgacttatttcacgtagcataatgtccttgagttcatccatgttgtcatgaatggcattattcttattcctttttgaggctgaatattattccattgtgtgtgtgtgtgtttgtgtgtgtgtacgtgggtgtatgtgccacattttctttttccatttatttgttgacagacacttaggttgtttccatatcttggctattgtgaatagcgctgcagtgaacttgggaaggcagttatctctttgagatactgatttcatttcctttggatgtatatccagatgtgggatttctggattgtatggaagttctacttttaattttttgaggaacctcatactgttttccataatggctgtaccaatttacattcctcacaacagtgcacaaaggtccaggaagggagattattaagacaatgagctgagagcctaaaagtccaagttggaacggttgaagttacaatggtgagaccaaatgattcccaaacttgtctgaacattggcatcccctgggaactttcagaaatactgatgcctgtaatcaacccccagagattgtggcaaaattggcctggaatgcagcccaagttttggaagcattaaaagatccccaggagagtttaatgttgcagacaagttagggaaccactgttgtagcccctcgatactcaaagcgtggtccctgggacagcagaaatggtttctcctgggaggtaggtagaactatatgtcaggcttgcccagacttgctgaaccagagtgtgcatttgagctagatcccaggtgattttgtgctaatcagagtgtttacttaatttaaggagcactcccctcctcacacacccagaacaggcaaaatcccctgctaaaggacaatctcatgacacactgtttctccttcctagcactgattccatttgtaattttacatttgtgtgagttgagaaaaacgtgtgagggccccaaaatatctggaagaggctctttggcatggaactgtagtgcattggttaaattaaaatgtggatctggaattcagatacctgtgtccaaatctaagctctagcactttaatttgacccctttgaaccccacttaactagagatactggatttttccaggcttttctggttttcatactaaaaagttctacatcctaggcaccaaacagtctagtgcaaaccaggacagttagttacccttcagttaactcatatgcaacctagaggcactaacaatgtatcagtggtctcaaactttaattgtttatcaaaatcacctggaggtcttgaacagcgatgtctgggccccacctgcagaatgtttgatttcataggtctggggtgaggcttgagaatttgcagtgctcacaagttcgctgctgctgtgctgctgcttagagaccacaccttgagaaccactgcaacatacctcccttgtagagttgttgtaagatttgtacaaggtcagccttcacacagtgcctggaaaaccacaaatcctagtacttgttacagctactattgttacttttgattatggaaaagatgggactaaagatggtccctaaagagtcggcaggttttaagttctctgaggtttagatgagcataagcaaaatcccagagtttgcgtggatttagttctgcaagaggctcaggtggttggaaagagaatctgggtggaaacagtaaataatatggaaatagagacaaatttggacaggttactagctgttgaatcttgaagaagagcttaacctctctgagcctcagtttccttatctgaaaatgaggctaatgaaattatctcataaggttgtcaagaagtttagatgaaatatcatgaaaatgtttggcatgtgcctggcacataggaagtactcaataaatgttaactatgatcatgatcactgggaaagataaaacacttttgattaaaggccagtataggaaaaggtagatttaggataccccaccaccactgccttcaaaggagctccaatggagaccatctggatgggcaagttgcttctccactctcagactcaaggtcattcatcatcttttgactgggaataatgatgataataattatacttcagtgggaagtcatattattaaataagagaattactaagtaaaatcactgagtaaaattcatggcagtagggtagtttcagggtcatatttttaaatacaattccagtcctttcctggaccttctgataattttattccactcaacccatctcactccagcttctctcccagaacccctagggaagggtttgttttaaataacaagtcatgttgaccaataatctttaataacatgtatgcttatagaacttaacctgtaaaagacacgtctgcattgaatagaattttgtgtcaatttggaacgcaccacctcagaaaggaaacctgtgagtaatcattagggcgtgtgatagtactaagataccactttcaaaaagatagaatcacaactgttgtgcaaatatgaagtgaaacttaacaaagattgtgttctacccattaatgagggaacccgtatgatatttaggccagtttaaaaagcgcttgaggagttaggtatttataagtaatttaatgttaggacaagattgatgggttagttacaaaactagttaatgtcttccagaacagtaaaccataacatttggggttatcttttttgaaaggacagaaattgtttgtgtctctattggaccaagatctgcaagttaacgtgttacttcagaaagacttggagctgagcaaagtaaatttctctagataatcctatggggatgaggagagccagtgccatattgcctccatatgacattgaaaggatgtgccactcacctttctgccttatgtctgagttttaagtacttttctagggggccggggggacaggatggagtgcagtggcgtggtcatagctcactgcagccttaaactgctgagttcaagtgatcctccagcctcagcctctcaagtaagctggaactacaggcacatactaccacacctagtttttttttgttgttgttttcctgtagggattggggtctcactatgttgcacaggctggtcttgagctcctggcctcaagcaatccccctgcctcagcctcccagagtgctgggattacaggaatgagccaccacatctaattatttttttaacaatggcaaatacttatttcaatttactgccttttaatgttacgtgatgcttacaacagccctattgagacaaagaaagggcagggataattcatttttcagaggaggcaattgagttactccatgaggaagaagctgagctggaaggagaacccccattttctaattccaaatcccatgctcatccctaaattcccagttgcattttctcttttacattcctcttcctctcaaccctacattgttcttggtgacattttttttccctctaagacttcccttgggattcacctgaaggcaaatgcttgagagaggagtcccagagttgcccctgctccttgcatccccaggggtctcctggtctaatctaagtccttttaagtccctgccaccattcagtttcacgataatatcaaatgaaccacatcctactaacccaagccaaggaaaatcgtcaaaacatttctttctgttctcgggagaaaggacagattagatgctgcattccaagaaacctttttttaagtgatggtttcttttaaactcttctattctcagctactgtgagacactgtgccgtctttcaagagacagagcccacatcagaaaaacctactgtttataaaccagagtatctcacttgggactgtggctgactgatgttttcccctcctcagtaaacaagatcgttctctctgtgttgaagatagcggggtctgtctggcttctggatgaatggcatgcagtggacaaatgactatttattgcattaaacagtcagccaggaaactagctgcaagtgtggcctgatgacctgaatcaatttcttccttgcaaggccatttatttttctctcccacatacttctgttgccatggaaactgtcccactagcagatggagaccagggccaactctcgcttcctgaacctccatttagtttagcgttcttgcccaactaggccagtcgcctgtgtcttcacttgcctgactgcatgggctttctttgtgcttgttgagattttaacgtcgattctcttcaggtgattggtagcagagcaccgcgagggcaaagggctagggatggcctcacttaatgagttaatcattaagtatgggacatgtgtgagcttattttgtttttacattttgtaggaaaacctagtcagagaggcaactctttttacaagtcaaaaaagtagagaataagaaagtatagggggtgtgtatttagaaaaaatagttcctctgaagtcccctagcattttgaagctagaaaaaaatgtgttgagaatatctaattcagggtctctcaaacttttcttcacaagatgtaattaatgacaacaacaaagaacgctcagtgcataataagtgtgtgccaagcccttttcaggcagcatcccgtttaacctcctggtaaccctgcaaggcaagttgcattcttgttatccccatgacgcaggtcatggaactcaacaagcctacttgcccaagtacagtggaggaaaggggaaaaactgagactaaaacccgggactaaagcctgggtctccaaacccgaaacagttgcttgctctctacctcacttcttgcttctaacgtaggctggcctgttaaaggctcgggagcctctacacatccagtgcctgccatttgtatttgatcaggtaattctctgtcccactcccaaccaggaaccacttcgtaacatctcaccaagtgaggatcctgcagaacagaatgtgggcaaccccagtgcaagccagttccttatttttcagaagagatgctttaggctgggcaaggaaatgactcatctccagttacacagctaataaatgccagagttggcacccaaaggccagacccccgcatcaccggcgagtgctctgctgtgctctgctgtgctacctacatcactattctaaatcaaaccccgagtttgcagacagattgcagctccactctccaagccaagcatcagaactaatccccttgtagaatgagggttaaatcagcctctcattagaagaacaataaagctgaagtgtgcagggtgctttgccacttggaaatgcttccacctacctctccggtttccagccttctgagtatatctgaaatggtccaacaatgaagccttattcacaagttgtatatctcccaaaataaactttgagtgactccaatattaagtgtgtaaggatcactgcatttcaactaggagaactgaaggtgtcaaggggaggtggaaatgagcaaggttatatgccagtggctttagggagcaaagtcctacctgtgaaagaaagctcccagcttaggagaatgagttagcagtgggtgttgtcttaattttcacttttcacatgaatctagcattgaataggcctaaatataaacctgcttccctccacactccacatatgtgcaacatgactctcactccctgaagctgtaaatatgtattgaacaaaatgacaaagtgtgtggggacatggtgtacacagcagtcaccaaatagaaggcatggagtgaggcattattgtgagaagatttggtgctgaagagaagtattgtgaaggacagctgtctctttccatacgtctgaattctaccactggcaatgaggatggcttcacaagtttcactgcttgtattttccctcttaaatgcaaagagagtagactagtagcatccaaaggacatgctcacattgcataccctactcatcatgcctttcataccttttttaccttgcacattttcttccttctgctaggcatctcctttcccttttctgcctgtccatcttgcacagcccaaatccaaagtcacctcctctaagaagaagtagtctgctctaataaactcatatttcccatatgaatttattaacactttcccctgtgcttctaaaatctgtggcaaaataagagcagttaccatgtctagtgcctaatgtggtcctgcacgttactatattatctcggtatccacttggcagataaggaaactgaggctcagtatgtccaaggctaggcagccaataagttactgaaaagctcgatttggaatccaagtctctcagactccaaaattcgtgcctcttttactacacaacatgcagcttcctttacctcagacttgccccttacaggagcaggagatgaatgtgtttttctctccatatccccctagctaacagtgagttccactagggcacacctgagtcttatgttgtattcctgtgtctggtacatagtagatgctaaataaatggtatgtttgttggataagaagcttatccctttacattactagttgattgagccctgcttcaggtgaaatcataataaagtacatccctgtaccaagtcgtccccaccccaaccccaatggagagttgggtaagtttctcagccagcagatccatattactaacccacttcttctccaatgttaatgtaatgcagatctcctgggaattttgttaaagtacagattctgattcaaacaggctggagtcgggtctaagggtctgtatttctggcaagccccaggtgacgcttctggtttgaagatgccatttgggtttaaacacctcagcagcagcagcaaatgcacttttggtacctttggctggtagcaagtaataaaacctgtctcatgcattgttctccttccaaaggagattttaagtgctcatgtgatttttcagtgttttagcaaaatatttaagttatgcttcaagctataaacatttggcaaaatgcacatttgtttgtgcctgtagctttggtttaatcacactctatcaataaatcacaaataaatgagggagaggagacactcactgaagattccattccagtgacaagtgagagtgggtgagggtgggggatggaatagatagatggtcactcacagcagggcgtttccaaccagtcttgctgttttgaaacagcactggaggctgggaaagaacccccattgcattcttattgggaagagccccacccttccacaattgcctaccctctggccccattccatgttcctgtttggtcttctcagttcccggtaaacagtttgtgatggcttattgatctcaagccctttgaaccccacacagtccctttgccagcacgccaagtcttttagaggtcaagcatctccggtccaagatgtttggaaggaaaacaccctcttttctgttccttttccagatgtccctgggccagctgcagtcagcaagaggtgtggcatgtttgggatgcaaggggacgtgttcgggcttcgagccacattcatggaggtaacagattttgtcaggagggtccctgtctgcctttgttacttggctgtcctctcggggaaccctggttgctttcttcgctgagactgctttggttgtatgcgttgtcagggaaggatggctgcagagggaaggcactcctgcttggtccaattcagaaacgaaaaaagtccttgggggagtgtggcgggggcagtaaagatgtgaagaaggagtttagcacttcctaaaccatttcaaggtagagtccaccaaacccagcccagcaagaattgctctgggaagacccaagcagaggttagctggtcccttgtgcctttggggtatgcctcggggtttggtggatggggtgatctcccctcactgcaccaacttcgctgtggatgggttttggtctagagtggcccctgggacagaaagagaggtcattctgtccacagtacttaaaaaccaggacctggtattcatatctgcacaggaggaccataagatccagctggagttggattcgcagaggttttctttctttttttccactgaggattctgaggttaagaatgaggctgccacaatgcagcgtccctgggcagcattcatgtcagcatctatgtggatggcacctctggagtgtgcagggaacagactgtaagtctgtccctgcggccctgggagaggaaagttaagttctgtggagcacatagcaaagaaagagtttttatcaccactgctgtagcgttgccttgagcgctcagtggggggacaaagtttggaaggtgttttcgcagcaatactgacttccattatgagatgggaattataaaaataactacgtatgaactgaatgaaatcttttttatttaaatgttgaaataaacctaagcagtaggtattagtatctccattttgttgatcaggacattgaaggtaggcaatggggcaacaactaccagatggcaggatttgaactcagatctgcatgaatcccaatcccatgctcctaatcgttctgcagtacacagggctatgagctttcagagcagaacactgttccctgactccattccctgacagttcccaacctcagaggagctcgcaccgtcttctggttgctagggaccttcaaggtcctccaactcaggcttctatccccttcaaaaactccttctataatttaaacactcctaggaggagttctccacacttactatattttggccatttgagctctttctggcctggaaagaaagtcaacttccttatcatttcaaccccactggtcctgaatctcaggacagcgttgattcctcctcagcaatttgaagacagctaggacgtctccttttatatttcttgagccaggggaaaatgttatctaaatgcacccaccgagtcaattcaatcagttttcccttctctcaaggacctcaatcctgtgctccctgctgtccaacatctgaaaatgatcatttggtatattttttctggttttccagttgttcaggaagagaggacaattctggaccctatttttcatggcaacaagcagaagtctcttagcattgttttaatccctccattttcttgtcatcgtacaaatgatttgaacatcaagtgaatttgtctttgagaaatacagattgaagcttgcaggtcctgcatatcaagtgtcatccttggtttgaagaatccaaatagggacttaaattagactcaaattgaagcagtaacatcacagaagcttaggagggaaatcctgttaaacttttttatgctccaggttttaaactctcaattgtttgtaagacatttaaatgaccaaagtgccaaccaacatggtttaataggaaagcccttcaactaatcatcacaggacagaattcagtcccagattaccaatgacagattacagaaatggctgttttaataccgttgaggatattttggggtgtgcctgtgtcctctataatctgggcacctggaaagagtggggtggggtgagaggggtggatcactcatgtataaagtcctagaaatgtgcctggccacatgaagagtgtgaataaaaggagaaattgtgttgacaccatttcaaggaacatctcagatctgttaacttttttttgttttgaaatgttttgcattcccagcctctctaattatcatcctgaaattccacattaactgcaaaagctatgcgcagcctcctcatctagttccatttatggaaagtattggggaggtcagaaggtcagatgggacactgaagagtcaggttcctccatgtccctctatgccaggatttccttcactttctgcctcttccttctccttccacttccagccctgctgttctcactcccctgatactgcctagtgcctgtcttcttaaagaagcaggcttctcatgcctggctctgaaaatggataagcaagagaatattattgattgtgaataaaatgcaaaacaaaacaacccatttttatttttatttatttaattttttttgagaaggaaaaccttctcatttattccctgcagcaccctgagggtcattttctcctttttgctactggaacacatccttgagattgtcaattttaacatctctcaaattgcagcccactgaatgtgaacttgtactgcaagcttctccagtagcattcaaaatgtcatgctgcacatcaccgtatcaaagtcaaaggagtagctttgcactaaagagaggtgtttaacctcccttaacccactgttttccaaactcatgaccactaagcaccaagcctttttctatgtaccacatactaatctcctggagaactggcccaggccagtagaactactcccagattttaggcaactctcttctgccctgaatgtattctactttatataatttccatctgattttctctccctgtcccatcccaactgtaagctccttaaaggtcacaacaaggccttcttctcttcatattcagtaaggggttcccaacctctcagcacaattgacattttgggcctcataattctttgttgttggagctattctgtggaatgtagaatgtttacagcatccctggcctctacccaccagacaccaatagcactcctctaccccactgggacaatcgaagatgtctccagacattgctaattctgtcctttgggacagaattgaccttagttgagaaccactaatttagaccatcagggcttgcccccactagccccacaatcaacgtttgtgatattcgatcagacgtatttacctcctgactgtaggagggaaaaggagggttccctcagccttgccgatcattcagctgcagtgacctcccttgctgggcctccctcatccctgcagttggccttgacattgctcactttactgtacaagctctcaagttgcatgcagaagagcatctgagacccagcacagcctgcccatggtgacaggccggaaagggaggggagcgattttcctctcacgccgtggaactctcttgatttctaaaccttaacagcatgacaccaagtagccacagatttttgtttttaattgtcaaagagaagcatgaggctttttagtaaatctgaaccctccccaggatgtgtttccttcttctgacaaagccttcccaatacacatccatctccccagccagaggggttttctgacctctctccctgctgggtcctgttcacaaatttcttgaagaaaatattcactgcattctaacggcagtatttatgctaaagagtttaaaagttgctgaagctccgaggctatgatcttggaaaacaattttaataattctttagagcaggagtttgcaaactttttttgtaaagggccagaaagtacatattttaggctttgtaagccagatactctctgttgtaactactaactctgctgttgttgccccagatcaaccacagacaatatgttaatgagtggtcatggctgtgttccaataaaactttatttacaagagcagattgtgggccaagtttaggctatgggccacacagactccagcccagctttagagcatctctgatgaacaaatcagcctttgccgtggcaaccaccaggagggaaaacataccactctttttaccagcacaagttatatcctacattcctcactgatagattaatacaaacactgtcatttcccaaatgcagttcccaattccaaaggcctttttgtctcaggttaccatttgtccgctgctagtttttccaacttaaagttttagcttgctttcaaaagggtagatgctgctagcaggagaatgtgcctctttttcctggaggttaatctcactggtccccatccacccacccccaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactggtaagagagcttccccaaccaagcagttgttttcctatcctcataaatactagccatgtcaagtgtttctgaatttcaaacatggggtggcaagagctcaaggtcacaaaaatgacaggagtggctgtggttttagccctgcccttatatcatgtgatgttgagaaatgaagactatctgggcctcggttttccttatccatgaaatgggtagaggtgttcatatggaccccaagaggccttgcagctctagtacaggggcatttattgttccatttgggctcctcacttctgaacaggagatagtttatcactcaaaattctgagtgcttatctccatctgcaagatattcattttcccttgaagtagcctgggatatgccctttgcaaacctgtaggagagcagagaaacatttctctcttctgcctaaatgctgaaacctattggtcttaggagggagagccaaactggttttatataaccttgaacaaaagcaaccagagaaatctcaagtaaatgatcagagaaaccctgaggagggcagaaaggacacaggtccagagagagcaagtgactcacacaaggttacaccctagctgctcgctggaatccccgggacctgcagaaggtctccatacccaggtctcatcccagaccattgagtcagaagctccagactacaaaatccaaatcatcagatgtgaccatttaaatgactccccgtgcagccaccttcaagatccaatgcaccagatcagggctcctacaatctcaacatgggtagatatcacctggggagctcatcagaatgcatccagcaagttcagggccatcctgagataccgcacgcctgacatactcccaggtgatgttgatgctactggtccccagaaccttacatgtggagtaacaagaggctggatgatttctatatgttaatacaatttgtagaaggttcaacaattttaaaaatgcaagcatggcatttaattgaatatctgctggaagaaaaggagtgcctttggagcccttcatggccctatccttcaggctcctccatggctcccatcactgtgctctcactcccaacatctcaacaccttaagacactctgacttcctccttccagtgctagaacacaccaagctcctgccctccttggggccttcgcacgtcctgctccttttctgaaaggttctttccttgctcttcccaaatagtccttctccagatattcagtttacaatagatgtcacctgccatcctatcacattttttatttcttttcgtttctttaacaacttttattgcaaacagattatcttttttctgtgcctagatatgagggcagacaccctgcctgtcctgtaaaccgtaacatccctgcacccaggacggtgcagggtgcaggacaggtgtgacgagtgttagtgcaatgtcaccttttaggccagagatgctctaagtgtgggctgtggactggagctcttccgcacagtctttgtgacctggacccaatgaaaaaagttgagaaattgagaatatatgttgggaaaatgttacagcaatttgacatgcaactgtgtgatgggatgagaactcatatcagaacagaattccactgtggtaagactcacactgaaatctcatggggtatgcgctacattctaatcacatgagagagaccacaaatcactctgcaataagtaaaaaacaaacaaaccttgatccttcgccatagagagtttcagaggcacagttctaagctgttgccttaggggggaaaatcccttccagataaaatgaaaagagactaagatttttttcttaatctgtactttttgataaagaagagcacattttaaaagaacacttcagcatccatggactcgatcaccctgtaaggccgagttgttttacatgtaaggaaacacagaatggttaattggctttcaaaagtttttagtactagacaggggcttgtcccgggccacagagtgtggccacagaacaacagcagagccaggacatgcccggtagttcagagctcaggtctccctccagccccaggtctgggtaagctatcaagcacgtctccaggatgtcagtggaaactaaagcaagcagctcatgaaagagctggctgcgggcttcagggaccggctggtgaaaaccccaaacacattgaccccagactaatcaggggaagccatcgtcaggcagtgattaatgctggctcataaaaccacatggctgtaaagaacccctctgtctgctcttcatctgggcgtccagggcaagtcccatttctgagattggacaactcccccttcccactcaccttcccaacatttttattattattattattattattattattattattattattattgtactttaagttctagggtacatgtgcacaacgtgcaggtttgttacatatgtatacatgtgccatgttggcgtgctgcacccattaactcatcatttacattaggtattctcctaatgctatccctcccccaggcccccaccccaccacaggccccagtgtgtgatgttccccatcctgtgtccaagtgttcttattgttcaatgcagccataaaaaaggatgagttcatatcctttgtagggacatggatgaagctggaaaccatcattctgagcaaattatcgcaaggacagaaaaccaaacaccgcatgttctcactcatagctgggaattgaccaacttttttttaattaccgaatgatcaagactgattatattttgggaatgggaccgaattttgctatctctcatcctttgcaaccagaatgaaagtctgagcaattcttaagccttcaaatgctgataacaataagcctaattgtggatatttgttaagtatttactgtatactagccaccatactaggagctatccatgcacaatctcatctaattatccagcactgttagaagtatactatcattaccctcagctacaaagaaggaaactgaggctcagagagatgatgcaacgatgcagctagcccaatgtcccacagccgatgtaagtgacagagccaggtcttgaactcaggccaccctgactccaaagtttgggctcttccctaccaatccaggccaggccaggcgaactggcaggtgggaggggaggcaggaaggagcagataccctgggttagcattttcagggaaggctatcatgaacaggaagcagcttgagtgtggctttgaaagctgccaggatttgggggaaggaaagagggagaagacaaaggagaccagcatccactgagcatttgtatgtgtatctcatgaacacctcaccgcgccctatgtgctgagtatgttacaggctcattttacagaggagcagacagaggcccgtgaggagccaatgcaggggtggcacttactcatacctcgccctctgcttccagacccatggcaggcattacttatcagtcagagtactgtttcccattgacttcttatcggccctcaggatccttcttcacatagcactctcggtcaccactatggactggggttgacttgtcagatgaagcccatttactgttcttggctgccagcagaagaatcaggaagagaagaatcagaacagggtctccggattccagagcccatgtgtgtttcactgcctaatccagggtacaggagtgccttcccttccactttgctttgcatttttagtttctttcctgatacaggcagattcctggaacctctccacccaagatgtcccgaccaggttgcagagcaccaagtaactcagaaaggtcctcagggggccaggtgcagtggctcgcacctgtaatcctagcactttgggaagccgaggcaggtggatcacctgaggtcaggagtttgagaccagcctgaccaacatggtgaaacccctctctactaaaaatacaaaaattagccgggtgtggtagcaggcgcctgtaatcccagctacttgggaggctgaggctggataatcgcttgaacccgggaggcagaggttgcagtgagccgagattgtgccactgcactccagcctgggcaacaagagcaaaactccatctcagaaaaaagaaaaatcaagaaaggtccttaggaaaaacataaaacctaaaccaacctttccaactggtctgagaaaatgcttcctgctaaaggttatgggaacaagatttagctcctatgacgtagtcaggtatgagacgtagataacatgacgtagtcgggtatcagagagatacctgggagattctgtttcagagtcagagcagtgccaggtcgttgactccggcccaaacctctgtccctgtcatccccttcccaagtccgtgccagtcaatagtggttgcttggagggctgtgttaagagggattctgagggcttgattagcaacgtttgtgaatagggagcagtggtggaagtctcagaccagccaggcaaggccaggatcacaaagtacacaccagtggcagctggatgcagtggcattgaccatgcaaagacagagaggctggagcttttttttttttttttttttttttgtgactgcttcttcctctgtcgcagtggcaggatctgatctcactacaacctccgcctcctgggttcaagcgattctcatgtctcagcttcccaattagctggggctataggcacacaccaccatgcccagctaatttttttgttgttgtttttaagtagagatggggttttaccatgttggccaggctggtctcaaactcctgacctcaagccatctgcccgccttggcctcccaaagtgcttggattacaggcatgaaccaccatgcccagccccagctggagctttgagctgcaaaaggatcactgggtccttgggaagggaaactccctttctccaaggctccagccaggaagcacattagccctgcagccacagacacccaatgccagtgcagagccgtgaaaggacaccgtgaacgcaggggtcaactaacatctggctggcgaagccgctgccccaggatccctagcacaccatttattgtaaagctcagaagaaaagggtgcaggccctggaaagccagagaaacagacacatccagggaatgggggatcctgttaccacttgatgcttacccagcccgctcactctgaaatgatgacaaaaggaaatgcctccagagattggggaatatttttcctcttggaaaatcatccgtcttctagagaggcagcagagaagggcttgagacccatgctgctgggttcatagctgtctctatcacatactagctgtgtgaccttggggaggttacttaacttctctgtgcctctgttttccaaaaggtaacattagtaccttcctcctagggttgttgtgagaattaaatgggttaacgtgtgtgaagcacttggaagagtgcctggatcatagcaagccctccctaagagttggctgttcctatcatctcttcaactgctgaacatggataagtcagcagtcttcccaggaagggcaattactctcccatgagccgaatcagcctggatggggctgcttcggaacttggtgttagtaagatgctagtcaggcctgatccccactctggcagagtgagccaagctcttctttccacttctccgaaatccttctttagattctggaagcaggggcaggccctgggcaagaaataggaaggggacggtgtgagcaaagttgccacccaaggctacaccctaacgcatctctgcagggctctgtgcctgccctcgcctgttggccgtccggctgccacttctcactgtctctgatggtcacatcctctttccccactcactgcccccagagaagccccaaccctggggtatcctgtgtcagagccacccaggagaaactgttttaaactgctgatagatagatagatagatagatagatagatagacagacagacagagagatagacagacagacagatagacagacagacagacagatagatagatagattttgagacatgctgcccaggctagactgcagtggtgtgatcatagctcactataaccttaagctcctgagctcaagcgatcctcccacctcagccactgaagtagccaggtctacaggcatgtgccaccacacctggctgatttttcagtattttgtagagatgaggtctctctgtttcccaggttggcttcaagcaatcctcctgtgtcagccttggaagtgctgagattacaggcatgtgccaccgctcctggcttaaagtgctcatttctagggctctccagacctcctaaatcagaacctaaggatagacccagaaaacttttcacaaggtctcccagtgattcttatgcaccctaaagtttgaggttcttcagacctacctgactgacatatttgtgctaaaagccacctgtaatttcatactgatcaagaagaaaactaccagataccccagtctcctaagacggggtcaggacgaagcccttcccagatgttgctgcagttgtgtgatgcacaggggcttctgctcgtccacatggttggtggactatcttggcctctttgacaggaatccaccgtctccttcccctttcctgaactgtaacctcgggttagtgatattgctcttctctctctcttggttatggtgaccattgaatgagattgccagggacttctcatgacggtcagaaccctagggattacataatctaccctgaactttgtagatgaggaaactgaggcccaggagatactttctcagtctgacatagagagcagcaggagaactggacctaaaaccctgacttccagacactccaccacccaggtcttctcttctgtctgagaaagcaccttgaaaagcattcagaggtgtgcagacatacctgggattagctgggtatgctgtgagcttacagtgccagaaggtgtctcagataggtgtcctctgggatttagggcagagtgaccaatggggcgtctgcagccacccctcaattggagtcccacaggagctcaggtcacctgcctttcccctttctatgctgtttcccagaatttatttactatgaatcccagcaggtaccaagccctagacttgtactcccccaccccacaacaaccctagcttcctcaccactgctccctaaaatcagacagcaacagggtctgtacaatatgcatttcagcatgaatttccatgttcactcccacagttcccaaatgagtccagccccaagcgataagctatgggccagatgggttctaggaggatgaacctagcagcagccacctcagtgataggaatcaggagactgggtactaaggttcagagtcagggtcaggcacagaaatggaaaatggttgtccaggatgagcaatttgcctctcacggtttctcaggccgtggtcctgacctgtatcttcccctaatctccccgtccctgggactcacccatgcataagaattacgttcaataaaaacaaatatataaatgaggccaaattggacagttacttgtgaacacattaatattcagacagttaccagtcatattaatggggaaatgttactgacctgagaccttgtcgattctactattagaagttgactttgcatattttttaattaataaaccatgaaataccttatgtccataatgatttaattatacttttctaagaaaaagcgattttagacaaggttgactttttttttaattaggaatgttgcccaggaggtaaatgaaataaaaatattcagttttgagagaaacaaaattcatgttgcaaagccagcaaatctaaaatgatcatctacttaaattacaccattctgatcaagaatgtgaatctctgactataacttggagcagagtaagagctcatttaggcatctctcaggtattagcaaaattcatatttcttccttgagaattcttacattttgcaaaagcctgaagcagctaggaatcgtcctctggcctttcctcagatctctgtccagtgctcgagaatcccagttgtttatctcactaatttttttgtttgccagtattttattgaaacagtagtgcaagtaaagtccaggagccaacttcttgcatcagatttaccaggattcttgttaaaaatgcagattcctgtaccccacacctcacctactggatggagatcttgactggggcttggtgcctgggaatctgcatgttagtaatttttcgcagggttattgtacactgtgtccattgagagacactactttgacatatgtagctggtgagtctaactgtaatcagagatttgaaaagagaaaagccacagatagaaaagcaaacagggtcaggtgcggtggctcacacctgtaatcccagcattttgggaggccgaggttggtggaggtcagaagttcaagaccaacctgccaacatggcgaaaccccgtctctactaaaaatacaaaaattagccgggtgtaatggctcacgcctataatcccagccactccggattctcctgctgaggcaggagaatcgcttgaagctgggaggcagagattgcagtgagctaagatcaggccattgcactccagcctgggtgacagagcgagactctgtctcaaaaaaacaaaacaaaacaaaaaaaaagagaaagtcagtagcatgtagatcaggagtgtccaatcttttggctcctctggaagaagaattgtcttgggccacacataaaatacaccatcacctaacgatagctgatgagcttaaaaaaaatcacagaaaaatatcataatgttttaagaatgtttatgaattttttacaaatttctgttgggccacattcaaagctgtcctgggccatatgtggcccatgggctgtggttggagcagcttggtaggcgctgtggttcttttaagtaatcctatagccaccctagggtttacgatcctcctttttacagctgaagaacctgtgcaaagagacggcatgacatggccacagtcacaccgccggcatgcctacaaccaggatttcagttcaggacaagccgattccagagcctttgctcttgctactatggtagaagggacatggcctgccctcagggattgaactgtcccgctagagggtcagctcaaatacactaggaatggttaaggactagggagagaccaaagcatacagtgctgcttgtaagaacaggaaagaagagagagggcttttccttccaggggcagggggaggtgtaagtccatgagtgaaggtagaaatcaagcctatcaattgtggggccagtgagaagagagcgccgagtgggacacaggttttgtgagggcagccagctggcataacttttgtcattatactgttaagagttttatcaactggctaccgtctagcaaatgatactaaagaagaggtttaaaagcagcaacttttctttggtgatagaggcaaactagtaaatgtaattattaccattaattgaaagtcagagaacagagcaaaatgagctttattcaaattctgatggaaaacctagcccatgagtaaatgtagactcctttttctttccactgccatccaaaattgaaaactacagtgttccttggagaataagcaataaaataatgattattattagcaagtagacagctagctacttaaccaacagatagagcacacaatagcagatgcaaacaagtgtctctttctcacacgcaagattgttccctgtcccacaccatgacatgggctggcccagtcacaggagaaacagaacccactgaccaaggactcatgttaaatggtacacacgcacagaaaatagcatttaaatacattaagtacaaccctacttgttatttgttccaggcagaaagaagactgggtgcccttatttaataaatatactattgtctggaacgataaacacaaagttgttggcaagctgttaccatgagccaataaggtgtaagtttttaaaatcctttttaaaacaaaggacagtcatacaccacttaatgctggggtttcgttctgagaaatgtgtcctcaggtgatgttgtctttgtgtgaatgtcaaagaatgcacttacacagccaggcgcggtggctcatgcctgtaatcccagcactttgggagaccgaggcgggtgcatcactaggtcaggagatcaagaccatcccggctaacacggtgaaaccctgtctgtactaaaaatacaaaaaaattagcagtggcgggcacctgtagtcccagctactcgggaggctgaggcaggagaatggcgtgaacccgggaggcagagcttgcagtgagccgagatcacaccaccgcactccagcctgggcaacagagcgagactccatctcaaaaaaaaaagaaaagaatgcacttacacaaacctagatggtgtagcctgctacgcatctaggctacgcagtatagcctattgctcctaggccacaaattgtacagcatgtgactgtactgaatactataggcaattgtaacacaatggtcagtcagtatttgtgtatataaacatatctaaacctagaaaaggtatagtgaaaatagagtatgataatcttatgggaccactatggtatatgtggcccatcgtggactgaaatgccgtcatgtagcacacgatcatacagtatgcatatggcaaagtgcgtgcatctgatgtgtacagcttgatgagctttgacacagatacatttccatggccctttcaccaagattgagacacagaacactccctacatacacaaggtagctaagggatgcgtgtttttcctttactaaagttttttctctcatgtgtgttttatttgtcacaatggacagtattgcttttgtaattttctaaaattacaaaagtaatctaactgcattaagttaagaaaataaagactgtgggtctttcagttgctgagaatgctggaagagaatgcattttcagttttaggtagattctgtcatagtttctttgactgatgaagccccatccacatcatgttgtctcttcctcctcctcctccctagggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtaagtttctcccatgcttccagccaggctgaaaccatgcaggcccagggctggacagtcagggccccatcacggggctttgttccctcattcatgcatttattcatgaatttgtgcattcagcagatattgattgctcatttagtctgtgccaggcactgtcccatggaaaatgatacaataccactgcccttgaaaggctcatagtccagtggcggtcacaggcaaaaccgaaacagtttagagaagggacatctaagcctgcttggtggtgagggtaagcttcaagaagttggtgaggtacaagctggtctacgaagaatgtctaggggtcatccaagccttcaggctttgaggggaggatgtgtacccccttaaagaggtgagcatttgcaaaaagagccaggagttcaagaaagcacagtgcatttagaagattaaaagaagtcccacgtgattgaaagtgtggcatgcttggggagctggggacatgaggctagggagggcagcagaggctggattcctggagggttcattccatccatccattcatcagtcaaatactgattagcttgtattagctgcactgccccaggaaatcaaacaagcagaggacactgtccccaaactgcagaatgccatgaacttagttaggactttattccaaaggtcatagacaggcttttggtcagaggtacatggtccatgctgtgcttacaaaagtttcctctagcagtgtcttagtacattttctgttacttatagcagaatacctgaaactgggtaatttataaagaaaaggaatgtatttcatacatctgtggaggctgagaagtccaaggccaaggggctgcatctggtgagggacttcttcctggtgagcactctctgcagagtcctgaggtggctcagggcatcatgtggcaagggggctgggtgtgctaactcgggtctctcttcctcttcttagaagccagtcccactcgtgtgataacccattaatctattaagccataagtggattaatccattcctgaggacctgagccctcacgacccaatcatctcttaaaggccccacctctcaatactgccatgcagaggattatgtttcaacctgagtgtttggaggggatgttcaacccataggaagtggcagtgtggaagaagtgctgctgaggagtgagtcactgggggccattttgagaaaacagaaaggagaagccagagttggggagatgaaagcctcatggcttggtttgtcttaaactgccccacagaaggcgaaaggaatgcttgaggctggaccacgtgggtctagcgtgtactgcgtttctggtccccagcccctgttttaccttttgctcctcctgccccatcaaccaagtgtcttcatttgtttctatggcaattaacttttggagatagaagtcccagcacacgagatccccaagcacattatctaccttgctgaacaggctggcagtcacacatgagccaggcgacccagggaaatgccagcccaaacaaagctgctgccacatccagagagggccggactctttctcccttgtagtcactcaagctaatcatccaaaacctgcatcctccatctccaagccccatcttattagcaccatctgggattgccaaccaagaaactgttttatctgagaactctaagaccaaagaacaagatttatttcctctactacagatttggcagtgacgcataaaaggcccatttctcaggaagaatacatgtcctaaggatgtaaaaaagaaaaaaatattagatctagttaccatggtctataaactggtcttttcccgccccaccctgatcctggcttctgtccaccctcaaatagctgtttgttcataaaccctaaatactagataattctaagttggaaggagacctctaagtcactgtagcatttccaaatcgccattcccaagagacatgtggatctgacatcgtgttttattcttgactgagcctcgcatatttgttctgtgtggaacaaaggcaaaggcagcccaagaacccgggtccttgcctacagtcagctttaggaaatgattgtgaacttgggaagcatttaaatagcaatactagacagtaaatggaaaaggccaaagtcagaaaataagtagggattccaaaggaagcctttattggttgggctaggctgggctagctgtggaagatagacttctatgtccctgccccaaccacaattttactttaattattatgtaattagtgaatcgatgtctgtcaccgtctgtagatgctgaggtcttgttcatctctttatttgcattgatatacatagccattgctcaataaatatgtgacccatgaatgaaagtttgaacttaagccttaaaaaatgggatctatttggatggccaatttgcctaggcggacggtgcgattccagttccacatttattaagcccctgctctgtgccaaacactatgctcacactgtcagggtctatctttaattcttacagttgtctggtaggatgaattttaccaaacccattttacaggtgagattcaaggataataggtaacttttctaagatcccacggtttctatggggcagaacctggatccaataccctttctgtgataagatgctaagttgtaaaacccggcttgttatttgttccaggcaggaagaagactgtgtgcccttatttaactccctttttacctccttgaagcaggggaggtaatcctgaaaagggtagctagataggctgacaggccacagacagtgtgttcccagcaaccccgccattaggagtgggtgtgggctgcactccctgacccgtctgccttgcctcaccagcattcacatcaagtggacgtgtgtgctggctgccctgtatgcttgcaccctctcctttctcataaaagggcagcatagaacaattaccagagccaagcatcaggcaggaagcctgacttctgctcccctggtaaagggcaatgatttttgcaagaagtggtccaggcattcaacttgagaataaaggtgtggggaagaaattgtaggactcagcctgacaccccaaaaccgaacagagattaacgggagaaaaacgaagggcaaaaagagacatgaacatacgggaactgtatcggtaacacctgcctgtttatcatcttaatcgtgttcgttgtgtttgtcgttactgtcagcaagtccgtgggcattgcctgaaccaaggacaggactaagcaagtatctgatttaaagcttacaactgccccaagatgtgaagtggctgtgcctccccaggctgctgggcctcagaactgggattcagttgaacgtctgcctaaaatcaagtctatgttctttcccatttcccaaagcttattcctgggagagctaccagatattctggaccataaaaggatcatgtggctggctcaggagacgttagagtgaacatgaaactacgtgagtttctttacagcagaacttctcagagcctttagtaggcctatgctgtggtccttacactgaaatcacctggaaggcttgttcaactccagaaggctgggtccccttccagagcttatcagtaggtgtggggtggagccttagcatgtgcattgctaacaagtcctcgggtgatgctggtctggggctacactttgaggaccgctgctaacagtgttaaaaagtgccttacatgtgagctcaacagaaatgatatcaccaatttggcctatagtgagagtctagatggtaacatgggcattttccagatgtatttggcctgctggctctatgtatgtatgtattttgagatggagtctcactctgtcgcccgggctggagtgcagtggcacagtctcggctcactgcaagctccgcctccgaggttcacgccattctcctgcctcagccttccgagtagctgggactacaggcacctgccaccatgcccggctaattttttgtatttttagtagagatggggtttcatcgtgttagccaggatggtctcgatctcctgacctcgtgatccacccgcctcagcctcccaaggttatgtatgtatttatttatgtgggatagggggtggattaccccaagcgagcccacctttgagaatactgcataaccctccctgttcctggagagctctggaagcacaggtgcagaatctaccacactatgctctgtaacctaccttgacggcccccatccctgatgacactaagtctctgcaatctgaggccagggccccactttcccctacacccaccccccgacacacacaccagctgtgagctccctcggctccctcccaccttgtccacctgctgggggacgtccttcctctgagtccttgggaggtggcctattggagcaatggcagggtcagcctgccaagttctcccacccagccccccacctaaccatcctcattggaaaaaaatgtccacaccagagaagcgttattgcaaaaatgcctgtatggaattcctactaaggggccatgttctgagtgagcccagataacagtggtggccaggttgcaggacacactgctgtctgagcccagcccacctgcatggccggggctgtcagttacacagatctgaacacagtgagcagaatctgaccccacccccagcttcccaaccccaggccagcagacgggccctactgacgagacggggccacctaaaattagccttggcacctcggtccacttcagaaatgaaccaaaagctgtggctgtccatgcctacctcagggcagtcctctgaaagtgttattattacactgaggttaggagaggcaggatatcatgggaaggtcctccggccaccaagttgtcagagttgccctcttcatggggcaataccaagcctgaaaaatcccagtgccagatgctactgcacccactgtcacccctgaagaagcgagcccttttccatcagtgaggccaatacaattcaaaaatatttagtctccctcttttcctcacatgtcccattgtgcggggatggagggtaggaaagaagacaagttgagaatcaagggaagaaaggggaaactgtgaggctgcagcaggcactgtgtaaggtctcaatctctttatttttatttttttagatacacggctctcactctctcacccaggctggagtgccgtggcaggatcatagctcactgcagccacaaactcccgggttcaaaccatcctcccgcctcaacctcccaagtaataaacctctttaactcttggtaacaaccagtgagagaggttggggttgtgatacccatttcgcagatgaggaccctggggcgcagtgaggttaccccacgtgctgatgagagcggggcttcggttcaatccccagtccttctgcttcaccggcagagtgaagtctgaagccgtgttggggtggggcctcggcagggtgggtccgaccatgccaggggatatatatgtgagtgtttaggttctccagggtgggcagccgtgtatggggtagcttgcagctcagcccactgagcatttgggagcctcttatctgcgtactgagaacaatgaaaggattcccatgtccacccccagttccacccactgtgggttcttgtgggccttttgagtatcagagatctccgtggccagggagctgccgactccagcaacctggacccattcacaccaggctggtgggagcccctcgcgcactctccaagccctgcgctccccacctggatggaactgatgggcccctgagctgggtgggcaatgatcttcatgttctgactcttagcagctccaccaagccattgccttgcgtttagagagctcgctgaatattttctcagaaattaaatacacagatttcccgggtatggtcattttgcccaggaatttccgcctttctccacaccccgaacttgtaactgaagaaaggggaaagaaagccagagcatagcctttaatgtgatctctactctttagcatttaccattcctgccgggcgcctccccgtcttgccccttccccaaccactccttcctcaggccaagtgactgccccaaaagagcaaacttaagaggaggacagcccattgagagaagtgaagatgttccccacagtcataaaaacgcgtgaatatggtccgaaatcatcctccaggatcctgggagcacagtctgacccctctgccccatttccccacaagaatgctgagagggggacgggaggcctccgtcccctccctcccccccgccaaaggtctgcttttcagatggaaacttacagcagctggcggctcagcccaactccagccccaatagaaggacatatttgtgggcaagggacttccaagtctttgtctaagcagatgtttggcttgtgggctcggcaggcaggctggctggctttcctgccagccccacttgggaatttgaaactgccactcctccccacttagtgagccccatctgagctggaggacaggagggtaagaggcccagagacaagcctggggtcattcacccagaggaatccctgctccccacagtcccgccacccctggctcaggcaccatgggcaggagcctgggggcagccgcaaaatcactatggttaccagcttctcggcatctgcctgcctcttgctttgcagtggagatactttagtgactttcagggagatctttttttttgttccaaagaaacttccctttctcccactttttatactatactataaatacttttccatgttgccacatggccttcaacgagcttttttttttttttttttttttttgagtgggctgcatattattccattgattaaaacagggattggtaaactttttctgtacagggcatatagtgaatattgaaggtttttcaggccacatggtctctgtcacgactaattaacacagctcttgaagcactaaagccgccataggcaatatctaaacagatgaccctggctgtgttccaatcaaactgtatttacataaacaggcggtgggctagatttggcccacagatggatgcagtttgctgacccctgaactggaagaatcataaagaatagttttagctttttattaatctctttggttttactcaattttgttttgctaatatgagctaaatgatgacgatgatgatgatgctgtcatctcccattcattgactacctaggttatgccaggcactgtgccagatattttgcatgttattttacttaatcctaagaattatcctacaaagtatatcatcctcctttttacaaacaagggaattaaaagacactcttagcaaagttaaacagtgttttcaaacttcaggtcacaatccgtcagtgggtaatacatcaatttagtggactacaaccagaattttttttaactgaaaagggaagagtgtttcaggagtagtaaatatttttccaggaagcttttttttttcaggagtgtgtgtgtgtatgtgtgtgtgtgttggatcaggacgtgtaatgtatttgctactgtggattacagacaaaaacaaaaatttcaaaaaacaaagctgaggaaattgtctagtcacctagatggtgagtagttaatccagaactaggatccagacctgcctcactccaaacctgacacagactctaattaacaggtgttcccatctctggagcacccacgcagttctaagccccgggcaaagccgttgcaattggaatgaacacatctgagactccgtccctgctcagctgtggaccaagcagcatccttttgcaaggagccagtccttgggcccatgcttgtcagagctggatttgagaacaacccacactgatgttctcttacacgtgtagcatttatgaagcctttccatctccctcacttcatcacataaccagggagggagattcagttagaaatgtttaatattttgccttgcttggcagagagccccataatggataatctgccccaagaagaaatgtaaggtgaaggggtcagttaacagtagtgaccaccaacaccaggctaaggcatttcgtatgagccagggcctgccacgatgtgctacagatgagaaaactgaggttcagagggttggatgatttttccaagagcttcaccagtgatgaagccatggcatgaaccatgttccaaagcacatgacccaaaccgttgcctacccaccctgcccattctgcaccatagggagccttgggaagactatacagtgtggggaaacagaactcaagagagctaaagatgccagaaatgatgttagactacagaagaaagaaacacacacataaaaacctctgggatacatgaggctgcaaagcaaagatggtaaatagtcaccataagaggaaatggagagatgctgtttataaacaaattgttgagtatttgtgttggaaagaacccagtgcctgaattcaaggcccttgtgttaatatttactgtattgtagtagtgagatttccacgaggcactctgggtttagactggataggcctttggataagagccttttggaggaaaacaacacaattcagacagaacttctggcaaacccgagacagagattattgctgatttagagccttctcatatctgctgatccctctctgaaggccaacacagttcagtccttcgagacagttcttcagctgagtaacccttggccattgtcccgagtctgctgttgcctaaaacactttgtgtcttggttactcctatttcagaaaccttaataattctgcatgtacacatttgatgtttctgtcacctagggctgcatatcaaagcatcccaaggcatatggctgaaaccaacatgtattttgctcacaaatcaccattttggcagggttcagtgaggacagcttgtctctgtccattcggtgtcacttggaggagcttgcaggccagagactggaatcacctgaagctcgttcactcatgtgcttgagctagaggctgggaagacacacacagcagggaccctccattgacctccttgacctccgaggtctctccacgtggttgccctcagatggaagcttcaggataccaagacttctttcctgtcagctgagggctcccaaggtgtgtgtactgagagagagagcccaggggaaaacactgcctttattactaccctgggagctgcatagcatcacttcatccatgttctgttctatagaattgagtcactaaggtgggaccatattcatggaaaaggaattaaattctatgttggttggaagggtatccaagaaatttgccaacatgacttaaacacccatggctgagggaaccccacaactctgcagggtcttagcttttgagcagctgaatctaaaatgttcctcagctttcttgaggcaggtgtttacaaattgcaaaggccccaatattcaaaatctttcatttcaattaagaatctcatgccattagaataaggaacaaggcaacactttactggcacaggaagaaacttcccatttgttctatttctgaaaggtttgtttcacacatcctctacccaggtgggaaatagtctgcaaacaaggtcacatgacaaatgttggaaacgttctcacgagcaagctccaatcttagatatttgggaacatgaacaagaaacaactgatatgctaattataaagcattcttctccatgccttttaccatagtcccaaagaacttccatttgaccatactagctccttaataggggaagtaacctgagaatggcctcattggtctttcttaaaaaatagtgttgagtttaaacatcccaggaattcaaatgagcctttgttgtaactgaactgaattggtgatatcagttttgctgagcttatgtataaagttatttttaaacagtctataacagcggttctcaaagtgtggccccaaccacaccagcatcccctaggaacttgcaaattcttgtgccccaccccagatctactgtatcagacactgtggggaggtggtggcggtgggggagcagagatatgttttaaccagccctctaggggatactgaggcaggctcaaccctgagaaccactgtctccaggggcaggatcagatatggggaggagcaggccctccaagcaggggatgagtggagctgagtctggagcagtggcaaatgatgaaaaactcacacgactcgattctctggccttgcacaaatggagagaactgataggggaaaaaatagagctcatcagtggcaggaatgacttcctgctagtctacatgcccttggtatcatggaaggaaatccaggcctccaaacctgccttcaacatatctttgtcattttaggaaagtggtttaatccctctgggctttacatttctagcctgcaaggtgggcagagttaaggaatacacgagattttagcaaatcattattgagcccttataaagtccaaaaattccattatgtcatttaactcacaccacaatcctatgaggttgctatcattactatcgccattcaacaggtgaaaaaacagaggcacaggtaagttagttcatttgcccaaggtcacacagctatgaacccaggcagtctgacttggtatctcccctctcagccacctgttgcaatttagaaattgcaaacctcgctacaaagaattgtgggagagactaagtttgtgctgagaaagggccaggatgatgagacccaagtaggctggcattctgactctcggctgctagcttgtctctcgtggctgagggaccaccagacgatagatccaggacaacctcaggtctctcatcctttgagatgactgagttaaggatacagaaaatggcttagaggcaagaagagcacatttcatcctgacacatgttgagagggctccttacctggacatcttgttttcatggagtgataatgatactgtttgcttaaaggggctggctactggtagaaaccagtccaagagccagggatgctagggagaacagtgagggaagaaatgctcctccaagaggggcttcacaaagtgctttccaacggatgagaaggttgcaaacaagctctgtgaacaagaattttccttccttccttcatactgctgcgagaatatctccctacagtgcaaattagaaccttgaactcctcatctcaagaaccagtaacgggttaggtgcagtggctcatgcctataatcccagcactttaggaggccaaggcgggaggatcctttgagctccggagttcaagaccagtctgcgtaacatagtgggaccccatctctacaaaaaatttaaatatttttaaaatgtcttaaaaagaaccagtcgtggctacccattgcctccagagtgaagtcccaacccataacctgggttcaaagccacccatgatcaccctaaactgccttttggacctgatatccccctccttccttcagtgtatcatcagggtgcctgccggtgctccccagaccaatccaggtgcatttctatccctctccctttccctactttcatgtcaattcacatttgtaaatgtggagtggggagccccattgatatatcatggtgttacccaatggggtgtagtttggtgaactgacacgaagtcccttttgtgtgggagggaaagagctggaaatttcattctgtagaaataagaagccagacagacaactcactttgtattcagacagccctggccaaagagtttacagttcccagctatgcaggagggagggtgaaaataagtagatgatgactggtcactgattttttgtctagaccccctgatgggctccaagccagctgagtctcaatcatgtgaagaggaacagggttttcatttgagcgaaaaactcacaccactcattcttgggggtgtaactgaaaccacaaatctagcatgttctaaggaacattatcaggcacagtcaggatccagttcaagatatatctagttgaccaaacacattccttatataggcagtcattcaagagctcctacgctcagaaactgctatcagtacatgacgttccttgttattcagtgttcttttcctaattttcaccattttaatgtttatttcctcttcaatatatgagtatattaagtatgtaatcaaagtatataagttaagaatagtaagtgtgcaaactcttatgtgcttccctgtcttcacatggcaaaaaagtaaatatttctattttggctgaaacatagttgatacttactaagtttaaattagcatctaaagccaggctcagcaaacactttctttggagggccaggtgataaatattttaggagatgtgagccaagagccaaaattgcaatatcatgtgggcactttatgtaacaagagagaaaacaactttccatgggttttttaaatgaaattcaaaagataataataattgagcacagagtttttttttttttttttccaatataggtctactaatgagaaaagcagaaggggttctttcttgggagaaaacatttcactgaattggagggcaaatgtaaaatccagtcttcattctcatggggcttgcgagaacagacagtggctgggtttggccatgggccgtagcttactgatgccggatctcaagtccacatgatggagtagaaagaactttggctttggagtcaggtttggcctttgttcaaatcctagctttgcctcccatcagctgtgcattactgagcaaatcactgaatctccctgaccttcagttttgtaatttctaagagagaagataatgattttccgaatagaaaaataactctagaaggagaaataactctctcgggcttatgtaaggggtaatagtaatgcgagcaaagtcctgagcacagtgctggatgcagacacgctgtagggacatgacagccattgtcgtttccatcatcatcggggcttacaggagcaggggataactccaaaatgactcaaaagattgtgtggattgagaatgtcaagttcccattctttagaggatgagaataggcaagttataaatgtgcgatggatggatacctgaatgaaccagtgaatgaatgagcatttagcaactttcactgctcctgggaactggcagaagacagaaatctagagctctcacagagaacttctcccaggcacactcaccctccccacaaagccccaatcctaactgaagctgaggaacaacatgagttgaggtccaccttgtcatggtttctgagcaggccagtgaaaatgttactggcagtaaaagacagataaaggagccccagatggaaagaggatgacaaacagccaggcactggctacattaactgctgagaggccctgtagggaagctgcttctcacctctagccattgggcatgctgctcctttgccatgccagaatgcattctcctgggagccctcctagcccttcagacaattccctgagtttagtctccccacccgacccagctcagttcccatagaaagccacagagccaagggcggcagtttgaatcccagctctgtttcttggctgtgccccccttcacaagctattttgtctccttgggcctcgctggtcttatctataaaatgagtgcatttcctgtgtacctacatctcctatccagaggattgctgtgagataaataggaatgtggttgatccctagagcccctcatccctcagagaggcctctcctgctaaggtggtccctgctatccacccccaaagtcactctccattcccttaccctgtgattgttttcctagtatttatcacactccatgattatctcatctgtttttttatatatttattttctgcctccacacacacaaagctccagtttccctgaaggctctggcattatctgcctgggtcactgctgtatccccagcatctagtccagggcctagcacacagtagatgctcagtaaacatggatgagcccctgaaaggcaagagtgttttgaaagctcccaagaactttccacaactgtctctggagcccagctctctgctgcacttagtctaaacctgtctctaaggtgcagacagatgcatcatctgctagtgtcttccacactcatctgttgtcccctaagtaggaagtatgaggtgggagggcagaggtttccaaatatttattgttcatctactatgtgcctggcaccgaggagatgtgaaagcaagcatagttggatgtggctcctgcttccatctagtgtagaaagaacaggtatcaaacaaccatacagagaaaggtaagcagagaagctttattatggacttaattgcccctggaaggaggtcagagaagatttcccagaaccaaagatctttaagtctcacatctgaagaatgaaagggagttaatcaggcaaacaggaacgggaacaatgtaccagacatcctgaacagcaacggcaaaggcctcatggcagggtggagcattccttcattcagcaactattgatggggaatttatgtgtgcggggcccagtagagggtcctgggtcagagctgcaaccaagcagcctctctctgccctctgcagctagccgcttagtggagagaacagatataaattagataattccataggtatttaaaaaataatgttagctaacatacatggagtccttttgggggatctgccaaaatcatgcatgggttccaaataacttatgtagatacttggccctggaggagatggagcactctttagacatggagggcttggtgacttccttccaaagaggatagtatggaagtggggagaagagtcactttacagtgaagaatctgacaaacactgcctccaccagaaggtcaaagtcaaccgcaacagtgacaagtgagggcgacagtatgtacccttgaaggatgtgataagaggagcagtttgccccgtgatcttcctcccaacgtactcatcatagtaacatcaggcaaatcccaactgagggacattctacaaaacacctgaccagtactcctcaaaactgtcatggtggccaaaaacaaagtctgagaaactgtcccagctaggaggagcctcaggagacatgacagttaagtgaatctgggatcctggaatagaaaaaggacattgggtaaagtttatgaacacgtgaataaagtttggactttagttaataatagcatatcaatattggttaattaattatgacaaatataccttattaatgtaagatgctaataactcaagaaactgagtgtggaatatatagaaattctctgtgctgtttttgcaatttttctgtaactctagaactactcaaatattattattattattatttgagacaaggtctcactctgtcacctaggctggaatgcagtggcacgatcatagctcactgcagcctcaaactcaaactcctgggctccagcagtcctcccacctcagtcttctgagtagctaggactacagatgagcaccatcacaactggctaatttttcaatttttttgtagagatggggtcttgctatgttgcccaggctggtctcaaactcctggcctcaaatgatcctcctacctccagttcccaacgtgctagaattaaaggcataaggcaccacttctaggcaaaaatattatttattaaatattatttaaaactcttcatgcacgggtaaaaagatccattcaaagtgcaaggtaaacaaacaggttttaatgtaaacaaatatgaaaggttcactgatgtgctttcagatttcacactgcaactaacttgagaaagtatcctgtgtcaaattttactgtagtatcaaagaagaatatccacagttgcctggaaggtcctttaaaatgcatcgtcctcctttttccaactttatgtcagtgtgagttcagattttcttcatgtatttcaaccaaaacaacagcatgcaaaagatgggctgcagaagcagttatgggaatccagcaatcttctgcaagtcattgaagagatttgcagatatataaaacaatgtcttaaaattttcttctactttttttgttttgaaacatatagttattttagtaacaagataggtatgttaatgtattacaggtttagtattgtcatttttaaatgaattaaaaaaatttaaattgttctcagttttaatttctcttatggtaaatatcaatagctattacccacatgaacaaaaactctgtaggggtcttgataatttttaagagtataaagggtactgagaccaaacaatttgggaatcactgtgctaaataaataactttatttagtcctcgtgaatagcctgttaggtaggcaatattattgtgtcgctttgcagatgacaaaactgaggcacgaagaggtatagtgacttgcccaaggtcacccaggaagtagaaaggctggagctggaattcgaacccatgtcactgtgctctcctgacttccttgtctcctatggtccttccccatccttccaggtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgaggtgggagatagccgcgagatgggttagggggcttgagggacactgctgagggtaaaagcccagaggccaagaggagcatggctttgtggatgatgtgttctacagattgggaaactgaagtcaggcctcactgcatgctctcaaccttcattttctcatctgcaaaatgaggcagacaaccatgggattgttgggaggggtcagacacagtgccggtgaatcttgtccttggcataatgcctagcacttagtaagtactcagaacatagcaggatgaaccaggaggcattgcccacgttcaaacctgtatctgcatctcttattattattatcatgtggttacctaactccggagcctcagctgagtctcagttttactacttataaaatagggatgagaccagcgcccatcccatagagtggctatgaggatagatgagataatgcatgaaaatgcttgccacagggcctgacctaggaacttataaatggtagctgctgttagtcttacgataatatactataatatgagacttaacattaatatgacacaatacaatacaatatgatagagatgctatgaaagagattcaagtctctgatactggtttgatgaaagtaactctaaggtgtattaataatggcaatactaattatgatcatagtatgtactatttgcatgcctttggttgcaggcaatatactaacttcatctttggcatgtatgaaggttagaaatgtcttctttatattgaaccaacatctattttctaccaccttctacgaattggtcaccatatgaagttaagaccctgtagtcctcttacctaataactctgttattaagtgatattaagaaggaaaaggactgtcacaggcctgccctggagcctcatttttgaagtgacaacagtatatgcacaataacaattctctatcatttattaagggcttacggtgggtcagtaatttgctacatactttacgtacaacatgctatttatatcacaacaatcctttagggagagataagcatgattttttctcatttcacgtttaagaaaagtgcagctctgaaaggtcaatgctaattagatagccctgactttgtgtcagtcaacattctaagcctttcatatgtagttggtcatttggcaatcatagaaccttgtgggatggaaagtatttatatccccattttacagatgtggaagctgaggcacagggggattaagtaatttgcccaaagtcacaaagctggtagatgtcttaagtgaaaactcatacccagttcttgtttgactccaatactagaaggcccattaaacattatgctcctctgcacttcctgagcctcaggggatccttacaatatgtctattccaagtgtcacttcattccaagcccaagtgaccctctgtattcttgctcttgatgattggccattggcagtttatctatccttaagctttcttcaccagggtgtgtaatcccaccttggaactaaactttagatttgacccaaagagtatcacagatacctagataagtaaaacctgcctgtagtggaggattttttttattccatctgagaagctaagatgcaaccacaaccttcaccaaatattatccttactgcctcaaatttatgccagatttttccactaaggctttaaaaggtcaaaacaagaataggatgggatgaaccaccaccctataacttgtcctagatataccgtctctacctagggacagaaactgagtcatgcatttctcctgctcccctccccagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccacatacacccttatctaattatttacaccatggcagtgattttgcaacacccagtgctggcagaaaatatagtaaaatactaatgagcctctctatcaatgtatctcatcagacttccactgggagtgtaggctttgggacagaacccccgccccacctgcctattccagatactcccagatcactaatgtaacaaaggtatcatgttttatggtacactgaaaagtggcctgctgggaactgatgagcttctctttagccagggacctgactcagctgccctcagagcccaggaaaatagcgaatgaacccctctgggaataagaccagtactgggaaaccactgaacaggggccacctaagctccaccaatgggtgccacatgggatgtggtgactaatgtgggcagatctttaaaaatacagcactttttcaaatgccaaaacaatcagaaacaaaattttttcaataaaaattaatctaaaatttaacaatgccacttttatgagaaatctcaatttttaatgttgccaactaaacattgaatgagtcacgtagaataggtctttgggccaaattgtatctccattttatggtctctctgaacattttcagctcttaaattaatttctttcccacagtttctaagaaaaacatatttttctactgggagtataaggatgaaaaagacacaagtcctaggagcttacggtctggtcgccagtggttttctttcttgaacttcctcatctgctgccagttttctttaacctcaccatccaaatttcactctgaccatctcgtacctagaaaacccccattcatgtgctttataagtttcaccaaagccattgctatatcctcccaaggcagtggttttctgctcccagctcctttctctagtcaccctcagtttcctcgtcatgttcatcttctcaaagataagtttcaagtgtgtcatttccttcactcaatctccatggctcttcattgcctgccaagttaacaaccaagtcctcatggacatttgaatccttccaaaacttggcttatgtctttctggccttggagccctttatttccctagatttctagttccctatttcttcctaagcatgcagaagctccctctgatcaagcccttccctttgcttttgctagttgaagactggctacctgaagaccaactctggctgttgaaattctattcatcctataaggtgcttctcaagcataacctgcttctctggcactttcctgaagcaccagtgaaatattcaccaattcatcattcattcatccattccacaagtatttcagtgagcacggcaaagttccaattcccatgctgaatataggggatgcggggtgcacaaaaagaacagtgacccctacgcccatagatgttacggtctgtgggggagatgggcctcaagcaaatattctcacaagtcaatgcaaaattacactactgtgcatgctataaaaggaagatttgtgttactataatgcatgtaaactggacttaggaatatcgagagaggtgcccctgggaaagtgatgcttgaactgggctgtaaaggatgagtagccttgccaggcatagtggctcaggcctgtattctcagcactttgggaggccaaagcgggtggatcacttgagcctaggagttcgagaccggcctgggcaacatggcaaaactccacccctacaaaaaatacaaaaactatctggcatggtggcacacctgtagtatcagttactctagaggataacctgagcccagtaagtcaaggctgcagtgagctgtgatcatgccacagcactccagcctgggtgacagagtgagaccctgtttccaaaaaaaaaaaaaaaggataggttgcctctaagttggcaaagagaggaaggacaatggttaaagatggatacatgaatgcatgtgcaaaggccctgtggtggaagccccaccagtttattcaacacctatttgctggtg

SEQ ID NO: 12749 - DNA, 23305 bp, Human
gaaccttgcttgttttctttccaaagtatctttcctacttgcttcactgcagtatcccatttgttctttataacattctctcggttttggcttctggggactccttggtgacaatggagaacagagactccatatcacattttgaggtatatgctgacttagccactctttccacaaatacttcttaaacagtgtctacgggaagtaattttttttttaaccaaccgaacttttaaaaagccacctggaagttggggacagcatgacaccccttcttataatatgtaataattaatgtaaagcacttggaggtccttgttgctgagacacactctgacaaatgtgcaaactatcactatcctttgtgccttgttgaggacctgtcaaaaaattcatctctaataagggatcgccataaagtggaggggtttatttaccagttcactccttcactttagttcactcatctgagtatactttggtttattctcaaggatgcatgtataaatgaccctattctccacggttagcaaaccaaaacctctctaaattgggagaaagaacttgaatgtcgtgtgaaagaaaggaaaaaagagggcttgaaaaggcaaaaagcagtgaaaagcagtagttaaactgtaacccctatctctactcaccagaccacatcccaaccgaatccagctgcacccaccccgtagacctttggggctcctgattgagagtgcagatacagggcacatactcatgcgtggctcccttcactactgggtgtcagtctggcctgtgctcaaggtgtggcatctggttggagtttcaatatgtaggatccactaccagggttttcgtgagattaagaagggtaaggtaacctactggcaaaaggggctggtatgccccaggggttggtttggcacagcaggattaaaacgaagtcaaccaaggctacagtctggtgttctttagtcattcacctcaccctccaggaggccaccgaatggctttatctggacagggacagatccagggacacaactgggataaccggtattcctggtaagcctgtcactggggcatttggaggttaggtggggaagggacgcgcgcgtgggggcggggtgagagggtacagagggagaaggaatgatggtgaagggtttgctggggctgcagcatcctcattctgtctccaggacggatttggaggccccagtttggggatacgggtaggtctgtaactcgctgcgggacttcacctttgcaagcctccgtttgctcctctcaagagggatggactctgatctttgcgcccccttcctgccctttgattctggttctttgagggaagccctgctatgcagtccggggaaggaaaggcattctctgctgcaggcgggccggaatgggacggccaggaaagcggcctctgtggcatgaattatatttatttagatacctgtattaaaaattattttcgttaaaaaaggaatccccacccaccaagctcgcgctggagctttgcactgcgaccgtccggcggccgccctttccctgaactgcggggtagccggtgcgcagcgctttcttccagcacctgacgcttagtttcgcgcagaatctccctacgccgccccgccggctccacgcgccttcctccttttcccagccccacggccgccccccgaggttgccctcgcggcttcccggagagcaggaaaacccggggagtggaacgcgtcgaggcgaaggtccccgcaagccgcgcagggtgtctgcggccggttggacgcttgcgcccggggtgggcgactcctccgggcaagggcgcggggacggcccggcgcgcaaggttgacgggagctcgtctcgcgccgcggggacgcccgggcggccctgaaggggacggggcggccccagtcggaggtcgcagggagctccgcccccgactcggtataagagctgggcccggcccacggcggcggcggcggcggcggcgagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcgtagtgtcatgaccagggcgggagatcacaaccgccagagaggatgctgtggtgagtgtcgttgaccgaaagcatatggtggaaacccaggtggggctttggagacaagcaactctacacgagttctggaggaatgtggctctgctgtgaaccatagctttgtaaaaagatcctttgactcatatttggtggacgttaaggaagaaaggaaattcagggtgtgggaaaaggggtttgcacacaggcacggatggagtagattgggcagtttggattgccttgtgtaaaaaagaaacaaaacaaacaaaccaaccaacccaaaaaagaatgctgaaacaagagtttcttcactgtatgtgaaatgtgaagttgggcagttattgactaggtcaataactgaatttagtgaatggtattaagtgaacgaaatacatcggttcataggtaacttgataaaatgtacgtggtttgtcctgcaaagtagtttttaataatcatgttctaatgagatcaaatggataagcattctgccctcagctcattaagtgactaccatcgctttttctcaccccgcctgtgtctttgcaggatccttggccgactacctgacctctgcaaaattccttctctaccttggtcattctctctctacttgggtaagtgagaatgcatagtcttacaacacagttgcgcaattttttatttcctttcgttctagccagttgtattaagccaacttccagttttgtcaagcagttaaagaaataaatcatccaagtacacatgctttaatgaaaacgttatttacatcgaagatctttccccatgagtgttagttaatgcaacttaattatcagatcatcgtagtttatgtagatagacaactatccagacaagattatcaaggaaaggaatatttgccttgtttttaaattttatgttgcattagtagctttggtaaatagacatatctgctacaaaagatggatggatgtctcatataccttctcttcttcacattttaaaatattttgttttctttttttgttaaaatttagttccagcgtgcagcaccatgagaatacaatagaatggtagagtgactgacttaagctaataataacattctaagattaattgaaacataaatgacccccagaacaaatatctgagtgacaaaaattctggtctttaaaaatgttatctatagttagataaagtttggggcagtggaggctatcttaaaattaatcatccaatgaatatcagcaatggatttacagttttccctctgactttctaggttgtcctggaaaagacctagtgtttctgtagatctgggctcctaaaactctctccgaaaaataataaactagaagggtgctagatatatgttcagtgatgattagaatctttaacattaaacaattattgtttaaaagcaataaatctggctatattctgtccatggctcatatgtatttaaaaagaatggaaagaattttgagagtaaattttttgaatgttattttccttttaaattggaaacttatattggatcatccttaagacatggatggaaaccactggaagaggaaatctatacccaatgcctttgagaaattgttaagctacattattggttctctaagaaatagcagtttatagatgacattttagaaaagcaagctcctatcttaccagaggcttacacaggggtgactctgcaaatacatgtaaacaaagtggaattggtgtgagtttgttttaattccaacagctgatgatgctaagtagaaacctagtgaaacaacccttaataaataaaaagcaatagtttgttcccccagtttaattcagtaaatattaagtattaataacatgtgatggaaatagtatctgaaattctcagcctgtggtctggccttgctcttagaggaagaagatgcctctcttccaagttctgattatggtttatgtgacctttggttaataggttaggaggtcagatttgccagaaaaccagtggcaccgtggttgttccaggaggatattttgtcatgttcattaaaagtcccacaagaaaggtgacacatgcttatcccaactttacagtaagtcaagcaaaggaagttctcatgagaaagttggattaaacaaacagcagcaactacaatcatataaggtttagtggatttttactcctttccgctgcaaaggagtgcaaaagaggaatgtctctaacactaggtaattatgctttttatgttttttctcttgtgtggcactctgcctgattttgttacaacaaaacatttatgtttctgtattatgtgtgtgtgtatatgtattatatatatatgcattttccgtcccaccctgccaagtcatgatttcttatgcactgaacgtaggggcattagagtagaaggttgcctcaggttagttttgtgtggggttgaatgccttttatttctgacttcatttctatctgccaatggatcaatgcattttactctatattatcaaaatacaatatagtgtaagaagtggatcctggctaggtgcagtggctcatgcctgtaatcctagcactttgggaggcaggaggattccttgagcccaggagtctgagaccagcctgggcaacatagggagactctgtctctgcaaaaaaaaatttaaaaattagccaggtgtcatgagacacacctgtagtcccagctactgagaggctgaggtggaagagttgcttgaacccaggagtttgaagctgcagtgagctgtgatcacaccactacactccagcctggacaacagaataagaccctgtctcaaaaaaaaaaaaaaaaaagtggatactattgtcaaggagcttataatacaatttagtatgggctttaaaaaagatatctaataacaaaaagatgacagtgtaagacagtgaaaaagaggggccagttgcttatatctgataacatgatcttacaaactctctccatttaaaccccaatatgtctgcatttctccagccctcgtttcccagaggctcactttgctcatggaggcctttgttgccaccagctccatcctactttatatttcctcatagcagcacgtgccctgtgctagatttgcttttggtctgtgctcactggaatgtgagctgcatgaaaaccttttgtgcgctgctgaagctctagtgcttgcaaatgtcgggtacatagtagccacttagtaagtattaagtggattgaggaccatgatcattcattgacagttattaggtttgccttcagctctcagtcccgtgggggtacatggacacataaataggtcatccaagtttagtgagaattggtgggaaggcaagaaatggaaataaggaaggatgggcacttggtcaatatttacatagactttacccaaatattgggctttttgtaaacatagaatctgttgcttcttaaagcctaagcccgttggaaattggggtaatgtgagcaatttctttctttccatcaaagaggtggtatggcatgcaagaaaaagcaagattcaaaactttaatagcatttgtcttgatgtcttgctttagaggactctaagacaattaaaaaatacaataagagtaagaaaaaaagaaagaaacaacagtattagaaaagtgtttcttaacctgtatgttaagaaagagaaaactcgctgacagaggcaacctatcatttgggacatgtgtgtatttttgtcttttccttgggagctattcagaggaatggagattagaataaagtatctcccctctccctatcccattttatcctaatcaaatctaaatttgcttttcaggttaaagattaagtaacagctccacccccctgctgttgtgacaactcaaaattactccagacattgccaaatgatccccggggaggtggggtgggggtaggagaagcaaagtcatctctagttgagaactactggtctacaggaagtttttttgtaaatgattgctaacatgcatcaatttaagttttgaatgtataaaattattatcttggcttcattaaatttttaaaattatttgacataccaggatagtatttgcttctaatacatggattttttcgtgaagatgttaacagactttgggaagaactaggagtagaagtatttctgtagggtcaaatctatgaggcctggaatttggtttcctatagggattcccagagataagttatgatggaacatggttgtcctccttaatgttaatttcagaagtcagggatggagcctaaaatctcataataaggtccactgtagattttttaagacattaatttgcctaattcacttaaaagtttctgttaaatcacatttcacggtaatgaactccaaaattccctatattctccggagtttgtgtgaagaaataagtagctttttccccctttcaaaactcatctgtattaaaatgttaacgtaactacttacttaggcatttaagtttatttctgacatcactgtttatgcagtgccagaatttgctgttactactcctctttccaatcgctctgctgttttatgactttcgaattatgactttatgaaatctcataggttttaggatattagacatgaaagaaaacttggagatcatatggtccattcccatcattttacaaattggaaaactggctttttcttgatgctcaaggtatactaatgtttgtgaactgtactgtaattgatttctggttcaatagcaaactactttatgcctctgcaatcaagataggcaaattccaggccccaggagaaacctgacacacaggagaacacgtttttgtctcaaaaagccatcttgggtctggaaactgcattttgtttctagaatgaaaaagagaatgtgcggttcattaatatcatgccttttcaagtttacttaataattgggcaagaatattttccattgtgctgggatgaacgttttaacatctgagcagtattcaatctaagagtaattactgactttgaaagtctcataatgtagccaggaagtgcccttttgataaggaagcaacttcctgagtacaatagactagaaacgaaaaatattccatcaaaacattttctcttttcatttaagggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaaggtgagtgttgttatataattaagcccttttattcatgggaccaatgcctgagctacctctgtagcaaaggaaacaacaaactaggagagaaacaaccagggaatgtctgcatgccacacttgagggaggagggcttagatggcaccacctctggatggagggtcccatggctcccacacaaagttgggatgcctggacattgacctaatagatttttttgtatctttggctgttcataaatttcatatgttaatgattaaccttgtagcacttctctgagaaccatgttaaacattaaaagtttgcttaactcaggcttcctaactgtatcttgtactggagtccctttagtgtgatgttcctgagacagctttaacatctgttctttggttactatgtttcatgtaagagtatgtataagggaattgaaaactaagaatagcttcaaggcagaatagttgagcctggatcacaaagagctgaattataaattttgtagggaaaaagaagaaataataatatcttgatatttattctaagcattagtactgaaatcatgtcattttatacaggaaagaaagtaattgatcaattaaattttccagtatataagggaaatatggatgatcattcagggtaaattttcttgaattgctcagttgataatgccaagacctgaccatgcctgacttagatgttggcaaaagactgaggtttcattctttcagtgcgagatgactgcttctggacacagagcaacaggcttatcaaattctaggacttgatgctactaggaaaatggtcaaggtgaacatatttctgtttttagaatgagtagaccagaacacatatagagaaaagttctgtaatctagaaaaaaatttacttctttgcatcattatacataggaacataggaatattatacatagaaacttttaatctaatgattgttgagcactgcaatcatagattaggaaagaatattgaattggatgaagaaaagtgtggtaggataacaatttcccacttatcctatataatcaactcatacattactctttatgaaaaatgtttcctgatacctctgggctgaatttaccatttcttcctctgtgttcccatgaggctttgttaccacctctgctcttacacagatataatgatctgttcacatatcttttcttcttctggtctgtagggtcccaaaagctaagaaccttatttagttgacatctgatccttatccagtgaatgaatgcatgagtgaatgaatgaatatgttgggattttatatcagactgctttcagtaagcagcttattttttcttgcaagaccttccaagcaaggatgaactatattatccttgaagacaagagctgtaattatcccttacatatagaacttcatgttttccaaactgctttcgtaagtgttttatttgagcatcattatgaccctataaagtaaggaagacaggtattaccattctcaccttctagacgcaggcgtaagagatgttaggtatcctgccctagatcatctgcctactgagtggcagagaaaaggctaccaggtgtctttatctgtccttactccagtgctttatctatatgggcgcctcataagagaattgccatctgtgatggaaggggtagcttagaatttcgtagcaatggcaaatagcattagtatgcaaagaaatacactgctgctttattcttggcaaatttttgtgtgtcttttctatttaggtaaaccatattatcagattcagcctgccatgtaggaggttgtagatttcataacttcctctttaacctcatacatgttattgttttaccttaagcaacaaagagctgaaatgtggatcatgtctatatcatactacagctccatttatgttaaactttcaagaagataaactaaatgaaaatgtagtcattatgatagacttcagtgaacagagaaacttgtggtacttcatcattttgtttgcatatttactggtctggtgtgatcctctgggttgtattgagagtagttgaggcaggactgacttcagaaaggttttctttttatctggtaataattaggtctgtgtattaatgtattatagtagaacaattatgtgtggataagaacagtctcactgagacattttgatgtaatgtacactttctctcttcctctgcacagtggcccagacctcgctggtggtacagaatgtttcagtcatcctgtgtggaatcatcctgatgatggttttcttacataaacatgagcttctgaccatgtaccatggatgggttctcgtaagttctcaatgagattcttgatggcagaaaattgaatatctggtagtggtaaaggatgaaaatgctttgaagctatttttttttttggccagtgtgaccttttaatattgatttctgtgtctactgtaatatcccctatagtttgttttgttgttgttttgcccacaacaggcactcattaagtattgtttgaatttaaattttgtcctattggtttctaatggcatttctaagagtttactatagaattcagttgtttgttttcagctttttagtgacctatactttgtttgtgctatttaataaatgttatccatatctatattagtcagtcataattgcgttcctccaataataattgttacttctgtttgggaatgtcaaccagataacttttcatgttgtgatttcataagagcttgatggaaaagaggagagggatggggtgtggtataaaccatgcatctggtgtcatattgaatcttcttgtgtatatgtggattgatattatagagttgcaaagccaggtaggactttagaaatctttgagcctattcccttcattttattgaaaaaattaagacaaagtgaacgttagttgattgcccattgtcatgcaactagaaggtgtcagaactctgacttaaatacaggtgttttcaattccccttcaacattcttttcaaaggcaatatttgtgggagaaatgttcaaaaccaccactgtgttaacattttataactgtattcacctgactattataatttttgtattatgtgtactacagatgatctagatgatacaggttaggacattatgcccattgactactggtattcattcagtttcatatctataacgtaaaatgatttcttataaatgaaattaaaatactttttttatcattccaccaaagactattttaaactgccttgtttagtgacatatgtacagtgtggtaaactgacattataactcatttttttcttgtcattctttagacttcctgctatatcctgatcatcactattgcaaatattgcaaatttggccagtactgctactgcaatcacaatccaaagggattggattgttgttgttgcaggagaagacagaagcaaactagcaagtaatttggctttctcttttaatgaaatgagcatgttaggattcactttaaatcggtggtgataaatgaggctgtaagccttgtatttttgttctgggtattttttaagaatgataaattgaaagcatactttttttcttaccttattgtcagttttagtgctgatttatctcactgttacgaagttaacttataggatagctaacttctcttttatcctacacaaacttggcaaatggaataacttttctttcctctttttttttttaaaaaaaaaattcaatcaactttctaaatgtttatacttagaacagtgcaaatctgacatgagattttactggtcatacctatgaatgttattactggtgcttatcaatcatatggatgttatttttctctaaatcaaatggaaacaattgtaggagagactctagaagttaatttcttccatcttaaagttataatctataattttattacattatgtacaatgtaatataattgctgttacaaataccaaagaaatagaggacagaatatagtttttaagaagcttaccatcttagttgttcattgggaatataaacaagtggtcaaagaacatctgaagaatgcttacaaggcaacatgtcctattctgtcaatattacttaggctcagaataacctccctcactcattattgcctgccgtcccctcatatgacacacagacacaatttggattgacacaaattggaattacaattcccctgtgtaaggaggaagggtacacctccctacctgtcagatcagctgagtcaactctgctgatcactgagataatgggtataacaaacacattgcccaactgtcctgacagacaagtaaaccattcttgatgacttaaatggcatatcccaggatacagaaggcaagattatgtgctggggttagcaagcagctttgtttggaccatttggttaaaaaaaaagttagaaaggaggggtgagtgaaggagaacaaagtctgtggaaggtctagaagaagaatttgcctgaatcatcactttgtggttgcagtattattattgagttagaaattccacagtgattgatttaaaggatggtgtgtatgtaagatgaatttagcatgtgtgaatctgtatcacaggaaattctctctggagctaaaatcatgattctcatttacttttcttcctgtgatcatttataatgaggaataatttcatgtcttttttgtcacattgaactagatgataaggctttgtctttttttgtttactttctctttttaacaaactacttaaagcatgtaaaatatatccatgttttaaaattcaaagggtacaaaaggatatattttgacaatagatcacacatatatttgttggaatatacttagagaagaaagttgacttttacaatgattattctgtgatttgtgcagcagctatagataaaatgaaaataaaattattttctttcacttaactgattttaactaactcatttgactctgcaaagtctgaaatatgaaaaagaaagttagccagaatctttaacttgtcctaagatatatatatacacacacacatatatatacacatatatatatacacacatacatatatatagatgtgtatatatatacatacatatataggtgtgtatatatatatacatacatatataggtgtgtatatatatatacatacatatataggtgtatatatatatacatacatatatatacacacatcatataaatataactgcaaacatgccacataactctgggatttttctatgaagtgatgtccaagaataacaacaaaaatatgactggtcgtttctcagctgtctgtctttatattatgaattattgcagagtggaagaatctaggctattcagtctttttctaactttctgatgtttttcaagtaggaaaggaagtgagatgtttgttgaactcttgtccactctacattagcttttagtaagtggtgctctttcacatccagccagcagtgtgggctggtggactagtgaaggaaaactttctgcatgtttcaaaacaggaaacagaaacttctttagttctgaaggtcagaaagtatctaattgtggattttttgtgccatttctgctattgcagagttaaaggagaacagagaaaaaggaggaggataaaggaaaaatgggacaaagaagggggaaagtacatctagaagggactccacctgctgccttgggttcctatgaggttgtgtctcttatacacagacccacctactccaggcaggaaggatttgtgtttatgcaggctgatttttgaggttgtggcaaagaaacccaggtaggggcctaggccaggaaggcttcacctgtttgtgatatgtttagagggtgaaaggggaggggtatgcccatgaaaagtaaaagttttgagctggatgctgattgctcccatttcctcatcacagtgtttcttaattttagagattgttttaaaactagaagctgtatcactgagggtaaaagaaaaggaggaattttccctgccaaggttaaaaagttttagaatttcagtggcatcaggccaaaatacagcagtcattatccagtttggaaagttccagaaaaggtgttttatttttctcatgaatactgctaaccagttaactaatttaggtactttctaggtgcttgatttagtacagtgttttatgataacattctcttgtgccacgtttgaatcttacttccttttcccaggctttttaactccatctattgctttttttcctcctccatttcttttgaggatcactctttattagtatcttctgagatttttcttgcccatcatgctaaaaaataatctgccagttagcttgatcaagtatggcagataaattttgtgttcgtgtggtattgattaaaaatcgatttcatatatgaagtagacaaaactgctaggaaatttaaaagaatttttcttctatggatgtaatatacccattataatagaagtagttatttaatgtcatgttctgtgccacagctgtagctgagaacagttaaattggaatcaaatcaacacatatttgtgtgcttatgtaagactaaatataaattggtaaagagcgtatatttgcatattcataagactgattcttttctagcctgctaccagtaagatgattaagtcttttttttttttgagacggagtctcgctttgtcacccaggctggagtgcagtggcacagtctcaactcactgcaagctccgcctcctgggttcacgccattctcctgcctcagcctcctgagtagctgtgactacaggcgcccgccaccatgcccggctaatttttttgtatttttagtagagacagggtttcactgtgttagccaggatggtcttgatctcctgacctcgtgatccacccgcctcggcctcccaaagtgctgggattacaggcgtgggccactgcacccggcctaagtcttttttttttttttttaattatccattctgcatcagaaaaataaaagctgttttttaatacaacatttctactgacacctacatattattaactttctaagtataatataaaagatggaaattggtgacattgggaagctccgtgagctcttaaaaactgaagtagtgaaagggtaagaaataattttaactaaaataatttgttgttgtcattctgggactttaagattcaaatatatgttttctttagttacttgctttttggattccaattattgagttatttggataaattccacacttctctgttggcatatgagttggaaacttattagttagtgggaggcagatggtagtgaaacctctgcggtggcagtcaagtgtaagatcaatgaaggctgcctttgcctctcaagtgaaaggtgaaatatgtcaaagttctcctgttatcatatatgcaatatatactcatagggctaattggaaagcaattgaggaccaggaagaattacagaaggaataaaggcaatcttctgttaatgtacttcttcgtcacgtattgtttttctgttaaggtgacccaaatgattgcttaagacttgtctcactaattttcactctgttctgtgagacaggaagtgaaaaagtagatcactttcttcactttctttttgtcctaaaacttttggttttattttattttaattaattttttatactgacacataattgtgcttattatggagtacatagtgatgttgtgatgagatgagatggagatacatctccatcatctcaaacatgtatcatttctttgtgttggacatttttttaacttcctctttattgattttgtcctgcactctgactcaggaatacattcccgtagtcaaactctagactttgttatcaccactaaattctctcctcccataatctcagtcttaggcatccatattttgagaaatcaccttctgtctttccaccaacttcttcactaccacagcctcaacaatccatgtggttggcacctacaaaccattcattccactgccttttcactgtccatgatctctctcttgtctctttcttacccagcttaaaattcaaggccagtcatgattatatgatcatctcttggcatataccctcagctcagttggccccctctcgttttgtcacttttgtttggtaagactttggttaaatccaactttccacagtagagcatggctggaaaaaaatgcacgaacttgctcagcattctcacttgaggttcagggccacagagttggtcctttcatgcttccagataatcacactattttctctgattctttccttctccactttcctagaggaccattcacagttgtttctcctctctcatcacatgttcaagtcctcctcccccatcctcactttcgtcaatgacctggctttgtattttgctgagaaaatggaataaatgagaagaaagcttccatgtgattccaccatcatgtctctcttcctacctgtacctgaagccatatatgtggtctctactcttgttactattgatgaattgtgttcctgtctaagagcaactccttcagttatgcggtagattcagattacatcccttatctactgtatcattccaggcagcacataatcctgctctaattttgctcctcttaaaaatccctatctttagcacacttccttctctgctactctatttctttgttcttctttttgtcaaaacatatccaaaagacttgtctatttccaattccattttttgggcagtaccttgctttccataaggccatgggaagcattcacattgtgctccagggtatgactcactgaaaatacaaatggtgtcccctggggttggcaccagtctcttaaatcagctttattcaggcattgcccttatcgttctcctttttttgaggtctccagaatctctcttgtgaccaagctagtgtttcttttcagtgcttctcgttgctgtgatgctctttttttcagtgagtcctctgacctcgccttatttagaacattcccctgggcactctctgcccttttgcttcattacttttcaccatagtatttaataaacatctgacatatgcagtgtttgtgtgtgtatacacacacacacacacgcacacacacacacacatatgcttgttgatttattgtcttttctttcctgtgagaatataaactctgtgaagacagggaagaatgttacttttcttctttatagtgttaagaattgttgagaataatgactagcttataataggcatttaagatatatttgttgaaaaaaatgaatgtagagtcactgctgtattcattttaaaaagctattagactgatttatgcaattccaaggggattatcattgttgaggcaaatttagtgggacttgacccaaacaacaaatatttttccaacaaaatgtctttcttacaaatgtacttttagaaaaccacattttaggaatctatactcttggtttacagctttgtattgtgtaaatgggcagtctctctttgatgggtttgcacacttacctgcctctttcacctgcctctctagatatgaatgccacaatacgaaggattgaccagttaaccaacatcttagcccccatggctgttggccagattatgacatttggctccccagtcatcggctgtggctttatttcgggatggaacttggtatccatgtgcgtggagtacgttctgctctggaaggtttaccagaaaaccccagctctagctgtgaaagctggtcttaaagaagaggaaactgaattgaaacagctgaatttacacaaaggtaaactgaacacaatgatctctccttttgttctcatgttcagaccttaaatgttggtgaagatcaaaactattttgaatttgtatcaggttttattaccagtgggggccagatgaggttaaatatatcgctttggtagacgaggcaagagcaggcttttgaggatctagggaaaaactccgggttgaatctggtggggttagaatgggtcccctagccctcttccttgatgtgagcagtagttatagaggttcaattttacttgagagatagctgggcaaagctaagtcataggactgggaaaaaatgtggggaaaaaaagagaatgagagaatcccttggactctgtgaggagggagttatgtagtcatttgtaggacagtggaagggagtgaggacacaaagatgggtatttcactggagaagaggacgctgggcttctgggtaaacagaatcttttatccagctctgcagggacccagaaaataatatgctggttgttttttgtttttttgagacagagtctcgctctgttgcccaggctggagtgcagtggcgcgatcttggctcactgcaagctctgcctcctgggttcacgccattctcctgcctcagcctcccaagtagctgggattgcaggcatccaccaccacacccggctaattttttgtatttttagtagagacggggtttcaccatgttagccaggatggtcttgatctcctgacctcgtgatctgcccgcctcggcctcccaaagtgctgggattacaggtgtgagccaccgtgcctggccaatacgctgtgtttttttagacaattttaatattttatctggtgagttttcctgctgtttactttggtgggagtataatttctaagagcaagagagagagagaaaaaaaagagggatagatcaatagtattttgtttatttaataaaaatgacacttgatgattattccttggctggaattcttagattattagtaaaagaaaatacatattacaatgtctaaccaagggtacccattgggaaggggaatagaaggaaaaaaagtactactaataattggcttttatttctacatgtcctccccaacaaaataatggtatcttttcttaacagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtaagaaatctctttttatatattaatgaactaaagtgtctttttgtaatgtaggttcagagaatccattaataaatgatctgaaatgttccctaaatgttaatttaagcaaaatccactcttacgaaatttttattttacatatttatactttatatttattgtgttttttattttatagtttgaaaacctgtatttgtttactttattatatacatatacttaaaacatggttcaggcttgaaaataattttttctaaatgaatatcttaaatattacttgtttttttttttgtttttttttttttgagatcagggtcttgctctgttacccaggctggagtgcagtggtgcagtcacagctcactgcagcctcgacctcctgggatcaagcagtcctcctgcctcagtcccccaagtagctgggactacagccatgtgccaccataccttgctaatttttgtatgttttgtagagatggggttttgccatgttgccgaaggtggtcttgaattactgagctcaagtgattactttttaaatgtaatttaatttataaaagatattagctatattaattatactgccatctagtagagtcttgatattgcaataaccttaacaaaaaaactgtagtttagaaaatattcccataggacaacactaaaaaggtaatgtttttggctttaaaagaagatgtgaaagtgataaaaaaaatccttcaaaggtcttctctagccaatatgtatttattatatagtttgccacacaaatggattttatagccctggaaggaaacataaagacttcttacaaagcaaaatttaagtaataattaatagagtactgatgaattatctctgaattcagtcttgaaatgaaactgtttttatcttgtgatacaaaacagttcattagtttattgaagatattaatttccaggcaagacagctttattgtttgggctttagaactctagcagtaatataacaatggtttaaagtttccttacactttaaccataaccatttattaggtcatttgaaacttaaaaaatactagtacttatactataataggatttattatgtctctgatttcaaagttttgtttttgtagtatgaataatcacagaaaaacagaactaagaagtttgtagattagacttctttttgtctgatgactgtaaaaatcatttattgaggccactaataacccaatatttatttatgaaaaataattcttaaggcaaggctatggtatatttaaggtgacttaaagacagtcaggctaaaatgtatattttgcatatgtcaacagatttttatctgtgatttgaaatgtatgcctgtaaactaaaatctaatctttaaaaaaatattttattataggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaatttttcctgaattctgttccccaattatttaacaaggcttttgttacagaacatctgttttgggtaacttgtttttctctataaagggctacagtgtcatgatttttagtgttatctccctgttcatatttctagtttatggtggactggataaaagtgtagtagacatgaggcccagcactctttctttgactttgaatatgtcacactaagcacttttaagttctcacttctattttcccttctgtaaattggaaatgatagtaaaaacaaccctacctacctttcaactttcctggttgaatgaaataagagaagccatgtggaattacttagtgaactacaagacaaggcagcatttttactagaggttggaccttagtaatgacggggagctgaggagagatgtctgctgcctctagagagagtagagccacattctgcataaaggaaacatttattggggacttgatctaaactgttatcagtcctagggattcagactggactcagacatagttgatcagagcctcctttcctttctcctaaaattgagaacttgagagcatttggcatcgccctgcagctactgatctgttcatgatgtttgtgcaaactagatgcctctgttaggtttggctgctgtcttgaactggctctctgctccctcccacaggggtcaaggctgggattgaagatctgtcctgaatgtttgcagctgtaactgaaggcctatgaccttgaaaaatgaacagaaccacattagcaaggggaggcctcagctcttaatatgggcattttgccattctgtgcatctagtgagagaggccctgtgtaggaagaagaagcatggagttgaagagttaataggaatttttacagctgttgctcttacctttgcagactactgctcagagcaggaagaggaaggaagtggaaaagaatcactgctggtctggacagcctttgttgtttacttcctcagaccacagaagtagggcaggggtaggtgacctgtgtggctgtgttatgggggtgcttctaaatatggggtcaaactcaaataactgcagagccaattaggtcattaaaatgaatgaagtagatttgaaataggaaaatactcgttt

SEQ ID NO: 12750 - DNA, 38059 bp, Human
tgacaattctattccatgaaaaaaatcttttgagtctgacctcttctccaatcccattgcagctgtctcctaagttttggaatagtttcctaaatggtctcttggcctctgtattagtctgttttcacactgctgtgaagaaatacctaagactgggtaatttataaaggaaaaaggtttaattaactcacagttctgcatgcctagagaggcctcaggaaacttacagtcatggcataaagggaagcaaacacgtccttcataaggcggcaggagagagaagtatgaggaaccaagtgggaagagccccttataaaaccatcagctctcacgagaactcactcactatcatgagaacagcatgaatgaaactgtccctatgatccaatctcctcccaccagctctctccctaaacgcatggggattatggggattacaattagagatgagatttatgcggggacacaaagcaaaaccatatcaacccccaacctcttttgcccctccaacactgctcttggcattccagttcctgcctggtccatagcctactccttcttcatctgtggaagggagggtagtgggagtcattagcctgggcagggaggagtgttttatcactacactgtttagaatggtgccaatacaaagcacatcaactttcagcaagtttattattgggtttaaattctctacacacgatgcactgcttttgcctacacctggacagtgttcccactcactctccttagtatgatgctggagataatatgatctgccatgaaggttaaataaagcaatgttcactgagaacttagcccaggcccctgcacatgctgagcattttgttaatgtaacaatgattagtaatagcattgctattggttccccatctctggcaaagcctttcatgcttggcctccctcactctctttcaccttcctaaaccctacactccagctatgccaaactgtttactctgccttggacacaccaagttcctcaagcctttgcaaatactccttacgctcctagaacaatggatgtcaattcatcatttaggatccagcttacagtcatgctttccatgaagccttcctcaaattagccacacaaaaggagtgactcctccctgtattcccatgaccctctgctcatgcctcctctttaaagcctgccttcactggagttcctggaagggagagtctgttcagcactcatctctgtatccacagtcaccaaaattgtaactgccccataataaattcccaatacttgcagggattttgcttcttggcttgttttgttttgctggaatgaatgaataagtaaatgggaacgattttgacttcaccctaagcctagctaaaagtttgggtagtgacagttttggttattttgtgtaacctgatagtggatcccctttctatgccaaaaaaaaaaaaaatcccccaatactagagtacctgttttcctagggaattgacctcagcaactgaaggagaggcgattcaaagcagggagtgtgatgaataggtcaactctgtcctcgcagccgtccctgagagggcgctgttcccaaatcgaagccccagaggcggagactgagacaccggcactctcccactggactgggtcagcatccctctccccgcgcggccgcaggtctagagctgagcgcctgcccacaaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcatctggcagtttccttgcaggttcaactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtgagccggcccagggtcctggcagcccaccccggagcccagcgcctagtccctccggtcactcctggtgctccatcccagacaggggaccaatgggaagccttcagttgagggctctgaagagatctgtgtttgtgcaggcgtcaaaatcttaccccacaatttttgctggtcccccttcccatcctacccaatacctgtccactctacttggcccttggctgtggtggtcaacctgaagtattcaagtgtaaagccattcccagcctccccatcttatggatgatgaaaccgaggcccaggaggcacaatggaagagctcctggtctctggagcgccttatgttggtggggatgtcttacgtcttcactttttagcaacacatcattcacgggcaaaacctcttcccttgtttttcaaggggcttggcactcacatgggggcctcacagttgcagctgagttctgatgggtgcaggcctgggaacggaggtggcctggggatgctacttgtcctccttttatcatttccttctctaaagcagagctcctgtgtatatatcttggagactcaacagaagctgagtccagaagcagaatgctttttttttcccctttctcttatttgatcttaatggcttaataataatattaaagacgcttagagatggaagggatattggcattgtctcatccagttgctgagtttgcaggtgagataaccgaggcgcagagaagttaaatgaattgtgcagagccatctaaagagtgggcagcagacctgggatgttaagtcctagatgcatgtgaggagatgcttggctaaacgcctgtaactctgagaatgagtcatccattcccttcaattacagaatccttgggctggagggaggctcaagaagtcaatttgttcaccctgcattcagagaagtccaccagaggcccttcttatctttagagaacaggcttcactccagtcctcaatcttcccaacttcaaggccagccattttcttggccccttttatagccattccaaattgttgagaatgctgtggccctctgtcttaagactcaggctcccacagcttgagaatggagtttggtggccccccaaagtcaagtgtgctcatctcctgcagagggtttggaaagcaggggtacccttattcctattccttggctgtttgagcatccacagcatgtgaaatgctgtgctttgtttggtgaggagtgcagaaaagttaacagtctagttactaattttctaggtactaattttctctaacatccaccttgtaacgccagccttctggaagtagcaccatgctaataggtcatgtctaaacacaacaccacattgagtttgtccttgtggagtgcacagcctagggctcagcagctttaagaggccaagtgatttctgaaggagtttgggaggtgatgggcctgttggctcttgtatgttttatattgatagaactgcaagaggccttagagattaaactaatccattgcttcttaactttctatctttagaaaaatgtacgtacatcccaaatttgcatataatgttgggggtccaagggccttctttggactttagggtgggaacccctgatctaagccatgcttcttgttttattaagcacccattgctgccaaaggcacttcagagctgcctgggttgcctgcagagtttcctttgtgagccctggcctccacttggcccattcatgcctcaggggaagttcaggccatttgcagatggcccttgccctctcagccttccctggctctctacacatatggtatttataacctttcatacattatctgtagcttctccttcctggtgtacaatcattgacaagacaacatccatgccttagcatctctggggccttgcccagcgtctcggctataggaggttcccagtagacattttgcagaatgggagggaagatggggagaggtgaggatccccaagcagcagacaggtttgagcgccttttgtctgagacactctcccggctttgcctaagtcatcactggctgttaactgggtctaagaaagtggcagagtcaaattgccacagatgattcctcatctgagggagacagtaagaccgggagaggcagatcgctcttctttcttatcctccatgtgcagtagttccctctccccactcatgtcagcaactgaatttagctcatgcgtcaaaagctgtctccccttgagggagtgtcagccagcgctgtaggaggggtcataccacagggaaccctccagaaccaaatcatgtacttttcttctttctcataaaatccagtaaacagttgtttttaattggaaaatatagaaaagaataaatttaaagaagaaaaaaagtcacccataatcccatgacttaggagaagctattttaatttacatataaaatatatttatatataaagcatataatttatatataaatatatttccagtatttgtagctattttatagcacagttgagatcatgctatacatataattttgtatgctggcttgtttatttttgtttttgtttttgagatggagtctcactgtgtcacccaggctggagtacaatggcacaatctcggctcagtgcaacctccgcctcctgtgttcaagcagttctcctgcctcagcctcccaagtagctggggttacaggcacccgccaacacgcctggccaatttttgtattttaagtagagatggggttttgccatgttaggcagactggtcttgaactcctgacctcaggggatccacccacctcagcctcccaaagtgctggggattacagacgtgaaccactgcgtctggccagtttttcttacttatagcatgaacatttcctatgttataagcgttatttgtcagcattatttttaacaactgcatactatttcactatttgtatatacaattattcattcaactaatgaatagcattgtttttaacagctgcatactattccattgtgtgtatatacgattcttcacttaatctacttctcttggatgttttaggctatttctaattttttgttattgtagaataattctgaatatctctgtgtataatattttttcctatattgtgtgtgtgtgttttttttgtttgtttttgtttttgtttttttgagattcccagaagtggaattgctaggccaaaggttgggcagagttttgtttaaaatattttttaactttaaaatttttgtactaagagtcatattttgcagttgttttccgagagggtgagttgacactgcatcccttccccattgcgagtaaggctgctctggggtggataagtgcgtccatgcctaggtctcagaaggcctcctcctctcccttctcccatccctgcttcttgccttgattcttgtctccatgccaggcctgaacctgtgaggggccttttcctcagaaacaaagatttgcctctttattcccccagttcttggcgttttgcccctgagggtccatccactttcagtaatatgtgcttgccacagcgtctatttcttgtctgaggaagaacacacagaaaaggacattcttttaataactagttaatgtgctgtgatctctgcctgaaataacttccccggcctaaggcccggcaacacagagtaataaaatgaacagtaaattggcttggcggctgccctctccaacacaggctgcctctttggagtacagtagctctgtgtccctctggccctggcagcctttcctcctgcctctgctattcttctccctttgctatttctctgcccggcatgcagccttgaatccctccttccttggaccatctggcccctggtcactccttctcgctgcctacttctgtggccccttattctgcaggtagtggaggtgagtagctggctgctccaggggctgaggaaggcctgagtacttccatgggccatgagggaggcctccctggaccttggcagagctgagagagaggctctagtggattggctgtggggcctggggctgcagagctaagctgccccgggctccttggggaggctgggctggtctggagggttgcacggaccttctatcgtgtgacttggactcttgaggcatgagcacttggtagggctgctgggatgggagtccatcgtgagggctactgagctggccctttcagcttctcccacttcaggagactctgcaacctcccaccccaaaggtgccttcgcatttgctgtggccgcaccagctctcatcaccaccctgacatccccaccccaggcattacagcgccactgcgccgggaaagatggttctccagaaagccaaagggatagagtgagagggccaccaccccagtagacccactcactgcaaagtccatcctggcaggcatagcccctgcaccaccttcagccctgtccacccaccaaggccaggggatgtcctttgtctgatagggttctgatctgctgggtctctaaaggggcctgggtgaaaatccacctgcttcttacaaggcctaagtgttacacaaggaagcagaaggccttaggccagaggaactgtgtccgcgtgcctcggcctggcttaggggctgccttgaaagtcaggtgcctggcagtcatcaggaaaaacatttactgggaggagaaagacctttggggaaaggtctccctcccattcccattgacagtgggacgaaggccatggaacacagtccaagtcagcagaatccagctccaccacttcctgcccagggacctggttaggaaggtctgacagaggtcaggccacctcccctttctgacccgcagtttccttatccataagatgcgaatagtaataaccgcctcacagcattactgaccggattcggggtggggagggggaggcagaaccagtttagcaccagctgtgctccaggcaccgcgcatggggctttatcatttcctctcctctctcgagctgactctctaacaggagacttagaggcaggctctcaggaaggtgcgggaaggcccttctccagcacgaaggggagggctggagaaggggcacgtcgctgagctctggggacggtgccgggtagtgccctgggcgggctggcctgtcgcaaggaggctggactgtctggccaccagattctccttcgtgctggaatcccttcatcacatggctgagggtgctttcgacagggccaattatagctgctccagggaacacggagctgactcatgcctcaacttggccgtggagagtctcccatccactttctcgcttgtgtctgtgggatgcgttacagtctccctcaaaccccatgaggccgacagggcaagtattatcatcctggactcagtctgtcctgtctcccctcattcttgtgcatccccgtctctgctgttcccaccctggcctgaattaacttttcttttttcacactgctgtgggaatgttttctcctggcaacagaggcaatctgtatcgcttcccataaagaatcagtgcatgagattcctcaatagatttttcctttctggacacagtggtggctttgttacaggggcacctgctgctgtaagccatacccaaatgtccctgagaatttaccccacccgactgtgctgcctggacttgctggtggcctcattagactcagtgtttccccagacccatgtgtggtcagcaagttttgggtcatgtgggtttagcaggacaaactctaggcccttgcctgaccacctcgggctgcagccctgtaacttccccggaagccaccctgctaggctgggaagacttcactcatctgctgagaacaccacgtccctctcaggggtagaatttgagacgcctgtgtgagaaggatccttcattgctgctgtttggccctgttcattctgggcatttttgaggctgcctcagaatggttcttttcagccctctctatttcagctgtccctggagcctttgatgatccctacttcccgcaatccactgttgctgctcccttgcagagccctgcttagggcttctcatccacacactcactaggtcaggtgcctgggcaggcaaagatagatggggtttcccaatcagggtggaatctttctcatgaagggtaatcttgcccgactgtttgtaaatccaaaagtgtccttttagagcccatggagccagggacctgctctgatcatatgatagcagcagctttgggatgccacaccccagtcactgaggccaagcagggaaccccacagctgatatttacagagatgagtacactcctgcgtttgtgggcctcaaagcctcacctctcctccaaggcctggccctgcctgcctcctgccaaaccatatttctttgtggccttcttgtcccattcatcgttctaaaagggagctcaacccttttggcctgtccctaaagatggctgcatttcctggtcaaggcaggaaaggtgagtgtagtggttaggagcgtgaactcaaatccaagggccaggttcaaatcctaaccctgttactgtttactgagtgcatcacctggggcacctttatctcctcctccttcaaatggaatgataatctaggtaatttaaggtactggttaaatgcttaacttctgcaatgaatttaatccccagaacaccctgtgagataggttttcttattaggtccatttgatgaggaagagcatagtgctgatatcatagtatgtgggaaggtgaaacgagataatccatggaaaatttagaacaacgtccggcacatcgcaggtactcagtcagtctgaacgattacccgccatgttatggagtgaggtactgaggttccctgagttaagtaccccctgaagagcatagccctcaatgttagagaaagcaggttggctggccccaggccactgagattcacagcttctcccaggaggccctgaaggagaaggtattctgagaaggcaggaagtgctagccaagggtgcagctgttaggattcactctcatcacaacctcggtgccagctttcaaagtgatcctctgaccaggggaaatcctgccctctcactctgattattgaactgggatctggagggatgaggggcttcccaagacaacctgaaacccatctgtgccctgtgtggcgggtggcctttggacaggagggctccaactctcagcagatcagcagcttcctccagggctggctgccgaggctcctccttggggacggagcccatagcaacctgactttaactaccatggaactgcagagtaaattcacagctcagaacgctgctcaaaggcacaaatgggatgttgatgagtgggaggaagccctggcaagcctccctggccaccacccctctgtgcagaccaggcctgctgctgcagtccacctgtgcacattacaacatccttcatggttacaaagcatgcacacgttgtggggaggggtgtgtgtgtgggtgttgggtacagaaggaaggcattgacagatagaaggtaactttttgacacctgtttaggtagtgcaggtaaaacaccaaacacatttaaaaacatagcacaattataatctttatctgggaatcccaccatatactattacattcgtaatgaaattgcctaatacccaagggcacaagggaggactcatttgctgaacatacctattttgccaggtactatacaaggcattttgaatgtagtctcttctttgaaagttggaattaaatggataatgacaagaaagatagaatgaaaggtgtgcaggttgcttctatgctaaaaaataagatcaggttgctgggtatggtggctcatgcctgtaatcccagcactttgggataggccgaggcaggtggatcacctgaggtcgggagttcgagaccagcctggccaacatggtgaaaccccgtatctactaaaaatacaaaaaattagccgggcgtggtggcggctgcctgtaatcccagctactcgggaggctgaggcagaagaatcacttgaacctgggaggcggaggttgcagtgagctgagatcatgccattgcactctagcctgggcaacaagagtgaaactccgtctcaaataataaataaataaataaataaataaaatcaggtcaggcacaatgcctcacacctgtaatcccagcactttgagaggccaaggcaggcggatcacctgacgtcagcagctcaagaccagattggccaatatggggaagccccgtctttacaaaaatacaaaaaaattagccaggcatggtggcaggcacctgtaattccagctacttcagaggctgaggcaggagtctcacttgaacctgggaggtggaggttgtggtgagctaagaacacgccactacactccagcctgggcgacggaatgacactccatgtcagcaagataaataaataagatcataaatgtgtagatctgcatgaacacttaataacatagtacttgtgtgcatgggacatttctggaagaatacaggatacaaaatacagatactagagggtaggataggatggagattcatttttctttctttctttctttctttctttctttctttctttctttttttttttttgagacagagtttcgttcttgttgcccaggctgtagtgcaatggtgtgatcttggctcactgcgacctctgcctcccgggttcaaatgattctcctgcctcagcctccctagtagctgggattacaggcacctgccaccatgcccagctaatttttgtatttttagtagagacaggtttcaccatgttggccaggctggtcttgaactcctgaccttgtgatctgcccaccttggcctcccaaagtgctgggattataggcgtgagccaccgcgcctggccagagattcatttttcatagtgtaccttttatattgtttgtattttgtatcatatatgagctatttttatattaaagaactaaccggttaaataaagacctatgaaaacccagcagagtctacggaaggtttagttctaaccatgcctttgtgtgggtacttcagcaggttaccttcagttatggagtctgtaatactctgtgtaagaatcatttcaatccatgctttgtttttgagcccaaaccttgctccttctacccccgcccaccagcccccaaccaattgagaaagggaaaaagataaggaccaaaaaacagaatattttaagttcagctgaaattccacctcctctacaaagttctttggacttgttatccagcaggcatttctcccggccatgagatcttgctgcggtggccctgccctcccctctgactcgcatgttgtctgccttatagtagacatgccgtgttgatctttgcgcagaacgcctgcattaggactgtgcttcttcctgctaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggtgagtgtggagggaacacaacactttcaggtgctctcttttcttcttggggtatggggagtgaaagaacagtaggcagggtcttgggatgcttggtgcctagagtctcctgtcaatctttccatacctagattgtcccttgcttgctgagagtgtaactgagtcagttgtgagatgcagcagctgcaaatgctgggttgattcctccttatcagggagcagggaaggatacaacaatgactcaggtcacattcccctaccctgcacctacccctagtaaaagtggaggaggatgctccatatagttcccagtatttgcctaaatattcagtggctgggatttgcatccaactggaaggaggcagacgaaggttcttttctattcacggatattgtttctacctggtgggaagaaccctggaattaagagggaagccttgggtttgagcactaactcttctactaaattgaatgaccttgcacaggtcacctctcttcccccgggacaagttcagccttgcagataccaagatcatcatgatgatgtgaatggagaaagctctaggaatgcttggcaaactaatctgggccttcacattaattattctgtttaaccagaatgcaggctgatcccctgctcacacttattacactgataaatccagtttcacatgtgcatggtaaatactttgaaaataattttaaaactactttttctaattggaggtttttagagtagaggtaatgaatatgggctttgccttcagatagacctgggttcaaatcctgcctaatactgtggctcttgaacaagttacaaaacttacttgtttctaatttttcccatctgtaaataggataataggagttaaaggagaaataagtgggatagtgaacagaaaacacttcgtgcctggcacatagtaaccaacaggttagttagtgatagtgttactatgtcttatttcatttgattacttaattgtttagtgaatggaataggcatctgctgtggccatttttcattgtagaagttgaggctcattgcccaaaggattctcgatgtctcttatcccaaaatatatatatatatatatatatatattttttttttttttttttttttgatgagatggagtttcactcttgttgcccaagctggagtgcaatggcgcgatctcagctcatcgcaaactctgcctcccaggttcaagcaattctcctgcctcagcctcccgagtagctgggattacaggcatgtgccaccacgcccgactaattttgtgtttttttttttttttttttttttttagtagagacagggtttctccatgtttgtcaggctggtctcgaactcccaacctcaggtgattgacctgcctcagcctcccaaagtgctgggattacaggcgtgagccaccgtgcctggccccaaataatattttttataaacctatgaacttgtctctgacctttcttgtagtggcatggagtcaataacagtctaagacagggacagggagaccacgacatgaatgaaatgtggaactgtgagtggccaaggtgtgcgcccagagtagggagcagaggaagggtcacgctgagaaatcttgggaacttggcctggcagagagagaggcccaggcatggggcttggtttatgttgggaatgaagctgaggtccctttaggaagaatgaggaggtcgtggtggtaaggtgcagtggggcaggtgtcctggagtccaggggtgtctcttatacctggaactgagtaaggaggtcctggatgcccaaaatgctaaaatgcataaatggagggggtgggatgagcatgattcaggagaatgagtcgctggagctgaagagaagcagggatatctgagcaagggggtaggcaaggaatttgattttggacacattgagtttgcagtgttagtgagtcagctgaggagcatcgtcctatctgaaggcagagaggaggagctggaccccaggggagaggagggaaaagccagggggagacaagaggaaactgggctcatcacaagagaagagtacaggtttagtggttaatgccattttgggataattgtgcttataatgatatagtgtattgtattatatgtaatagcatatagcctattatgataacagaatttaagtgattgccatcatatgctgggtgcattcctgagagctgagcgcccttatgtcattaatcaaacccagcaagtctcattaactccattgttaaatgtattgaaaccaggtggtgtgggtgaggttgggtgggggtggtttactttgagtaaagacacctctttgaatattattatcttcatctagaaagtgataaaatgtaaataatccattcctgcaaatgttgtgtgttgtgtgaagaagatctgagagagaaaggaaaaaatatataaatctttacagtggttaccttttttttttttttgagacgaggtcttgctctgtcgcccaggctgaagtgcagtggcatgatctcagctcactttagcctccatctcctgggttcaggcaattttcccgcctcagcctcctgaatagctggggttacaggcatgcgccaccacgcctggctaatttttgtatttttagtagagacagggtttcaccatgttggccaggctggtcacaaactcctggcctcaagtgatccgcccaccttggcctcccaaagtgctgggtttacaggtgtgagcctgtaaccggcctacagtggttccatttaggaagtggaattgagcagggcagaaggatagagaagaggaacaccttcctatttcattttatgccttgctggaccatgttttggttttttgttttgttttgttttttgtttgtttgttttttaccatgtgcatatattttacaaaaaaaaaaattataaagaaaatatataggaaggtgttgtgaaacaaataacatgcacataaaaggtgatactattaaggggtcaggaatctctctctaaatctgtgatttcaatgaataaaatgaaggtgactgaggcaagatcctgcatttccagagtgacttggtgtctggcctggagagcagacattgacaaggaaagaaatgtggccacaggaggggctgtgtctcctgcctccttcccaggtatcttactaagggatagaattcgtgttttatttcaacagacaccaggcccctagcggccttgggctctattctgtgggggaatataaggctgatccagtccagtgggcacaggcttggaaagagccagtgataacccaggcaagaggaagagcaggcctgacgaggcctttgtgggaaagttggcatttgaccctgacattaaatgatgagtgaagtggcaccaacagtgtaaaaaaaagaggacattcccagcagaaaatactgaagagagaaagaggagaaaatatgcatcaccagagaagaatgatgaaagaatgtggcttactgcaggcacctatgaaatcgtgaggttctgagattttctccaggagcacgcagccgctgaagtagtggatgtttaggttggctgggagtctgccaggcatgtccattgaaacgacaacagggaatgatgttgcatccctcttgcatgtgccaccagcttcactgcagtccacacaaggtgctgcaccttagatttgtccgcacaaggtgctgcaccttagatttccaggttcctgtctctatgctgctgagtggtcctatttcacaccccttgtctgctccccttccctcgcttctcttaaataacacttgactgctttcctaatagagatatttggcctttaaatgcccaaataaatgttcctgggtggttcccattcctcgaggccagctccagtgcctcctcctccaggaagccctccctctgcctccaggaagccatctctctgccttgaatcttccaaacactacatctgacttctctcagggtgctggtcccattgcactgtgtattctgcttgtccatgtacaggcctcctggcctcctgtcctgcaccaggctgtgctccttggagacagggatcgaggtttggatatcttagtgtccccaacagcaggagttggcaagcatgaaccatggctgcctcacaatcatccagggagcttcctcaaggcatagagcctgagtgagacccacttctggggctggggctgggattctggcctggctcctgggagtctccattttaagccagccaggcttgtgatcctctggccatagcacccagcctgttatcttgcacagagtagggcctcagttactgttgaatgataccccatttacaaatgaggacataaacagagaagcacagccacttggcccacaaggatcaaatcagaaggaggctccccagaccctgactctgcagtgatggtttgggacagacccttgaagtccctcctgccccgctagtccctaggggctcatttgaagaggagccagggggtcttctcattggctatctaaagaagctaaggttcctagagagggccaagctaagtggagtaactcaaggcaaggaggtagctgaccaaggacaaactaaggacttggggccataagaattaaacccaggctttgatcacacatgaagacccaatgtcgctatggagtagccctgcttgctggtcacacagcattttaccaaacacacccgggtgcagggcgctcttaacactggatgtggggagaggcaagaggactggggttcagccccgggtcagctgtcagccacaccctgaactgggcaagtccatggtgaactaaacccttcaggatgcacctgcagctcacctgagagagacaagacaggtggttggagtcatgcggctaggtcatgaaaggtgggcgagtactcacccaggttacctctgcccatgcaggttcgtgtgtgcccagctacctaaccctgtgctggagagcatcagcgtcatcgacacaccagggatcctctctggggagaagcagaggatcagccggggtaagcaacctgcctgaggggtgttggctgtgggctccatggttctggcacgttcagtctcttacataccagaagagaagcacccagggccatgctgtcccttggtgagccggcacttctcctgtgctgtgtgggatcattttacctggggcagtcctaggccggggttggcaggggtcgggagaggggaattcaggtccaccgtagctcaggagatagctggcctcagtcttctcatctgtaaaatgaagacatcaatatcagtcttacctcgttgggtttattcatgctacaaggggcaccttccatggccctgatcctggcttgcttcttaagttcctggggagcttgcagctctgcagggcagccaaatgcatacagagaaattcagctcaatggtatcagtgccctgggtcataagaggagggaaccaggtagtgaaagcacttcaaaaactgttcactacagataaatacaggataattgctcattaaaggaggttgcctggtatggtggttagaagacagaactctggagtcaggctggcagggttctaagcctgcctctgccacttcatagcacagtgaccctcagcaggtttctttatttcagttactttgtctgaaaaatggtgtggggcggtgggggcgggtggggtgggaatagtattatccatcttacagagttgtttgaagattaaaagaaatgcttaagataaaaagccttttctggttggcacatagcaagtacctagtaaccatgagggattatagatgatcatcatcatcatcgttgttttctttttttttttttttttgagacagagtctcagtctgttgccaggctggagtgcagtggcacgatctcagctcaccgcaacctctgcctcccgggttcaagcgattctcctgcctcagcctcccaagtagctgggattacaggcgtgcaccaccacacccagctaattttttgtatttttagtagagacggagttttaccatgttggccagaatggtctcgatctcctgacctcgtaatccacctaccttggcctcccaaagtgttggggattacaggcgggaaccaccgcacccagcctgttttcttttttctaactctaaaatgctaggcagatgctatcaaaagctaaaaacaactgctctgggcccccacccccagcctgtcctggcacagtttgctgagtgtcctgtatagcccactaccctctctgtgccatgtgttgtatctctggcaagaaaatcagatgacgccatgcccaccccaatattggagctagttgccagggctggagccacatcagcactcagaagtcagcctatgggtaaggaagggctttgaactgctggggttctctgggaagcagctagaactcttgcctgaatggacctaggtaggtgactgtctgcatgtgccttcaccctctgtgctctgtggctctggctgggacacagatctgccctgcccatgtctgtgccacaatagtggggcccagaaacctttgctctttctgcaagagcatggcctgcccaggccagcactgctcaccccagacccctcagaggagaggtcacagcctcatggtgtgacaggccagtgctcctgcagttgtgtattgacgaggcccaagtggtgcaggcccttggcccaggtgcaggccactagtgccagacctgggcttctgtccagtgctcctgtgagctgccttggtgtcctctctgcagaaagcagctctcttctgatgagggcaggtgtgtggtgcagggccaggctcggctctttgaggctacactatgcctgtgtgtgagctgccatggctgggagtggaaagggaagacagtgagagaggccctccaggtcagcagcctgctcaagggccaggttaaccccagtcagccctccagggaagacacagcctggagtcctcatcctgtagcaggtgggagggagtggggaggctgaacatcctgagaggaaagccctgcccttcctccttaccacctcttgctttgcttaggaggtgagacctgggaagaagaggggaaatgaagcaactgagtcaggagggacttgggaaactgtgttagcagttcctgtaattggtggcctgtgaattctgggacatcacagtgtcccctgggaagggggtcttggaagacttgatctcctggctccctatctctgggctgtatggtggaggtgatagggagctggaacccctggcctgggaaaatagggatgtctgagcctccctccttccagccagcacgcacgctgtaagcacctggctccctgttaagggccctgtggagggacagcacgggtggtttttctgtcttgctttggtttgtttgccggagcaccccctttctcctaacccacctattcccaaccccaagtggttcatctggggtttaccctgcgtttaagcctgaaggggatttgctgtttcactcaggcagctcaggactcctccaggaaggctggggaaagccaccccttcccagtgtgaactccctgggggacgtcacatgtgcacctgcaaggccagtgtagcctgaccagcgggtccagagaggactccagcctctgcggtttccaaggacactgtactaggaattcagagttctgggctttagaacctgtgtgtgtctcaacaggtcacattttcagtgtccccatgtgtaacaaggggtaatgatatgtaccacacagccgtcttgtgaggtctatagaccatatgaaaacacgggccatagccctgggtctggatcaccatgagctaccttcctccctccctccctgtcagttggcaccacctatcatacaatcccagagtaatctgtgtgaatagtttcccttgtagttgtgcagtgcacagcctgtgcacctgtatgtggcaggctggttcccagggactcctgccttcctcagttcctatcctattctattcttttcctatttctgtttttgttgttgttgttgttgttgctgttgttgttgttttgagacggagtctcgctctgtcaccaagctggactgcaatggcgtaatctcggctcactgcaacctctgcctcctgagttcaagcgattctcctgcctcagcctcctgagtagctgggacgacaggcatgcgccaccacacccagctaatttttgtatttttagtagagacggggtttcactacctctctcctgcctttgtctttggaccccagtgactgccttaagcaaattaggcccttggtgttcttgcctgcacttcctaatgcctcccatcccacattgactaagcaccaggtccccctacctctgggagaaatgatggccccaggagtggctttgcaggccagtttgttttctgctttcctgagtccagactgtaaatgcagctgctggcaaaagcagcctgcgttaaaaacaagagctagaactgggctgctggcgcctggggcggtgctgacctcagcaccctgaggagaccaggacagttgggggaagggcgtcagacaccctcagttatctgtggtaccccaaacgagtaaagtttccagggtgcagagcccaacccctttctttctcacaattggccttagaacacatagctccagtttaaactgacgcacacctcccccaccctcccccacccatacctccttttacgcacacacccactcccacacccacacatgcatacacactcctcacacatatcctgcatatacacaactcccctcttccccacagcaaccccctcccacacacacacacacacacacacacacacacacaaatgtgtgcatagaacaaaacttgctttctcatggcttcttgcctagggctccaagagctctgggtttggccacagagcagactgggtgcttctcgccttactccagccagcccaggcaaggaccggacacccttcctccctgggatagtcctgccaactatgtcctacacgagggcatctagaacctgaaactcagcccaccttctgctcactgagcctcatacctggcgcagggctgtgtctcaccagataaaaaggggcatggttatcaagtcggcacagaggcccctactggccatattagactgcctgttctgcaaagtgagctgcttcccagggctccaagacctcaggcttcacaggaaggagcactcgggccccaggctggactagggcggcaaagggtcgtccttgctcagggtgtggaccctctactgggcctggggcggggtgtgtcttgtgggaagaaggctggggtgcccgggaagctgattctgggaggtcctgggccagcacttgtctctggatgcagatgcattggggtgggcaggggaggaagacagggaggtggttcctggaagtggcaggatgtgccccagcctggctcattactgggaagaagtgaggatgcagcaggagtgggagggctccagaaggctgagtgtcctgagcttaggaaccacatttcctggctgcttcccagctagaaatccccataggcgccaccttaggaaagcagggcggggctttgtgctcacatcacagactgcacagcttgaagctcctccccacaggcccctttctgcacaggtgagctcagtaaggccagagcaggttgaaaatttgcccggatcacacatctagggaactcgggtcttcctattcctggtccacggcttctcagcacattatcatcacctgccccggaagagcacagggggtaggaatgagggcaaacctctcatctccaggtttcctctaggggtctttagggctcagaccttggcaggtctgggctgatccttgcagcctcacattcctagcccatccagggcaccctcattggagcagagcctgcacttaaaggcctctgggtcttcccagactacgtgccggtacaggcacgcctgtgtgggcgctcctgtgcctgggcagagcagccgagtcctgacgcccttcaaaaggccttgccaaccatctgctcgggccgctctttgccgttacttctgggaagcatctaatgtggcatttcttccccgttgtcagccaaactcttcccacattttggaaattgatgccttgttattcctcttttgctcaaatgcctttaaatcttgacggagatttttttggggagggatggggttttgtatgtacccaccgcaagtaagtgcctggtttgagggctcagcctctgagcttcaggctcacatggctgtgagctgttatagaaagagaatgtgggctgcaagtcaaggagctgggttccaggcctgagtttgccaccacctggctgtgtgagcttgggcaagccccttaatctctttgtgtccagattccctgtcctgtaagatgtgtatgccctacttacctcctgggatacagagaattatgaagagcgaatgaggtcacgtggctggaaacccgaagaagtatgctgccctgtgagggcccaggcactgcatgccagaccatgatggaagccggcgggtgaggaaggggtggctttccttactgtgtttgtctgattgatttcctcttgcctggcattacttcaaagtgctttctttccagtcatctggagcctccggttggaggggaccatagatccctgcaggctgcccagtctccaggcccggagctggctgactagacctcttagagccagcagacttgtgctatgaagtccaggaagggcagcttctctgctctgtctcttggggcttgaatctcccccgactcactagtccatatttcatgaacacttgggctgccgcaggtgcccaagagctaccgttgtgggtctcagagccatcgctgggaccagagaggggaagggggcctgtcactggccatagcactcaccgcagctgctgaggcagtctgtgctgtcagatcttgttgccacagctctaccacagagtcctcattcagctctaccacagacccctcattcagtcatttgttatccctattttgcagctgagaaaattgaggttcagatttgccaaataaatgagaaagctaatcctataccataccctttttcttactgggtccagtccatacctttgagataccgccattcctagatctgcacctaagtccaggccaagtgaacaactaaatatccaccctacagatgacacagcctcggggttagccaggagcagggaagtcgagcttcagagcaacccatggagtcattgcttgatggtcatggtcttcacagccacacctggctggaagcttctggcattactgagtctgtaattggatagcagctttccagagcaaataggaggcctctgcttataaaatcacggaaagagttcccagaagcccttggcctgtcctcaggcagaggcagacttcacacaggcatccccgaggcctgtaagacagcagcctgcagcctctctctcttgctgtgcctgcaaagggtcccttgtagctaatctccatccatcctgttgtactccccaccctcacacctctggtctcagatgcagagaattgtgaaccgagaaaggaagctcggaggttgtccagctcaatcccctgatttgacaggcaaagagacagaggactagagaggggagattcttgcccaaggacacacagtaagttagtggctaagcggaaacgagaggtggactcacccaggccagtgctcctctggtgactcctacagagcacatcccatctcatagaaactagggcttaaaaggagtgctttacaaaaaacagcagggcaatgagaacagccaaggtcacagctcagcagtttcacctgcatcctctgatttgtttagatcctcacaataaccctacgactgagtcactgattcctcaaccataaaactaaggcccagagattactcatttactgtctcccagatgccaaacgtggaacaggtttccacgttttccacgtttcacttccgttcagcaaatactgatagtgcacctgctgtgtgccacacaccgtgctgggtgcaggggaagcccagaagggtgaggtgctgcccctgccctgtccagctcccagtgcaccgaggatgatttcagtgagctgaagagcagaacaggagcgtgcatgatgctacaagaccactgagggcagggacagggataggcaggggtctatcctgttctggcagcatggacatattgctgcccctcagcctttgcagacacagccttctcttacatcgctggtgtcatcagggattgcagcaagttgcagggacagagcctcttcccttctctgcagcttctctggtgtctttgttttccccagcctggtggaggcgtggctacagtgcaagagttgagtttggagttcaggtcttggctctgacccccagcattgcatggccttgggcctttctctcaccctctataaacctccattaccttgtcagcataggactcaacactggctgccctggctgccttagcctgttctgagccattgagccaatatattggggctgagatttgctggacaggtgagagggagctgcagctcagtcttggtcctcccagcagcccctcctgtggcctgcactggcacagctaaaatccagattggggaataaggagcagcagaaggccagaggcctggcagggagttgtggaggggccctactgccctcctgctgtgagctgtttgcagaggtgggggttggggattttcttagccctctggcccctccctacccacagctctgagggactgcctttgggaggtgacagccgccttgccatgcgctgtgctgaagggaagataaaaataggctggagccatccctgggaagggaaggatggacagagggatgtaggaaggaggggagtagtgcgggctgcaggcttcacctgaagtgggaatgcttaggcttcccgggctccagtgaggagctggctgtgcctgcgtgccagggagggagggagggaggcagggagcggccaggtgcagaatggctggatggctgacagctgggtcatctggcctcacgacttgccaactgtttgactctctcctctctgaacctcagtttcctcccctggaagtgagaacgatactcctcgcgctgcctgcctcagagcgtgtcgtgagggtgaaatgagataatgacatgaacatcttaccgtctgcagcaagcactgaacttcgagttggaggctaggggtcgtgtctcatgggtggtattggctgagtcacttaactcctagagtttgcgtgaacatctccgagggagggttgatgatgcccctgcccactgggcagagcagcctctgaagcactttcctgggccttgtctctgagccgagacaggacacctgtgttcaaaagagaaggcaaaatctagttcacaccaggccctcgatgacgcacccatcaggaactatcctcaggatggcacctggagatactgggccagctctgccccttcctgagcctcagtttccctatctgtaaatcaggaagttggaccattgatggctaagctcctcgtagcctcataggtctacgccacaggagcagggggagaaggctcaggtgttagttgagctgtatattcattgagcagctaacagatcttggagaaaatcacatggcaatgggaatgcttggaagcacttcatttaccaaagacagaggagctgaaaatggagtagtactggcatccgggtaaccaaaggagggtttgaccttcctttgtttgttagaattctcttacagccaccagggaaacattacaggggtcctccaggaagctttagggcagcaagttttcccgaccgtctgatcccatccccctaccccctgtggcagtgcctccacacgtcctaaatatgtaccccactgggtgttcactagatgccacagggtgggggaaaggctttttaaacctagctccgttggctccattcatcctcatcccccaccccatcgatgcctgctacttagtctgaaatgacagcctttgaaagtgaaagccaactcggtgcagtggttcatagcactgactccagggctaccttcctggacttgagtcccagcccattgcttaccagctgggtgaccttagacaagttcctttatctgtttgtatctctggttactcctcagagaagtggggctgatattagtgtctaatgaccctacacagagtcatcgtgaggattaaaggaatgaatgattataaagtacttaggtcagtgctgaacaccttttgaatgctattgttatttttatgggccagcggtattcaaagtgtggcccttggaccaacagcatcagaatctcctgggagcttgttagaaatgctctgcgccagacctactgaatcagaaactttggggatagagtccaaccatctgggttttaagaagccctgtgggggattctgatggaggctaagtcaggacccctgttaaagacagtcagagcttcttaagtctgactcactcacaaggcagttgcctgatgatcttgcctggtctctagcctccctctgtgaggcagggcaggctttttcctaatgatttggtttcccattcgatggtggcaatgagctttgggtccccagtgtgtgtcaccttggaacccttgtgctatggggagccaggatggttggtcactttagtacccaagaaagggctcctaccttggtgccagaggtatgccacgggggagtggcaggaggagaggctgagaaccctgctcagactcagaatgggaaagcctaacacctccatcttcatgcgactgctgctgctcatgggctgtgtgcccttcgacaaatcacttgacttctctgagccccacttccttatctcttgtcttcctattttatgtaagaggagcctgagacacagaggtaagacctactggggctctgggtgtcagtgaatgtatagactgttggtccaccctcctacttcagctcctactggatccacagctacttgggattgagcagaacaacttctctggggctcctgtaaccagtctgacctaaagcagcttagtgctagataaccaagatgcgggtggccagagttccagtcacatcctaaggaagaaaccccttgtggtttcaagagttgggaattttgtgctgcagctgattacaaaggaaagagcctgagtgagaacaagatgtttttataacaagaattgcagatttcttccagaccagtgacaggcatggtctgaaccatcatcagtatctactttttagtgtttcattgttttcagaccttagaaagaatttctgggtctttgtgtcagattaggtgtccagactttcttttccagcgggctgctaaatacagtaagcacggataggggagctggtatggaaataatgacgttaataagagttactaggccaggcgcagtggctggctgggggcggtggctcacacctataatcccagcactttgggaggccaaggcaggcgcatcacctgaggtcaggagttcaagactcagcctggctaacatggttaaacctgtctctactaaaaacacaaaaattagacgggcatggtggcgcatgcctgtaatcccagctactcgggaggctgaggcaggaaaatcacttgaccccaggaggcagaggttgcagtgagcagaggcagtgccactacactccagcctgggtgagagagcaagactccgtctcaaaaaaaaaagtaactagcatttactgagcacctactaagtgccggattctaagagtatttaatcttcatagttctattaactaggtattcatattattttagtatttaacagtatttttagacgaaaaaaattctatgagacattgagtaatttgctggagtccaaacagttaaaatgtggaggagccaggatttaaacttagatctgactcccaagactgtgttatttctaccacacccgactgcttctccaaacccctaccctataccccaaaggccccagcccctgattgtccctctgccggcagggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtgaggcagccccctgggaggtgggcagcttgggcaggggcccagagtttggggtcagctgcacgagctgagggttgctgcctccaacagccagtgcatcatgtgtgtgacaccaaggggcaggacagtgcgggagccatggttacaagctctcaggtcagatggccagattggaactgactccattgtttactgtctgtgggattcccagccttggcaaggcctttagtctctctgtgcctctgtttgcatctgtaaaatgaaggggttgttggaggataaagtgaaataaagagtctcaaagccctcatcacagtgtctggcaccttcagagatgctcagcaactgtcagctgctggtattgccttcagcagcagcaacatgaccacctcaccctgccttgaccatagctccccacaacctcaccttgcccacataacatagaaaaacagcccagccctgcaagcaacatggagccatgagggtagaggtagaaattatttcaaaagtaggagcaggaggaggcgggagggatgtaggggaagaaatgatgcaagagccatcctagaaggaagggaccgtccagggtcttgatgtgaaggcttctctctggccctgtttgtcaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggtagcgagggctggggtctctaagacaagggacagtgtcccgagagctggctgagcagcctgagtatggaggaggccactcttggagccccccagggagaaccccgcccagaatctgcaggcaaggaggtggccctggatctacactcctagctgggccatcactggcccaacaggggccatgtctgggcctggggagaaacacggagcccaccgccccagtggtgcaggtgtgttagatgatgctggggggctgacacctccagttaatgaccttctctagtcacagccaccacaggcttgacgtccccaccatctctggtgcagtgggatgggtcacctgaccaaggttctccaggctcttaaagtgctcgagtttacatctgaggtcccccttgtgagcaatctgggacacgagcttcggggaggcagaagtgcacacgggaactcgtcatctttgggtcctattgcaggtgcctatcttgggccagtggccatcacacatggtttcttacggttttccccaaagcactcatcagagggaggtatttttcatctgcctttttacagaagaaacagaggtctcagcattttctgagtgtagcattcacataggccacaagaagaaaagccaggagctgggcccaaaggtccaagcaggaaaccacaacattgactggatcctctgagcctccatttcctcatctgtaaactgaagctacaaaatcacgccttatacaggtgttgtgagcaccagtgagataatctttgcaaagcccttagcacaaagccagacagactatgcccttagtacacagtagcaaatcattaggtgggcagagggaggtgggtgctgagcacaaagcacccacccactgtacaatgtttgcaacttcttatgattctagaattaggaaattagaggccaggcacagtggctcacgcctgtaatcccagcagtttgggaagccgaggcgggcagatcacctgaggccaggagttcgagaccagcctggccaacatggcaaaacttgtaataaaactacaaaaaaattaactgggcatggtggcaagcacctgtaatcccagctactcgggaggctgaggcatgagaatcacttgaacccaggagtcagaggttgcagtgagccaagattgtgccactgcactttagcctgggcaacaaagactccatctcaaaaaataaaaaaattagggaattagaaaaatcaaaaaatagcagccacagaagcacttaatagatgctgttgctcttgttttgatctttagcttgggaatcagtttctcagtttaaatctaggtttttcataacatcactatagtcctcaataggcatttttagtttcctatccggcagaagaaaaagaaaaaaatatacattccaagtatttggaatttgttcatgtgtccattcactcatataaccacctaccacgagccattcactaaccagcattgcttttgttttgcgggtttcccggtccttgacttggagcacttcagctcttcgcttctgcttttgttaagaatttaatgatttgtaagcaaacatttgggaagataacatttgaaagggaccctaagaccccagttttaatgtgaggaattctttcaaaacaaagattctcacctcatttgtttgccagttcaatattctgttctgcagttcaatatgctgaatccacaatgtaaacagctgtcctgtgtgggtgtccatcgtagggtaatgggagcacccaccatgccccctagttgatactgggacccctgcatgggagcccaccaaacatacctagatgtgagcaggctgggagggacaggaggaatgagaggtgggaggaccttgggacgtgatgctctgaggggtgggagatagggccctgtctgctcctcctccaggagtccttcagccctaaggccttcctggctcagcctcaccctaggaaggaggtgagaagtacccaggctaacacttgccctagaaagctgtgggtgttttttgcatttttctgcagcagactagctgtgcttcaccctgtgtactggcctcttcccagcttctggagagttaggtggccagagccagggtaggagcagaaagctgtcaccctatcaccctctacaggccatggagaagttggtgttctagactcgaaaactttcaaaattgcagagacctgcaaagtggaagatatttcttttatggtgtggtgtgggttgtcatgtgaaggcaagaggagctctttcaaaatcggcatgcccacctgcctgcctgtgcctgctgtgtcaaaccctcggggacagtcatgccttgctaatgacagggacacatcctcagtaatgcattgttaggtgattttgtcattgtgtgtgaacaccatagaatgtatatacacaaacctgcatggtagggcctaccacacacctggactatatggtatgatgacctattgcttctaggccacagacctagcatgtgactgtactgaaggctgtaggcaattgtaacaccatgtatttgtgtatctaaacatagaaatggtacagtaaaaatacagtatgaaagataaacagtggtatacttgtacagggcacttaccatgaatggagcttgcagaactggaagttgctttgggtgggccagtgagtgagtggtgagtgagtgtgaaggcctaggacatcactgtacactgctgtagacttctttagaaacactgtacacttaggctacactatatttatttttagaaacattttctttcttcaataataaattaacatttctactttacagactttttttttttttttttttttgatacagagtctcactctgttgctaggctagagtgcagtggcgcgatctcggctcactgcaacctccaactctgggttcaagcgattctcctcagcctcccgagtagctgggaccacaggcatgtgccaccatgcccagctaaattttttttgtaattttagtagagacggggttttcaccatgttggccaggatggtctcgatctcttgacctcgtgatccgcctgcctcagcctcccaaagtgctgggattacaggcatgagccaccgcgcctagcctacaaactttttgactcttgttgtaacaattagcttaaaatgtacattgtatatctatacacaaatattttctttatatccttattctataagttttttctatttaaaaaaatttattttttacttttttatttttgtgtgtgctaaaaactaagatgcaaacacccatgctagtctaggcctacacagggtcagcatcatcagtttcgctgtcttcacctccacatcttgtcccactggaaggtcttgagagatagtaatacacatggaggtgtcatctcctgtaataacaatgccttcttctggaattcctcctgaagggcctgcctgaggttgttttactgttaacattttttttaaataagtagaaagaatacactctaaaataacaataaaaagtacagtatagtaaatatttacataaaccagtaacatagccgttatcattatccggtattatgtactctatggaaatgtgtgtgctagatttttataccactggcagcacagtaggtttgtttacaccagcatcaccacaaacacataatgcgttgtgttatgtacagtagctacaatgtcaccaggcaacaggaatttcccagctcccttattgtcttctgggaccctcgtcatacgtgtggtccctcattgactgaaacattgtaatgcagcacatgactgtattttgaaaactctcctcaggtgactccgatgagcatcctgattaagaaccataatttggggatgacctttggcttctgttatgatttggttttagtaccctgtgccctgtttggtttttgtttttgttttcactaagtggggatagaatgtgattttcctacctcagaagggcgctgggggagtgaacgaggtaatgtagtgaaggcacttgcggtgattttcaagtacagtataacccttattaaagtagaggcccacatgacccagtctcagaggtacagcattcaagagacatgattcaatagccaaaactgacttaaagagaaatgtaatgatttcctctctggaatgacattgaaggggattgaaataaatagatcatgccaatacttgttaaatttccctttcttccccagcccctacaacccttctaccccctactgaaaaatcccatcatcagcccagtgggcctttattcccctcctctctcataccttcgattaccacgtgatgtccatcagctgagcctctaggtcacaggtctttcattgtagaaagggatcagctgtgaacattctggtgttcataggaggcacgtgataaatggagggctctcctttcatcgtatcctatcttcatcctctctcctcctcttcccaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccacgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtgggccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggtacctgcctggccacagagcatcattcaatggaggctgagggagaagggctgggttcttacttggagttcctggtgaaatctttggctggaaagggctcactggggccacccaatggccagcatccacaaccagcttcccagtgggctggagtttgtctaggctcagtgaccaacccaggcacagctggtggagccaccgctccctgctcctctggagtgaagatgttccctaagcccctgggcttccttctgcaaatacacatttctctttcacatgaaatgaagggcagacaaaggccaggcaaagaggtctcacctgctctggagaaaacccttgagtgccgagtgcaggttagggaccatttctcagctccacacctttcttcaagctgaaggagaaatgggaaggaaatagcagaggtaggtgaagttcctgtctttttattttataggaaagggagatgtctgttatcccctttcttcactgccactggacacacatgccactttcctgcccttctacatatgctgcctctcttccctctctccatcttgaagtctccacccaggagagacctgtgaggtgtgggaattccatgtttgcacagctcccatctccctggaaagaggaactgatgtttgaggggacagatgtgggtcactttccctggcagtgccctctagccttgctgccttggctttctgaccccttccaggcttcaggggcctgggagatctcatgcctcagcccaggaaacatttaatagggaaagcagagacatgtcatgtcagccccacagacaagaatttctagagcacttgtcctgttgttccttgccccgacattactcagtctgggccatggaatccatccaataaacacagcaacaccctatgctactgaccaagcaaagcttgcccctggtaccaaagagctaaatcatgaccaaagtgtgacatgaatgtaactgaaatgcgggttagttgctcaatgtatgcaaagtcccacggacaagagtaaagtctgataccaataaagtgaatgtattccaaagctagcttggaggaggggcacacaacgtcctgcctttcaatgtgccgcttcccctttggagcagaaagcaggcacttttataaggtaagggagcaagtgagcaagggtccgcctgatagcatggtgccttatctactggacagttgagtcgggccttcctgggcaaaaataaattttaaaagtggccaagtaggcatactttagatataacctcctagtgaatgaaagtcctgaggcagcccctggagggtgggagttccaaggcaacccctggaggtgaaagctcaaggagggcatgttttggtctgcaaattggcagtcaattctggaggactattttggagcagagagatgaacttgccctgtagggaatgtctagtgaaggggagatgaaagcttatatttgcatttccctttttttgagacagtctcactctgtcgcacaggctggagtgcagtggcatgatcccagctcactgccacctctgcctcccaggttcaagccattcttgtgcctcagcctcccaagtagctgggactacaggtactccaccaccacgcctggctaattttttttttttttttttttttttacttttagtgaaaacagggtttcaccatgttggccaggctggtcttgaatttctgacctcaagtgatctgtccacctcagcctcccaaagtgctgggattacaggcataggcgagagccactgcgccaggcctatatttgcatttctaaagggctacctaggaagttgggaatccaggaaatggaaaaaagaagagaggaagaaaaaaacagctcttagaaaactggggtgctcatttacatgaatatttccagatgacaccactgaaccatagcagggcatgggccttggtttgcagagtgatgagtggttgccctgagtcatccccacttccatttggttccaaaacctgta

SEQ ID NO: 12751 - DNA, 148794 bp, Human
catgttgaccaggctggtcttgaacttctgatctcaagtgatcccccagccttggcctcccaaagtgctaggattacaggtatgagccaccatgcctggccttgaggactgattatatgcaaaccctgagctaggtgttaagaatatcccaaacaagctaccacttttccattctcgtgcaggacacatcctgtagcactgacagagagaagtaagtgggcaattttagttcggggtgatacatactttaaggaagtgcaaggtgatattggtgagtaagatgaacctgagagagtagggaatgagtttttccagtagtgaaaactgcatgtgggtaagataacttggaagttagagtgtgtttgtacatttggatggagcataacaacaaaagaaaaacaggagacaggacagacagtgtcctattcagtgtttagatatcagggctggctgggtgcggtggctcacgcctgtaatcccagcacttggggaggccaaggcaggcagattactaggtcaggaattcaagaccagcctggccaagatggtgaaatcccgtctctactaaaaatacaaaaaaaattagcctggcatggtggcgggtgcctgtaatcccatttactcaggaggctgaggcagagaattgtttgaacccgggaggcggaggttgcagtgagctgagatggagccactgcactccagcctgggtgatgagcgacactctgtctcaaaacaaaaaaacatcagggctacattttcaatagtggctagtttctgaaagttcatataaatgtaagaaaaaggtgaatgtgggtgatgctaattgtgaatagtttcacagagcaatataaagtgactgggatgaggacagggcaatgaggaaggagctgggaatttgaacataaggcatcttgaatataaatcgagagagtttcctatttgtctcatagacagtggggttcattgactgcttcccaaaaaggtggaggaggtggcatgagccaactcacactttgagaagataattctggctgtcatatttaagaagaattgtaaggttgtcaaggtagaatcagggggaccaggtgggtggcatttgttcttctgtgtgtcttggcgaagaaccttgttttatttaatcccactaagacttctttcctgcagatctctggtcttacccgacatgctactgattggaaaggggaaaaaatgaacccactaaggtgttaaggattaattccaaaattcctcacttctgaggatttaattgccacctctgcctacgcatgaaactgggtgaagtaataaatagaaacaggaagtcactgaagacttaggcaatttggaaacagagtcctaaggtaacttgccagattccaggggctctgtattggcagtgaaacaatctgattgcgggaagtgcctaagaacatgagtttcttagtgctggaaaggagagaagatccattcataagcccgtttgtattgccttcatttatttaagaattgttggccgggcgctgtggctcacgcctgtaatcccagcactttgggaggccgaggcgggcggatcacaaggtcaggagatcgagaccatcctggctaacacggtgaaaccccgtctctactaaaaatacaaaaaaattagccagacgtggtagtgggcacctgtagtcccagctacttgggaggctgaggcaggagaatggcgtgaacccaggaggcggagtttgcagtgagcagagatcgcaccactgcactccagcctgggcgacaaagcgagactctgtctcaaaaaaaaaaaaaaaaaaaaaaaaaaagaattgtttactgggtattttataagttccaggcaatgtacttagagatgagaaaaatagatacagtccctgtccaatggaggtaactgtctagtggagagtgaggacaataaaatcattgccagctggcctgggggagcctgaggctgagctagttgggagagtcaactaaagtgccctgtagaagtgacctccaagcccaggcccagtactttgagaaggagtttatcaggggagaatgggggagaagattgtccaaagaagaggagacctcagaggcacttcagtcctgaagttcttggtttcactctgtagaagagtcacctgggagcttgttaaaaaggcagaggcaaagactctggcctgctaagttttgactaatctctcgtttctgtattttaacatggattctcaccaaattctgatgcgggtggctgacctcacgtcaaaataacacagatggcatctgtgtctgatagttttcaaattgtgcccctggcctgaagggcaggatggtgaggggagagtcaggggtctgcgttcatcgctatcccctgagaagttctacttatatgtagtttacttattttgcaaaatatttattggaatgttattatttgtacttcctccggcaaaatgtacattctttgtctatagagttttctcctgtagtcctagcacctaacatagagacaaaaccttactcccaaaattagttgaaagaatatattaataaatcaaatgtttcaagtctaagtaaaagcatgaaggccactaatccactccaactgttcattttacagatgagtaaagtgaaactcaaagaggaatcattacttgtctaaggttgtccaggttgttatgttagagtagagggctgacttatatgcctgtgcccacagtccagtgtttgttcctccaagtccaatttcagcttttttttttttttttttttgagttggagtctcgctctgtcacccaggctggagtgcaatggcatgatctcggctcactgcaacctctgcctcccgggttcaagcaattctcctgcctcagcctcctgagtagctgggattacaggcatccaccaccgcgcccggcaatttatttttattttatttttttatttttagtagagacagggcttcaccatattggccaggctggtcttgaactcctgacctcatgacccgcccgcctcgacctcccaaagtgctgggattacaggtgtgagccaccgcgcctggcctcagcttttaaggaggacaaaatattggcagaatcttgcttaaaatacaggaagtaagtaagaaatatgatgcagtttaagaacaatttatataaattcatagacttgggtctcataatgggcaattagcttgctagagagatttttgggttgaaagcaatcctaaaccacatgtggcatgcacatagtgtcatagagatagttaaacccggaatctttgagcttaagtttcttcatctgtaaaatgaaaataaccacaaccagctcctggggtgcttgtgagtattcatgcaaagtgcctggcccatatatagttgaccaacatacatttatgcttaagcatatgtacccggaaaatcaaacatgtccaatattgtaaaagagatattatttatctctgagtctactaggggtttaggcagtaaatacatgcaggagggagggagagagagagagagaggaagagaagaaggaggagggaaagagaggcgaggaaaagagaagagaggagaaagaaagaagaaagaataaacgaaggaagaaaggaaaggaagggagggaggaaggaaggaaggaaagaaggaagagagaaagaaagaaaagaaagtagaaaagagtattattcttccttttggaaaataccatgtgagcttgcagaaataccacgttggttgttggcagtggccttttgtaggctattgccatcaaataccttatgctcaagaggaatggtagtcatgtgtggagacaggaaaaaagaggaactgaggacaatttgatggagagaaaccatttttatgtgctttggaagaaagaacagaattaaaattcagactttgggagtagctctgggataaaacaggaaactggcatttctcagtgtgttttggagtactgtccaatgaactcagagctggaaaaacctaaacaggcaatccctaccataagttatccatcatcttggtgcctatatgggactaacatgtgtctgtggccacagcgatgactaatttttgactgaaagatgtccaattcacctaggtatccagaagacagttgctaatgttccataaacatttttacttttctgaaactcatagcatttcctagttaagaatggacaacaataacgctttccaaccacccgttggattctgaatccctcctataagcatctctgtcaatcagttatgcaaactctgcttcagtatcttcaaagacaggcacccctctacttcccagagcagcttgttccattctgatcagttctgacagtcagcaaggacttgctttattgagtgtaattttgagagtattgagaatattttaaattaaattattatttaataattgctgtcaattattcctagtcatttcagttttaaccctcagagctgtgttttcatgacatttacaactcatcagatcctaccaactaggaaaattgatgatgccttccttcttcttatgatgctttggtaatcaaatcaaatatctctaagaatactttagacgacccccaccccattgtttttctattatcattgagtatactaaatcaattaccttgtttaatcatcaaattataaattccacttaaaacgttaattttcttaactcagatgtgacctgggcagtttttatcagcttcttccagcgtagatttaaataacgagtgtgttattcaggtttaaaagttctccaagaaggctatgtgggtaaacatccctgttttctaatttgcttcagctgagtagttttcaaacattttgggagcaagagaatacttttgtcaaagcaaaacaaacaaacaaatcactgatctatctatctctgtcagtggtagtacaatatataaatctttgatcatccttgattatttccttaaaatatattatttgatgtctgggtcaatgagataaaacaggattagcaaactgtctataaagggtcagacagtaaatattttagactttgtgggccttctggtctctgttgcagctgctcaactctgccactgtagtgcaagagcacccacagaatatacagcacataaatggaggagtgtgatagttttccaataaaaatttatttgcaaaatggacagtgggacacatttggtctttggcctatagtttggtgccttgtgagttaatccttaaagattttagtgcattttggttaagtaaagtatggttttagatccctggttcttgatatagagccagatattcagtgaatataactgaatgaattagcagaagagaaggatatttcttaactagtttcaaacagggacagggaatatttctttataggaaaatgactaagggtctagctgagaatgtggatttgggggaggctctgagatggcagcatgctcactaatcctaaaatatcttaacaagaaagaaattggcaattaaatgcagtattacttgccgggaaaaaagttgttcatttttcttcttaaacaaagcactgtggcagagggaattaagcagagacctggtgtgcgagacctggattttaaaaccagctcttgtgctgacagctgtgtgtctttgagagaattatctcctctttcagagtccctgtgtttccatctaaaatttaagtcagtgacaaagacactctttgtggtcccttggagctttcaaattttgtgatctgaaaggaaaaaattcatataattgcaatgtttaatgggatttatgataattggaaaataattgccattccaaacttttattaatctatatttagttatgagtcgctctttcacaatagatgctttggaaataagcaaagagacaaattgagtcaacagaattttcaatattttatttatatgcagtttgtgtaatccctggagcccatgggcatattaagatcatttaaactatccattaaaagttatgtgttatacaacaaactctccttttagaacgccttgccgcaggatacgtagctaacatttattgagtagctactactgccagattaattgcattcattatgtttaatccttccagcaatgctgcaaggtaaatactaatattccttttgcactgataaagaagctcagagatgctgagggatttgcagatgttcactcggctaatgagtggctttattgtaggattcagagccagaccaggccgaccgtaaagtctgtgctcatcccacagtatcagaatgtctttgtgaaaggacctgttttgcatcctctttccaggtgctcaatggaatgagcatttgctttccttgatatcctctattttgtttttctgtagagcattgtggagactcctggcagggtgggttgccagagtcaatgacttcccccattcacatggggacaccagaatgggcagaggagtagagaataggaagaaacaaggaagatcccagactaagaataacagaacctgaatttctgtcccagatctggtgcagattttccaagtggccttcactgctctgggccttggtttcctccacttgtgatggggatgatcatactccctatcttccaggttgttgggagaataatgtgtggggtgacagagatttgtaaaggaccaagtgcatgacagaccccacaaagtcaagaaaatggaataagacagtgggtcagagtagagaacacggaatctaaggtgaggaacttatttcctagtccctcttgccaccaatggtgctgtggccttagcaagtccctctctctctatgggcctcagttttctcatctgtgaaatgacagtgatggccgtgagtgcctaaagtccctctatcctgatattttggattctgtatggcaaggcagtgagcagttccagtgcatggagtgtatctcaggaaacactgggccctttggggtaaaataaaacaagtgcattctaagcttcctttcccacgattaactctcatagccaccattatggccccctgccctcgataacagtgcttcaggaagaatcccacttgcttttctggaaatggcccatttatataaaagttgggccattccaagtgtgcttgttgtgtttctatttttccctctcaagtttatgtgcaatgagaaacacacatagtccccttccagtgtgctccccttaggttatttacccccattgctctgaattcagccccgtaagagccttcagaactgctatgaggctggcataagagtaaaactatcattacttaagtgaacacctttggcaaatagacctctgtacacattataagcaaggagtactttattctctaaagttaagttgatatctttacttgtaattaaaataatactattcataattacattttcagagatagttctttttttcttcttctttttttctacttttcctcacttcacccctctggagccaaaatgccctgagagatctgcctggatgtggctgtttctcagctgccttgccagttgtgttatgggacatgaaggcaggcaggggatttggagctgacaccctctcgttaagatgcatcatttctgcttcacatatgcccttgggttcacctttctctgagctggctgaggatcgtgtggggagcgagtgggaacagcaggcaagagaaatgccttctttcctctctcagctcaatgatttcatctcactcttctcctctgtgattccccttgttcacctctggggataatttgctgctaacaatagcagaagctgtcccagagttttcctctatcaccccgatactcagaagcttctctttatccatttccaaatgattagttaatgcgaccaatgggataagccacccaggaataaacaaatgcaaacatcccatcactgtaatcaatcatgctttcaacaaacctttattcggggttcaatgtcattatagtattccaaaatgtattcttggattaagccagaccgccagaaagctatatatttagactgtaatatgtttgcccctcatggagttgctttattgttgcttattgtatgaatcgtgtatgaatagtgcttcattatatgcattaggctaccttgagcccatcaaactcacaggaatattgttcagaacatctcccaccagcatcaactctattgatctctttatgagaaaccatggaaaatgtttgtgtcttattgtagcattgagggaatctatttctcaaataactttgaacaactactctgctgtctttctgactgtatggcttttggctataattcccctttttccttcagctgcaaggaagctcagagacacttgcagttcacttgaatcaagtgttcaggactttatagaattaactttacaaacttcattttctattttaacccaaacttcattttctattctcccttttatttttcctattttatgtgtattttacggcctataagatgtgtatgtttttgaaagtaacctccaactacatctgagatcagattcatgtaagcgaacaagtcataaaacatgcatgagaagagtaaaagaaccctccacttatcagaggtcattaggagcttgattatctaaaaacaatggaggaaacacatttatccagtgcgccctatagacccaagactgctggaagcattccccttacaactctaagatgcagaaattgtcactgccccaccccattttacagatgaggaaactaaaatagaaccttttaagcaatagaaacatcataagtgtgtcctatacaaataattgtaaaacaaatgctaatgccaacagcagctaacaattgttcataccgtgttgcactgtataaagaagttgtctaactattatttcatctaactcttccagcacaatttgaggaggtgcatgcttttagtcctcatcacatatacgaaaaaatagacttggatggagtttataaactattgcttcatttcttaaatttagccttgctactttcagcttacttcacaagaatcagatcccacctttccctaaagttttatctactggaattttaaaagagcatgattgtgtcctttcccttctcactccaccatctatccactatcacccagctttccaatgtagctgctcatgtaatcataacaacaatgatgatattgataataactttaatattttattgatgctttcatggtttaatataatcctaagcctgtccttgtaaggtagctaccatttacattttacaaagtataaaccaataggtggtagaaccataactcacagttttacccctagagcctaggttgaggatacagggttaaagatgatccaattcaatcagtttatttcacaggtagagacacggatatccaggaatgaatacaccgtcccaagagcacagagccagttctccttcctgtctcgtgttttttttttttttttttttttttttgagctggagtcttgctccgttgcccgggctggcatgcagtggctcaatcccggctcactgcagcctccgcctcccgggttcaagagattctcctgcctcagtctcctgagtagctgggactacaggcgcatgctgccacgcctggctaattttttgtatgtgtagtagagatggggtttcactgtatttcccaggctggtcttgaactcctgagctcaggcgatctgcccgccttgacctcccaaagtactgggattacaagcgtgagccactgcacctggcctctcctttctgtctcgtaatcatgtctccttctgtgcactgtgtcattgagtgtacatatgtgtatttttttgcacgtatgaaggaaagtagaggactaataaagaggatgaaggaggattcctatacaggcaatactttgctctaaaaagaaagattcggacttataattttctctccagcctcatcttaaatccagcacccctggctgcagtcttcatccatccccaggccctgtcatcatctgccctcccacctctggctcccccagtgggatggcccttgctgcagacaccccacgacttccatccaggatcttactttaatctcagtctaattggtttgcccaccctgctgggatgcttaattgggcataagcatattccacagatcctatgccattgtgagttctgccttctcctccaaggggaatttgcttgttctgtgcactcagaaggaaagatatattttatgttgtgctcaattccctgagaactgacatgaaattgttcccgggccagcagagcagttagacaacatggcaagcaaggcttgctttcttttatgtattttcttttacattattttttttaaggtggcatgttgcaatggaaagggtattgcacttgaagtcatgagccttgggctctgatttaatccttcctgatcgtttgctgtgtgatcttgatcaaataactcaatctttttgacattcaattttcccatcagtggatggtattagttggatttgatgacttctatgaatggagttagagtgaagcttttaggacatatttcccataggccaaatatatttgggcacttgcttttgtaaataaagttttattggagcacatccacactcagttgtattgtctatgactgtttccctgtacaaggacacagttgagtggttgcaacaggtacctgtggctgaaaaatctaaaatatttactacctggacctttatagaaaatgtttgcctacccttcctttataacgtaaatcagattaggtagactcaacaccttcttttgacttttcttgttacttagaatttttaaaaaagttttactaaggctgacaaagccttttgaggtctatgttcctccacttcatcttttgatattatttttcttcccatatcacccctctactcatttaggctgccctttgatgtttcccaaatgtgtcaaacacatttccaccccaggacctttgcatttgctgttatttttttccgggaacattatttcaccaggtggccctatggtccctccctcatttccttcaggtgtctcctcaaatgtcatgaaatcacaaaggccttttctgatgacctatatgaaatgacagctttacccccttctggacatcgcagcctcctccccgtgatttatttgtctttataacacttatctcccctgacacattacatatttgtttctttgttatctgtccactgtcaccagcatgtatgccccttgagagcaagactttcattaattttgtttactgtggtatctttagagctggaaaaatagtaggtgctcaaatttcgaatatgtaatcaacctttttgtctctaatgttgtttaaatctagctctgaatagatctgggtgctattgagcccttttacttaagtgtactttggtaaagagtgtaaaaatcacagaatcctgtgattattacagtctttgctccaacatccctgtaatggttgcagagccacataaacctatcttcaaaatgcttttagcctggattgttggccagtgagaacagagtttatagactgtaatctactatcatagtttgacacatagtcattcatcctgtggtccttgacaacctctctgcctttagctcttatcatttatgtattacaggtacacacagacacacacatccctttctttctacctgtcctatcccctctctttcacctccatttttgcacatggagctcattgttctttttgttctttaccatttttaagtgttcaattccatggtaataaatgcatttatatgttttatttttcccttcgttcctccccaactatccttcccagcctctgggaaccatcatttcactctctatcttcacgaggtccatttttcatctcccacaaatgaatgggatgtgtgatatttgtctttctgtgcttggactatttcacttaacaaaatggcctccaattccttccatcctgctgcaaatgacaggatttcattcccttttatggctgaatgatattccattgagtatgtatacatattttctttatccattcatccattgattggcacttagtttgattgcacatttttcgtattgtaaatagtgctgtgataagacatggtcctatctctttaatatgtatttccattcttttgggtatatgcctagtagtggcattgctgaatcatatggtagtcctatttttagttttttgaggaacctccatattgtacattatagtttaataccttccctaaacaaccatttgtcctccttcccccagtggaccaattccttgggataaaaaactctgtccgtggtgctgagcaggtagttagttctttagggtaacatccccagttactgagttctccccaagtacctgactctgtgctcagcaggtcgcatacatttcctcacttaggccttacatccaccctgtgagggataaactgggtacctggcataggcatctttctgagtttcttttcaaggaagcaacacagatggcaggccctggtctatcgctggtgaacgtcaaagactgtgatggctgtttcaaaaaaaggaattgagtcatgccttgtaatttggtggtgggggtggcatcattcttctgtactggtactggttctactatgcttttatattctacctctcgatatttacattaaaagagtgatttaagagtcagggtgccagttttctatactcaattctaccactcattagctacatgacctttaacagttacttaacctctctgtgtgaaataaatattaattttaaggaatacgggtgtgttcatatgaaaaaagcaacccaagacagtaagttatgaataaaagtgatacacacacacacacacacacgtatgactatatatatttttctatatactgatatatcagtatgtttatatgcatatatatatataacctcataattatatgtatatataattttataaatttcttggattagctgataaggaaatactcttttcctcagagatatttggcatttctcattgctgtgtattgatcaattacctcacaattcagtgacttaaaacaatattatctcacagtttctgtgagtcaggaatctggacgccctgtctctgggtttgttaccaggctgcagtcatctcaaggctagcttgggaagggtctgtttcctagcttaagcccatggttactgccaggattcagttccttgcaaggcctcatttcctcggaagctgttggcctaaggattccctcggctccttgccatgtggatgtctccatagagcatctcacagcatggcagcgagtgagagggagggaggaagaaaagatggacacagagacagagagagcaggaaagccaatgcaagaaacagagagggaacagagagccagtgggtgaagcagaaaaagagacagagacagagaaagacatagagggacttagagaaccagagacacacagagagagaacacacaccaaatagacatcgaagaattttgtaactgaaacgtgaaagtgacactccatcactttcatattctattaattagaaacgagtccctgggcccgaggtcattaggactcaagccgcaagctgcctgccacacctgtaacatttgtctcagctggctgtcaaggtctttcccccatgcccacatcccgtcaactacttgttccatcttgttgcctcccacaccctctttttcatgctccccctattttattctgcccttctcataacgttttctgtatccctgctcactgttcctgacttttcctccccatggttagtttttttgttgtttttgtgtttatttgtttctcttttacttttagagacaaggtctcactatgttgtccaggctggttttgaactcctgagttcaagtgatcctcctgccttggccacctgagtggctggggctacaggcgtgcaccaccattctggctgtttttgtttttaaccacacttcgttgatctaaattccatgcaaacttaaaaactatagttcaaacatgacctcctctctgaagctttccctagaggcccgaaaagttcaggttcctcctcctgtgtcctgtagtccttgatttataataaactgaaaagtcttccagactgtgagcttcttaaggacagggactgtgacatgtgcattccccttccgtggacatcatatgttgcccttagtaggtgtcttgaagggttcactgagtgcagttgattgacttaagtacctgcaacaacatgcaaggtactcagtggacttcaaatttgaactatgtcttgaattatggacagagatttcttactcagacacagaccatgatctctgaatcttggaaacatattctaatgtgaaagcttttctcagacccagttttctgtgaatcaggggtcagacaccaccactaaattaccagggcacattccggccagatacccccactgttctgctgcttctttgccctgtgtccctttcctcattcgtctctcccatcctgtggcaggagagagagaccttttcattaaactctggttcccatcatttatctcagctgaccttacagccctcttgtctagtctgttttcctcaagggaccgagagcatgtaactcaggcaggtcggagagctggtcattctgggggagctgcatctttggtgggaactgtgattgttactgagcaaaagcaaccttcactcagtccctctaagttttcacttgtactcggtttgtatgctccaagtttactgtatgtgaacttttaatgatttacatgtacatgtctgggaacttgtgagaaaataaagttataaaacaataattcacattaaattagcaccttgcagtttccaaaggtattttgcactctatgtttcatgtaattcctgcatcagcagtagcaaatagataattgaattttatagatgaagaaatgtaggtctagagaggggacaagatcacaacacataatttgtaagagggagagcgagacttggacttccaaatttggtgtcgtttggttgtgagatcctctgttattagtgaaggcaaacatggaaattctcccacatggtctttggaacatagcttaattgctttaaaatactaggtgctcaatgaatacatgttaacattttggattaaagtgagctctgggctcaatatttgatttctggattatcctagaacagtcctcaggttgctttgtgccttaggtcctgtctactattatatatcctccttctcaccctccctccctccttccctccctccctccctccttccctccctccctccttccttttcttccttccttccttcctttcttccttccttccttcttccctccctccctctctctctccttccttccttccctccttccctccctccctttctctctccctctctcccttccttccttccttcttccctccctccctctctctctccttccttccttccctttctctctccctctctcccttcatccggtccctccctctctccctcccttccttcctcccttccctccctccctccctccctcccttccttccttccttccttccttccttccttccttccttccttccttccttccatttgtttatttctctgtctggcattatcatgaatcctgccatgtaacaggcacggagctatatacagggctgggttagggagtgcctaagaagattctattcttgtggtgtcatttacagtctagcaagagagatggacagacaactagaagacaatggaggacttggtcctgtgacaggtatcagaaatggataataatcccctggcacagggctagtgtgatcattatataagaacttagacatgatattcttggaaactataaaataccatgaaaattttcatcagtacattatcatcatccatattatcatcagattattatttgtattactctttctttttcctcagtccctctacccaacccctaataaaagtaactcctgatatttgtctccctggtgctctgtaaacaacttgaggacaatgatattgtttatctagttcaatattcctgtgatgagaatagtactctataaatatttgttggttgcagatgattggaagctccagatcaaagcatcacttgacacatattaaaattgtaggcactttcccacttaaggagagatgcctggatggatggttgggtggactttggcttaagggtaatggtggtaagttgagaagtgttgctcatttctcctgcccagggagtttgcccgttggaaggtgaggaacacagccatcgagaggagagatctggtccgccatccagtgcccctcatgccggagtttcaaaggagcatccgcctgcttggcaggagacctaccactcagcagttcatcgataccatcatcaaaaagtacggcacccacctgctcatctcagccacattgggaggtaggtcagcagccactgggccagagccttctcatgactttgggtttgggatgggaagggagagtgggatgtcttaacagcaaagccttcttagcttctctgccattctacatcacacaaaagcatttatagccaggtaagccaaattgtcttggctgttgtgatcatatccgaggaggtgattcagttctatgggacagtctaatttgagagtttactaaattttctgaaaatacggcttaaccttggaattggctccatttgttagaaatgcctaatctgatcattttctcagttcctttggtctaatctgggaaaataattaaatttcagatattgtttagggaatatgctttgtttatttaagtctactttagagactgataaatcgaggttatccttttacaaacaggctatcatttgtaactcctgtgggcttagagtaggttaatgggaaagcagattaattgttccaccctgctcagccttacccatccctccccatcagggccagtcagtttttgagtgatcaagggtaagagggctggataaaggagaggaaataaatgcaaagacaatgaatggaaaatagtgcagactagtgcctttagatgcttgtggatcttgcctgaatgcatcatttaatattaggagcaatcccttaggcaccagttttgccacagtgactggattcactgaactttgaggaagcccctttagtgatagagcgctgtgccacatactcacaaagtcgccggctgcatttaggtatggcccatgcccactaggagagattggcatattgatacaggaagggtggactgaggtgtaattataacaggggatcttctccttcagagacatgttgagcactaccaactggagtggtcagtacagacttcctggaggaagtgacagttttgttcaccaggagctggttaagtaaagggaggtggcagagctttctaggctcagcatacaatgtaggaagacccgattcataatgtggggaatgtggtggagagattggttaggcaaatttattcattcctacaataatattatccactacttaacagttatttgctatatagcagacattgtacattgtctttagccctcaaaactgcacatgtcatattacctccattttataaataaggaagctgagacccagaagaagtacagctagtaagtgataaagctaagtttttaagtgagtgttttccatgcacaaagcctgcattctgtttttgatccaatgtcagtcatctctttttttttttttttttttttttgagacggagtctcgctctgtcgcctaggatggagtgcagtagtggcgcgatctcggctcactgcaagctccgcctcccgggttcacgccattctcctgcctcagcccgccgagcagctgggactacaggcgcccaccaccatgcccggctaattttttatatttttttttagtagagacggggtttcaccgtgttgacaggatggtcttgatctcctgacctcgtgatccgcccgtcttggcctcccagagtgttgggattacaggtgtgagccaccgtgcctggctgtcagtcatctctttaaccaactcacttccccaccaacccaatacccgctccaccaaccaaccaaccaaccagcatgtgttagctgtctgttgccagttagatattaagttaagtaggactttgaatatgaaatcattagtgtaaattctattctgttgtaaagtgaaaatgaattcatttctacattaagtgtagcattaacctaaactcttttctttggacatcaccccctccatttcacttgggggtaaaaaaggcattgagaccaattcaattcttccattaaaagctgtgctcttgtctgagttcctggaaaccccaagtaaccaagacctttcttcctcaatgaaatatatttttaatttctctaaggcaaggtggtgaattattcacagagccttgttcctctcctatttttacaacacaacattttaaaatatgcaaagctttggattgagatctggtgttggacagtaggccctaaatgttccctcagccctcagtgtggaggagtagagagaaggaaggcaaagagatttattgttgattgaacactatgtgccataaatgatgcaaagctcttcttacatcatcacttcattcattcacttatggaaaacatgttttttaagagcctcctctgcagtatgagagaagggaggtgggaagttgtagggaatgaaagagcaggctctagagtttgatcacctggcttctagtcctgcctccggctgttcaccagcttagtgttactgtattagtcagggttctctacagtgacggaactaataggatagatgtatatataaaggggattttattcaggaatattgactcacacgatcacaaggtcccataataggtcatctgcaagctgaggagcaaggaagcaagtccgagtcccaaagctgaagaacttggagtccgatgttcaaggagaggaaacatccagcaggggaaaaagatgtagcctgggaggctaagccagtctagtcttttcacattctgcctgctttcgttctagccacggtggcagctgattagattgtacccacacagatgatgggtgggtctgcctttcccagtccactgactcaaatgttaatctcctttggcaacaccctcacagacacacccaggaacaatactttgcatccttcaatccaatgaagttgacactcagtattaaccatcacagtcaccttggcaagtaactcaatcctctaagcctcagtttcctctttcctaaatagttacaatagtagtccttcatgcatattgcaaaaattaaataaaatcatctattgaaagtgcttagcacactgtctgacacttaacaaattgttgctatgttactactcttgttcttactattattgttgttacttaatggggctaagaaacttgggaatccagattaaggcccaattctgctactcactagatgagtgggagacactgagaaactcacttttctgtctgaatataaatttctttatctataaagaaggaggtgcaaataattttattcactgtaatttttttctaagaccactgtgttcattgagaaaaaatgctttgataaactcttcgacatgtcaggtaagttcacaaggggataatcaaatactaaaagatgcttcttaacctgtcacctatgagacaaataaatgtgtttgtttcactctttaggaagaggaaagaggaagggaaggctatgggaatggagaagcagaggtgatgggagggccaacaaataagagatttccatgggatctccagatttttggtgaaatctattaaactaataaaatacatcatgtgaatactcctatgaaggggggtgaagggaaaaacacacaagaaaacaggcatagaaattttccttagtccccctgatgaccatatcttggggctgcaggaaccaccttggagactgggtgcctgtgtgacacgtgtggttaagcttggatgtatgactatgcgtgcatggaagtacatctgtgtaaacagatgtgcacaaatgcctacctgtatagacagatgttcacaaagcctattcctgcttagatatgagttaatttatacatgagcatgtattcatgcacattgcacacacgtgtacacatcattcacatatatatggttgcaacatgtatatgtgtgtgtgtgtgtgtgtatgtgagcttgcacatgcatatgagcgtttgtattgcatggatgtctttttatacatgagggctcatcttttttgtttatttgtatattcactatttccctccctgcattttgggagaagtccccttgactaagaggaaggctgagaataaaatcccaggggctcagaaggaaaggaagagttatgtcccagagggctaaagtccagacacctcatctcctatctgggagcaaaatctcctattgactcaaaaagtaataggatcagcttccactcttcctcattccctttgagagtccccttttcttcacctctgaaacaaggtgctgcagtgaggtgaagtctcctggagaacagaaagactcagaaaaggcctatgtggggcgaagaggcaatttgcaggaatgcccaagggggaaagcaattctaaacagaacattctcttaataaacaagaaattaagccttaataatgcagcaagaagcccattaacccctcttgatctaaaggtttgcttctgccagttctcagtccagagggaaccgggcttgtttcaccttctccttcacaggcccctaagagagcctgagctgacacatggaacatttatttcctctgcctcatggctcaaactcttagcatattcacttgtttaacttttacctttccactcagctgtctgttcatctatacacccatccactcatctatctatctatctacttatccatcaactgataactgaacatctattcttcatcagaccctaggataagcattggaacattagaaaggtgaattggatggagtccttgttcccctgctccacttcccatggcccccagaactcaaagtctaattggatatagcatcagttttaagccaaatctattcaggttgctgtgggggccaaaggatagacaatcatgtattactacgtaacagtaaagcttctaggaaaactgcaaacgccaagtgctttaccatgaactcaactcaagccttggcctgtaaaacctgagagttattaatctagttcaggtaaggagtgaaggactaagggaaggcatcccagaagtgctgtcttaggtgatacctgaaggatgactataagttagccgggagaaaaacagaaaaatagaagtcctaacgacgagggaaaatggggcacatttgtacagggtagagcaaacacagagagcagcaaaagttatagctggagtgcccagatcatccaggccttgtggtccacattatctacaggatgcaggtgcccactctttctctggtctgcgttgcattctgtgcactcccttaccttggctattcacctggtatattaaaatgatctcctatgactctgtatccctagaccagcactagccaatagatatatgatgtcaccccaagtgtgagtcacataagctccttttaaattttcttgcagctacactgaaaaagacaaaaaggagaaatcaattgagaaaaaaaggacaaatcaattgaacaaacgtttttacactgttggtgggaacgtaaattagttcaaccattgtagaagagagtgtggtgattcctcaaagatctagaaccagaaataccatttgtcccagcaatcccattactgagtatgtatcaaaaggaatataaatcattctattacaaagatacatgcacacatatgttcattgcagcactattcacaatagcaaagacatagaatcaactcaaatgcctatcaatgatagactggataaagaaaatgtggtacatatacaccatggaatactatgcagcccgaaaaaagaatgagatcatatcctttgcagggacatgtatggagctggaagccattatcctcaccaaactaaggcaggaacagagaaccaaacaccacatgttctcacttagagctgaatgatgagaacacatggacacagggagggcaacaacacacactgggtcctgtcagaggggtagggtgggggagcgttaggaaaaatagctaatgcatgctgggtttaatacttaggtgatgggtttataggtgcagcaaaccaccatggcatacgtttgtttacctatgtaacaaaactgcacatcctgcacatgtaccccagaacttaaaaaaaaatttgcaccagtttgtgataatgtagcttcaggttttcaactgtttaccaaataaagcttcttagaatgaaaaaaaaaaaaagaaaaaagaaacatgcccttgttcacatagttgatagagaatagaggcagctccctggagcttcctttctggagttctggagaaacagttctttacccaaattaaaagtcatcatagttagcagtgttactgatctatgtgtgcatgtctaagaaaaacttaaaagaagaaaatgtataaatttttatatttgcatctaaatttatttaaacatgtctatcattcatccatttgcttccatccaaatatctctttctagctatccaccgttcatttatctattaagaaaagatcagggggaggggaaagagaaaaaggaaaggagaaagaaatgaaggggagatgggagagtagaggaaaaggaggaactgcatgataatgaggagacaaaggaggaggagaaaagaatgagaagagaatgtctatgccacatttgccattgtatagaagagactgaactttcttggaagaggggaagagggttttgttataagatgatgctggtgagaagcatgaagtcaattattaggggctggactttattgttgggggttttttaatgatccttgtcctaatgaagcctggtgtttacagccacctctagacagtttattttcattgtgcctttgatttttagaggcagaaggaaacatgggccacattggttggagatttaaggctgttttcagcatccaggtcccatccctgtcctctcacatgaaagctccacaaaccttcttatctacttttctttcccatccaggggaggaggctttgaccatgtatatggacaaaagtcgcctcgacaggaagtcagggaatgccactcaaagtgttgaagctctgcaccagctcgcatcatcctactttgttgaccgtgatggtaccatgaggaggcttcatgagatccagatatcaactggagcaatcaaggtacagctccggggtggatttgggcgacaggttctcaatacaacaacactgcaatgcaggcattctgagagtggatggacagatgtaatttctgggttcataaccatgtagctcgtgatgccctctgccagctgctttgactgatattgtcacataccctgtaattaatatcaatgtgcactgtcattccagtggccatatgtactgatttgctagagtattctggctgtagtcatggcataactatcaacagttctctcattcagtcttctgtatggagattatcagatcccctttctagagaagaaacagagactatgaagaggtaaatgattttcccgaggtctcagagatagcagcgattagattactgatgcctagctcagtaatattttaaacatctatgttttttattctttcctccccactcaccattttaaagatgggaaaactgaggctaaaggtttaaagcctttttctgagggttatacagttagagaataacttaacagggactagaactctgctctcaagaccagcagtcagcaaaagttttctgtacaagaccaaacaataattattttaggcatggtgggctgtatggcctgtgttgctattactcaaccctgctgttgtagcataaaagcagccatagatgatataaaaacaaatgggcatggctgtattccaatatgactatatttaccaaaacaggcactctgtggtttgctgatctaggctcgcctacaccagcaccgtccagtagtaccttctaagatggtggaaaggccctgtatctgtgctagccgagatagtagccactagtcacctggggttattgaacacctaaaatatggctaccaaggagctcattgtttaagtttattccattttagctaattaaaaattaaatggtcacattgagaaaagcagccctggactttcaattcagtgcttagagcacaggaactttaacaagattccattttaaacacaacaaattcagacagcctctataaagcgaatgtgggaggacatcctcgacataaaatgtttgctcttctgagggttttagtgcagatgtttccatctcaaatgttctttaaccagattatgcctgcattttacatctcagtctttactctaatttcttctaaagaaaatgcagacctagccttatattaagactttccaagatatctatagggaaaaacggtgaggataaggccaaggggtcttaccctgccaaggctggcagatgagtcagaaattgactaaggagagagaaaagtgtgggagggagagagttactgagcagggaggtagtaaggagagaaataaatcagaccaacaaacaaagggccagtttatccgaaaagaatcgcctgtatttgggagattatgttgttagggaactcagcacagagagatggatctttatgaagccatcggagtcagagtgctgcagaggcctggttttcattatcaccaaatggttctctcctcgctggatgggatgtggaattgagatattgaagctctgtcagaagataatcctccttcgtgtatcctagaagtgcagtctgcctccataggaggaatttctcagagaaattgcagaggccactcaagaaaccatttcttatggtaggcactgtcttctgcacttaatttggcccttggatttttcatgccatttcttgccactacctcaagaccaagctgtctaaaacttgtctcactattgggtctgtttttgttgttgttgttgtctttttgagatggagactcgctctgttacccaggctggagtgcaatggcatgatcttggctcactgcaacctccagttcccggtttcaagcgattctcctgcctcagcctcccaagtagctgggactacaggtgcgcgccaccatgcccagctaatttttgtatttttagtagagatagggtttcaccatgttggccaggatggtctcaatctcttgaccttgtaatccacccacctcagcctcccaaagtgctgggattacagtcatgaaccactgcagctggcctgggtctgtttaagaccagccactaacccgggcggagaagttttgcccattcaccattctccccagcagaggtatctttaggaaagtaaattggtaagttttactctctctcaataataaatatgttattatttttatataaaaataaattatttgtaaaacaaaacgaaaaatacaaaacctaattattccccatttactaaatatgactgcacccgaagtgctaaacccttcaaaaatataatctcttgaccctattttggtgactaatagcattactaacattttatagatggggaagttgaggcttagaaagagaaagttactgatccaaggtttcacagctggaaaagggcagagaaggtgcatgtggctgcctcccaagtcattgttccttacaatggatgctgtgtttttatagctgaatgcaaacttcaaaacaaccctaaataatgggaagcaaaggctaaataaatgaagaggcttcttttcatactaagccattcttatttcaaggttatctttttgaatagctgttcctctcttacccaccacctcaagtctttctaagacaatgttttggaaatgcacatccacaggattgggtcattttctcctgtggcagcacaatgcttcttgctaaaacttctttaggaaaatgggcatcgttttcttgttcttgcctaataatagtgtatatgtactcattataacttatagagccattttgtaataaggtacccattatggaacacatgccatgtgccaggcgtttagacccatcgtacctggtctcacaacctctctggaagagatttactagctttgatttgcagatacttagagaaattaattggcttccctaggtcccagggtaaatacatggcctaggcaggatttaacactattttttctgattccaaagccaatgcttttgaaatataatgtgtcaacttctaagttcatgtctacttgcagccaccgtgtgaagtgagaaccagtggtaggaacaggcatgcactctgtatgcttgaccaccctgcttacctgtctactcagtgacagctgtgcttggtcccagacacaagcacgaagctcagaaagtgaccattgactcaaaccaggaggccttttctgcaggctttgctctgctggggcatgactctttggggtatgtcctagacaaggactgctgtctcacacctatcttatttgatatctactgcaggtcacagagacacgcactgggcctctgggctgtaacagctatgacaatctggactctgtgagttccgtccttctgcaaagcacggagagcaaactgcaccttcaaggtaggaagccagtggaaaaagtggggtcagttgggggaaacatcatggatgtgatatgtgggagaggggatcaggagggatggagtgaagggagaataaagaagaggaagcatagaaaatctaatgaaaactgcaaatatggaaattagacagttatgataccgtgtatacatatatatttagaattttttaacatatgcaggacagtaaattcatgattattaattagttttcagatagtaaggaaatgtgagctttaattaatttgtatttataaatatctacatttctttggtgtctgtatatgctgtatatgtcaagtttatgtttggggctccatatacattattttaaagaaaatatatcctttaaaatagtaatttcatctttattaattcacatcataaaaaggagaggagattgcagggaaaagttggacaaggctttaagtacacatagcactgtttttaaaaagcataatgtattatatcaaaaaaagtaaggattttaatttttcacatgtgaagactaagtgaattatattgcattaatacaacataatattaaactggtactgatgtttataaagaatttccaataatatgtaaaaataatgtgatataatgttaataaataaaaggtttctgatggaatgggtggcatgatcttaataatttaaagagataataaaaataggcagggtgcagtggctcacacctgtaatcccagcactttgggaggctgaggtgggtggatcacgaggtcaggagtttaagtccagcctggccaatatggtgaagcccagtctctactaaaaatacaaaaattagctgggcgcggtggtgtgcgcctatagtccgagctattcagaaggatgaggcaggagaatcgtttgaacccaggaggccgaaattgcagtgaaccgagattgcgccactgcactccagcctaggcgacagagcaagactctgtctcagtactaataataataatggccaggcgcggtggctcatgcctataatcccagcactttgggaggccgaggcgggcggatcacgaggtcaggagattgagaccatcctggctaacgcggtgaaaccccgtctctactaaaaatacaaaaagttagccaagcgtggtggcaggcgcctgtagtcccagctactcgggaagctgaggtgggagaagggcatgaacccgggaggcagagtttacagtgagccaagatcatgcaccactacactccagcctgggcaacagagcaagactccacctcaaaataataataataataataataataataatgtagcaagaaaatatgcccaggtattagaagagcttacttctggatctctaggttaccgatgatgtattttaggcatctaatttcttttctaacttctctacaatgatcatgtattaactttagagtcagaaaaaaaaatgacatgctttaactttgagcagactaaaaatgtgaccttctagaaaggtatatgataaaggtgattctgaatgtcagtgggaggaagttgggttgagattggcaggtaaagctaagaggagactaatgtgacttttattttctggttccttttggcaactctttgattcatgctcccgttacagaaggtggttagaaaatatcttctgttttctaacatgcatggagggcttggtagtgtcacttgagggcagtgaatgaaaatccctcagggaaattcaggccaagaaagtggtttactattaaataacaaaacacaacacactagaaacttaaatacatggagcgtaaccctgccctctttagcagaaaaaagagtagacagaaaagagtagcagaaaaaagagtagacagaaaaaagagtagacagaaagatttactaatgcctgttaagaaagtagataagaaagacagatcttccttgtgtgtgccagggttttcaatgtgttagttcatgcgatacctgtagagactgtgtgaagtgggagccaggatttgaatccaggcagtgaagctccagtctgtgtttgatcaccctgctgtgcatactgagggtggaaagattgtgagttataattggaacagaaatagaaggaattaatgacatattcctaccaaggaaattactgagatcttagggacatttagaggttgatttacctgaagccaatgaagcttaaggttcaaggattctgcaccttccaagtacccaccttttctcattctaaatacacacttgatttcctatctaattttgaatttattttttaaataaaacagctagtgtataagacttatgttctccaaaatctagatctgccatgataacattattagaaggatgctgtgaatggaaagggtggtagcaggcctactgtcctaccctagatgggttagagtacacctggaggattggatccgtgtttgagcatcacactccaggagggatgttgagaaactgcagtttttcttgagaaagtgttttactatgataaatagtaaaagaaggttaaattgaagcaaaaattacttgctgcaggtatctaaaaggctgccttgcagaaaagataatcaatcccattaatattaataaaatggaccaatcccaatctagtaggaagggagaagttacaaggatcccagcttttaactcaatgtaaaatggatctttctagtacacatttatgaccaaatctggaatgatctgctgaaggatgcagtcactccctgttgtcagagaattataagtagattatatttggtgcaaatgttatagagattatttaagcatcagttaggttgggtgattgaggcaggtggttttaagttcttctcaacactgattctaggattttatgaaaatgatgaattataaaacctttattgagactaactacatgccaaagccaatactagaccccaggcatataatcataaatcagttcaagtcaacaaatatattttttgaagaactcatgttggtaatgagatagacaaaaaaaataaagtcgtgaacaagacagacattgtttctgccccaaggaaatatacattctattagagaagatgagcttcaaacaaacaagagtaggcataataaattttaatggagaaaaagtataaggtttatatggcacgagatagcatagggacttaacgtaccagggagtcaggaaagttttctgccaaaaagatatataggataagacctgaaggatgaataggaggacagaggcatggatagagaggcagacagaggatctttatgaaggggtattcaaagaaataagaaactcatgtgaaattaaagcacagacatcaatggtgagaaagacaagataatctttcaagtcctagaaggcttctgcagcacattaatgagttgaaagttaatttgagagcaatggataccatggaatggttttttaaaaagaagtagcatgaagagattgatattttagaagatcattctgactcttgtgtggacagttaattagagggggtggattagaggttggtgacatttagggggctactacagaactcaagaggaaatgccacggatttagaccatgggggtaccagttgagatggacagaaatggagcaatcccagagttacttaggaggcattatgacgaggatttagtgaaaagaccatatagaatttagacaattgggtgaatggcttgtggggatgagatagaaaggatagatgggcaagtatctatgactcaagataatatataacctaatagtcataataaaataagacatggcattatggggattcagaaaagggagtgattcattctgtctgttcagattcattctgtctagaggagtcataggaaaaaaaatatctgaggaagtatcatattctcctagtggaaggcaaaacaaaagtacttctaaaatataagacagattatctcatgatttttgagtgagctcatttttattcagtaggatgcaaaaaaacactaagtataagaaaaaaaggctaataaattggatacattaaaattataatttatgttcatcaaaatactattaatattataagaatatgagccatagagtggaagaaaatatttgtaatacatgtgcctgacaaagaacacttatagaatacagaatatacatatttttaaaacttctgaagtcaaaaagaaaaagggaaatagtcttgtaagaaaagaaaatgaatgaaagacatgaacaagcacttcacaaacaagagtgtcaaaatgccaaataaacacttaggtgctcaactctcctagtcaggaaaaaaagtgtaaattaaagtcacaatttaatataacacagcaatgagcatgactcaaatcaaaaagactgacaatatcaaggagggacaatgtgaagcaatgggaacttaggcacattgcttataggaacacaaattggtacaatcacttcggaaaattcttggcagtgtctacaaaagactgcacgtgtccttggtcaatgacccatcaatcctgactcctatgaaaacatgctcaccagaagacataaatgttcacagcaactctatttcaaataactccaactggaaacaacccaaatgtccatcaacaagaaaatggataaataaattgtcatacattcatacaatgagcttactatacagaaataagaaagaataaaccactgtttcatacaacaatatggaagaatcttacaaacacagcattgagtgaaacaagttagacgtaaatgagtacaggctgtgggattctattcctagatgggtgaaaaaaaagtaaaaacaaatacacggttttaggagtccagagagtgttaacctttagggagaggaatggggtagtggctgaaggggtgagagacatttctggggatattggtaatgttctgttttttaaatccggttggtaatacatggatgtgtttgctttgtgaaaattcaaaaagctgcacatgctttatttgtatgtatgcatttctgtgtatacaatacgtatctatttaggttttatttaataacatgtcccatgttgacatcctctgcaaagaaagaacatgaataaaggggagaggcatgggaaagtgggaggtggttcagcccagctggaggacaggctgcatgaactgaggttagaggagccaggaatgacaatagatattatttttttcagtgcttcctcatatgccagagattgtgctaatttatttttattagatttatttttgcttatttatgtatatttttaacttgtttttattttataattgtatttattatatttttaatcctcaacatgattcccatgaagaaggcataaataacattctcatttttgcaggtgaagaaaccagggcctagagaggttatttaataagtggctgaactgcagttttaactcagcctaacttcaagcttcttcaaatgtgtttcctctatatttctctcttcctcttctcattcctttgaatgaggctgggagggcagattctgcagaaggctactttggtggattgagaacaatatcaatggcactctaatgactttcaccttgtgatgtttcatgaaatgtttattaaaacaaggcaaacgtaaagcaaaatagaaaaaaaaaaagaaagaacaggattggaggagattagaaatgagaaagaaagcatcatgagaatgatcagaggctattagtagtcatagcagtaacagctcaaatagtggtaataacactaatggcataatgataacttcttattttcatacttctctttccaagaagcccattgaatgttttaccaacattgtcatgtaatttaatctagtatccatatggcgaagtatacagggagcaaagctgtgcctcagtagctccctgatgtggaaagggatgcagagagaatattttgctgaaatctgtggatgatacagaaatttattctttcatacatttactaatttatttatttagcaatatttacagagcaccaactgtatggtcaggtatgtttttaaagccagatatacagcagtgaataagataaatgaatcattttgagcttataattgatgtgtggatatggcaaaagcagacaataaataaaaaaacttctttataatcagagaaataatgaaggagcaggtcatgtagaaacttgtagaacatggcaaaaactttatatcagattttactctagatgcaatgagaagcaattgaaaatttaggcagagaagtaacttgacctgacttagattttaaatagataactacagctattaagtaagaaagactgtagagggcaagaacagttgtaggatatcagttgttaggaggctgtcatgtttatccaggtgagagaacacagtggcttagatcatgacagttgcaatgaaggtggtgagaggtgactgaatttatggatgaatttttaaggttagcctgacatgatttggtaatgaactcaaaagtatttgtgagagagagaagtcaaggatgaccccaaagttttgcctgagcaactacaatggtagaattgtcacattgctatgatgagactggtaaggaccagttttgatgggacatgtgaaaatgcgttcaaacctagttgagttggaacctacgtttgacaaatctattcgatatccaaatgtagatgttgagtggaagacatttgaaaggtaagaggagaaaactgaaaatataaattaggatataaatactatttaattatctgagattgaacaagattactttgggagagagggtagatagagaaaaaaaaattcagttattgtgccatggagaaattaatgttaaaagttgcgatgatagaatgatgatgaggaacaagaaaaggaagctggagagtggccagaaaagtaagaagagagacaagagagtatagaatcttggatgttatataaggaaagtttttcaaaacagagacagcagtaactgcgtcaaatactgctaatagtataattaaagtgaggactgagaactgaggatgatatttagcaacacatgggtcactgatgacaaaggatgttttcaatggaattctgggggtgaaattctggagcaaattcaagtgaaattcaagggcaaactctacagagtagtattatagtaaatggcacaatagcttaaggtgatcaggagtaaagtgatatttttcttttctttttaatatagaagcaacaaaacttttgtctaatgttgagaattattctgtagagagggaaaaattgatactgcaaaaatgggaggaatggttttacaatcaaagtggagcaggcaagagtgaatagggtcttgtgcataactggaattatttgccttagataggagcacatattcttggcagagagggaaaggagaacctgagatcagaggctagtacaatttgtacatgtgataatggagacattttcttgatctttatttcttgattgcctatcatagattttaaattgtatgatttttcagattttaatacctctgaaattagaatgctttttattattgatgatgtgtcttagtttaatttggcagggtattattttcttagtatacataaaacagtggtgtgttttatagtaaatatcatcttagatttgtagattcaatgtcataaggtatttcccctgaaaaattgagtgaggtcattagcttattcccaatttccaaaaggtaaggatgaatgcaaggaggatagagatcattaggagatgggagggtaggccagggaagggagatggggtcaaagaccactaacttgaggtatcgtctgccctctgcctgaatctccaacagggccacccgagacttgtgttttgagagccttctccaaatcttcacattcaaatggtctatctggtttcttggtcttaaatcatttatcttccttctcttcatcctcctcttttttcttcttcttcccatcttcttcctcttctttgaccttttctttttctatctctgcttgaaacctcagctccttctagactagaagatttcctatcactcatgcacccggactctcttcatgcctaaaatgacatcctcactctcttctattgaatgtggcccatctctcaatgccaagcacaaatgtcccctcatcagaatcattccttctccaccctctgccttggttcagctccttgtctcatcatctctcccttccccagatcagtacaatgagggtcaaagcagccttcttgttcagatctcactcctgctgatccgttgactcacagcagccagcgtgatcttcttaaagccaaatcagattctcgcttccctcctcacagcccttcacagcctccgtgaaagttttggtatacagtttagatttcttaacttaacaccaggctgttcaaatgcaagccttgccaatcttcttggctttgccttatgctatcacccaacatataccatatccatgctccagacccatgccatttcttacatttcactacaggcatcttttgaaaactattatttttatttttttattgccctgcacttttacacagcctttctccaattcctgaacttttcatctctctcaggtaagcttctctaaactcccctccccaggccattagatggtctgcacaacttcttctctaggagttgccacacaatagtatcatcatccttttattaatctgactctccaattgtcctagattcttgtttgataagaaccatctctctctctggcacaatacacagagactgatatatagacactgctcaaaagatagttgctgtacgactgtgtgaatgaatacatgaatgaatcactcagcccatagtgaactctgttttcttctttgaacccttacacttcttatcccacatgatactggattcagttcaacctaatgaccatttcctgagggcctactgtatgccattctctgtgctacattgcatgcacagcattcttcaaaagggcatgtgtttttgctattgctttggatgttacatcttccaggaagggtcataccattgaattctccaaatgccacctcttctgagaagcctcctggcttcttttgcttctctgaccttctacattatgaccattgtcactctctttcttatctaaggagatacaatgtagaatagtggtttcaagaaaaggccctggagtcaaacggaccttagttccagtactagttctaccatttgctggctgagaggtttcagataagttactgcagcctccgagcctctattactaacttacttcctatggttgttgtattatgcatgtaagaatatacattatgtctggcttagattaagcattaaaaaaagttaggtattatttttaccacctctatcaatgtgttacttgcaaaatatttgctttatttatatttgcatcctccatggcatatgtgcttggccaatatcaagtgctcattaaatatatgctgaatgaataaatgcagtgttccttacatagtcaggaactcagcaaatccttccacaaaaaccacagcaagtatttatggtgtgccaaatattaagaacaaccactgtgttagtcaaagtggaggatcacagtctaggggattaaaccaaatacatatacataaaaagtgtacttggcaacttcaaagataatctcagtttgatcagtttatttatgaatcaatcaagtaattaatatttttctcaatggatctttattcaatatacatcagttcacccctttgtattaatcttcccaagtcatagcctattaggactgacgcttgcctgaaatcactccatggtttccccacattcgtggggtcccaaattccctttctagcttcagttctaaagcccattggaacaatggaggtgggactttcctagaagaggcaatgataataaccaacacgcgcaatcacgcagattatctttcctccaactcaccctcttctttcccattcgtctttgctcagcagtatcctctaccagagataccttgcattcccatctctactcaatggcattctacatagtcctcaggaaccatttaaaatggtatcttgcatgcacacatgcacatacacaggactggattaaaatgtccctcctctcatcccattataactctttgattacccctcatttacagtatgatttttttttttattttactcaccttgcaacatattcatttatgtttagttttctatcttttctattagattagagtataggcctctttaaaggcaaagatttttccttgccaattttacatttcgtaatatttaatgtagtgccatgggcataggaattatatataatataattcctatgtgtgtgtgtatacacgtacatacatgtatttgctgaattgctgaattgagtttttgaatataattggtgctagactgacagtggaagataatgagataaggaagattaggaggaaggggaaaggaaagaaaggaagagaaagaagtgtggaaagagagaaagggaaggggaagtgaagaagggggtagagggagaggacagggcagagcaagaggagcagtctgatgaagagtagtgtcggtaatcccatttctcagtagctagacgtcacagatggagcgaagatgactattttcaaaatcatcttgcaacaaatagtagaaaaagaaagtgtaggagaaatgtttaaaaataacatttttttgagatgctatccttcttagacattgagcttataaccactagcccatttatccatcccaccaactaagagttagggatcatgctccccactatacagatgaagaaattgaggctcaaagaggatgaaaagacagagagtgaataggtctcctttttctaaagccccctcctctcccacacgcccatcactttatgtggacttgtaacctcagggtgatacactaagtgattgttgccagtacctggtctcagcagcagctttggggtgaatcatctttgttaggaattagtctagagtcacaagcaatggctcatgcctacagcctctcttgtccagttagcagggacctggaggcactaatgggaatttatgttcctggcttcctgtggctctgccgatgaggccctttcaatgaaagagcagtgcctttcgtgtcttcatgaaaaatgagattactgatttccacccagctagctgcatccaactgttgcttttactttatgaacataggagcaccttgttctatgctcgccagaggagaaggattcttctcaagaagaaagggattgaggatatcaatcaaagactcaatcagaaaccgaatagaatgaggaggatgggcagagaagatttaattagaaatcggatagaatgaggaggatgggcagagaagatttgccagtgataaagactagttaattaggcctctgagcttccttaggtcttttaatctgtaaaatgggaataagaacacatgtatctcagagctattgttcttcatttatttggaaatcacatagaaagcacctgatctaaaaaccaagagggttcataaaataagaatactaacaataacggctattatttgtgaataattatcatgtgccaggtatagagctcatttctttacatgaatatttcatgtaaacctcaacacagtcccatttttcagatttgaaaattgaagctcacagaagttaagtaactaccttttagagcaggaatttgaacccagatccactcagtgctggtattcttaaactctacataattttgcttcccaacctggggcatatatataatagtcatggtttttactagatcaggaatttatatagccctttccatgtgccagcaccataacctttctaggttctgctatttactttagacagtctgtgattttcctaaaattacttgccaacttgtgtaggtgtgaccgatttccataattattctcatattctgaaatggatctataaccggagaagacaaaaaaaaaccctagaatagatgatactaggctttgcagcaacccaggagtatatgactgtaaaaagagctgcttctgacctacagaaacctggaatctggagggaacttaaagactcagacttgggcaggaaggagtaaagaattctaagcaagcacaaactgatggggtataaactgatgctgagagaaggagtatcagggagttacttcttggtatgtagccatgtggggctataccattcaaataaacttgtggccaagtacgcagcatggaaatcgtgagagataaatggttgatgtggcaatttggtctatttaacaaccatgtcccattagattccttgtcgatctcattgattgtgcagaaatgaggcatcaggatggccaaaacctaaataagttacccatgataattagtttattgactccatggagatatggtgcctgtttattttttaagatgattgggccacttcttatcttcttcctaacaacttaccttagaattaagctctccttttgcactgtcaacaaagcatttttaatgtgcctctattatattccagatacattctgtcttgtcttatgtgtacaattgtacacgtctgccactaaattgtaactgagatcgctgagaggagaaaccatatgctttttcatttgttcattatttgcttctctttctcatagtgtttagcttatagtagatgctcaataaatgtttacggtttaaagttatttgaactgtcgaatcgatttgttttgaatcttatttgtttattgttgcaaaatatacacaacataaaatttaacactttaatcatttttaagtgttaaatttagcaacagtacattcacaatgttgtgcaaatatccttactatttctacaactttacacaacccccaaaacaaactctataccccctaagcagttattctctatttccccttcccttcagcccctgataactactaatctgctttctgcctctatagatttgcctattctggttgcagtctgccctctatacccttgagttccatatccgtgggttctgggtctgtggcttcaaccaaccagatagagactatttaaaaattaataataataatacaacaataaaaagtacaaaaagttagtacagtgtaacagcagttacatagcatttacattgtattaagtatcataagtaatctagggattatttaaagtataaaaaaggatatgtggagcgtatatgcaaatactatgctattttatataagggacttgagcattcatggattttggtatcagagggtggtgggagggtgggattctaggaccaatcccctgcagataccaagggataactgtatttcaaatcaatggaatcatacaatatgtggtattttgtgtctggcttcctccattttacattttcaaggttcatctatgttgtagcatgtatcagtacttcattccgttttatggcagaattaatacttcattgtatacatatactacattttagtttttcatttattggtcaatggacatttagggttgtttccacctttgactactatgaatagtgctgctatgaacattcatttacaagttttcatttgaatgcttgtctacagttcttttgaatatatacttaagagtaaaattgctgaatcatatggtaattaaattaaaaaaagatttggtgtaaaaataagtgtattttgtggcagatttcattattacattattgttcgtttcctctaagaggattatatacatacagtgcatttccatgtgactggcagcactgcactgtgggaggctctgtgactttccattttagtgacattggccttgtccatgtgatttgctttggacaatggaatgtgagagacatggtacatgacacatttgggcaagacactttaggagacattgtctggcatggcttttgctcttttccctttatcataagaatggcatattcctgaaaaaaggctgcacctttagcctacatctgaaatgaagaagacatctggagcagagccaaagcacagctgacacgaaatatgagcaacaaatcaacctttgtggttataagccactgggattttgaggttattcgttaccacacagtaatttagcaaaagtgccctaatattaaaacactggattaaataacataaaccacatttatttactgcaggacttctcagtgtcttgactgtgctaatatgtattatgagtctaaagaggtgaattaagtacagagttttctgaatgtatttgggtttgggcatatttgcagatttgtgattctgtggcatacaacttggcaaatgctggaccatatatactattcaggttcaatcctgtacaaaatgactttcccaaactcctctactattataaaagttagagaggtcttcttttttgttcctatgcaaactcgtgcatatgtatgcatatattttattgtcattttacatttataaatctttttctagtgccaaactagagccccatgaggccataaaccatgtcatattcactttttgtatctctagcatccagtatagaactggcttaataaagtggtaaatgaaaggactttcttaatagatgttcaattgagtactttaatttttgcatacctactatgatctagcactgggcttgttaccttggaaagaatgcaaaaaaaagagataaagttattgtcctcaagaatcataatctatagcaatggatccataacaaattatttgctgaagttagtggccaagtcttttagcaccattgttctcttaagaatatctttgtgcctatgtatttttttactcagatctttctgagcacatgtctgtaactactgagatgaaatttaaaaagcctcgtgtctcaagctgtaatattgtgaaagaagatacaggttttgctaatgagggatggctgtagagatggggcatgctaaacatagaagacagaaccacagtcctctctgaaacacattctgtctaaaattgccttcattcaaacacgtactctgggtactcaatactgtgctagatgacagggaaatggtagatgaatgagctgtgttttgcattcaggaagcttatagagtaggagagacatgaacatgagcacacatatgatactgtaagtgtcccattgggatttgaaatatgtgcaaggtgcttttggttgccagcagagagactacctgagaccacataagacttctggagaaaggaatagaaaacagggcaaggtcagaaaataatgtcacttaaacaactaccctgtactaagagctccacaagtgctatttatgttattttattttcaggttcattgacatataatttacatacagccaaatatacccttttgaggtggactcttctatgaatttgacaagcatattcagttatgtaacccccaccacaatcaagatataaaatagctcatttaatttttacactagctttatgaaagaagctttgataagaaaactggggatcagagaagttaagcctcttagcttcttcaaggtcaaacagttagtgagagctgaaggcaaaatgtgaacaggagagaacttggcatgcttggagaacagagataatggtatggcaggatataacaagaaaaagaagggagatgggtaagagaataatttgaagacatcagctgatccagggatcaggtagcacagactcttacaggtaccaaatttggtttgtatcatgacttctgtgaagaagcttatatttaaattgaaccaacctcttcttaaagcttcaagaacatgttcatgttgaaattttatgaaattgaaaaaaaaagtatgctggcttccttatccttggtgatttcataaattaagctatattatctttttttgaagttaaaattctcatttggaagtccctctggcccaacccctctaatcagtataaatcctttctatttttatttatttatttgttgtcttatctccctcactacaaggtaggttccatgacagcaaggattgtgtccttgcctttcctagttccttgtcttttctctagaacctagaacagtgtctgcacatgatggatgccttattgatctttgcttgacaaatgaataaacaacagcacagagcagaatcatagaaaagtcaggttggaaaaaatcttgatggtcatctagtagaagagttggcaaactttttctgttaggaaccagataattaatattttaggctttgtgggccgcatgttctctgtagcaactgctcaactcttttatctgcatggctgtgttccagtaaaatttgtttataaaaatagactgcaggtcaatttggctatagtttgtcaactcctgtatctgttagtataagctaggttatgctgtgctaacaaacaattcctgaatctcagtgatttgccaaagtgaatgcttatttcttccttatgctacatggtggtcacagtactactgtgattctgctcctccgatggcccctatctggaacattgttggacttgtaaaaagagagattgatgagctcatatgttgttttctatagctttgtttggaaaagacacacatcactcgcactcatatttcattggccaaaacatgtcatgtgaacttgtttaagtttggagagtggggatgtgtagttatctctaagaggggacattataagaaggagcactgaatgtgggtcaatgataacccaccctaccacctgccatctgaatctttgatggaaccaagatttgtttgtgccatgtcacctttcaaactctgcttccacacttccagtgttggggagtcctctgctaccaaagcaacctgcttcatcctttgaaacgtctgattgctgaaaaggtgattttattgtgctgaattccatatacctgtatctttcacctaaggattccaaatcttcttaagatcctgcagagcagatgattttatttacaaacacaaaagattactctaaccaggaggggacatttccgaattcttatatcaaggaagcaggaacccactcaccaacccccaggtatctgcctttcctcattttccagagtgtaaatgacccatcatggagacagagctgaacttctgaatgagatcatagccttttcgccctttctgcacagtttcacccggtgaattattgtcttattttcattccactccaatgagctgtcagcgatggatactgtaattcacagcaatagaaacacaaacagatgggtaattgacctgcatgccttcattacactggagttcagcatggctgttggagccataaagtcctttatctgccagtctgaaatccctgggctttcacaaggaaggggatcaggctgactttttgcaaaaggtgcagtccttgctgttgttctcctcaccttgtgcatttcggaaatggacagaatttgacaagcagaacttagtggtacaagacaacagctggggctcctataaagctcagagatatctacagggggcacattctgatacaagaacaggatagaaaaatatttatattcaactaaaatagaacctgtgttttttccttcttcccttggcactgtaagaaatcgtgtatttaatatctaatgaaataggtcagaaaagagcaaatccatcaaaaataccactgtattaggtaattaggatatagaataaaacaaaataaagcttaccaaaaacaacctatgacaatgcatggtctttgccttgcataagaaaggcttagattgacccaaattatgccctctgctatggcatactgagttcactttctttatctacctattcagaccatgctcatgtttcaagattcagcccacatcccacagccattacaaagtcttccatattcattatttccaggcctattttctttcgtcttcataatagatcactgacttattcaatacttgaaatacatttataaaaacctactatgtgccagacacaatactacttttaatgttttaatcatcaatcaaggactttctttcccgttcttgaattttttttttgctttagttttcaatatctgagtaacctctctgtttctttaggaggtgggaagcatgcattaaacctcttatttcctccaacaattcctaatgtactacttgttaaaaggagaaacaagctgagttcctgtcagcaaaagagcagaatcaaagtcagcgatgaagattgggctataatcttcaggtcttaggttcaccttcagcttctgttgattggatcttctttcccagttatcttttccagatattcttctttccccagcctcacagagcatggtcagttgatccaagtgcctgctagcaatatcatcaatgttgttgaaggtctccagagatccaacttgagggtcccctaaagttcttctgttacttgagtactcccagtggttgaaactcaataacacagtgagccccatttttttcctgagtctcagaatcccatcttataatgaataaagatctttcttgtactataagaaatgctatttcctctaaggagctcacagatttctgctttgtgtcacccttcccttcaaaattttgatctcttgtgtgcaagtactctttcttttcttttctagggaacttgtaagcaaacaaacaaaagaagacgaaccttagtcagaaagaaatgtgagggccaagttgattctcagctggaaggagttctatgcccgtggccttttccatgctcttcccgctgtctagactactctttctgtggatccctcatcccctagtgcccttgtatccattaggtctcagcttaaatgctaccccctaggagagtggagagtgcttttaacacccctaatccagtccatgctgagttcattgttctttccctgtgttccctgaaaaacttgtacttctcatagaatactggtttcattgcatccaagcaactagtttacatctctttctctctctctctctctctctctctctctctctctctctctctctcagtaaacagtaagacctacaacaagagggagttgtctgcctcattcaccctagtatccacagcacagctgcctggcacatagtagggcttcaggaatatgtgtgaaagaagggaagcagaaagatgggaagaaagaaaggaaagataaatgggaagaaggaaggagggaagaaaatgaggaaagaaggaaaacaggaaggaaggaaggaaaattaatagaagaaaaatgatggagtgattaaaaacgaagaccaataataattattttaatcctcatataagaaaatgcattcttagcatgttttatactggctcaaatggtgctattcaaggaggatttttcaagaagggttcaagtttggtccaggtaatgaatgtgatctgatatctagttaaatggggggcaacctaacatttgttgaacacttaattatgacagtgtcttggtctgctcaggctgctgtaacaaaatttcacagactgggtggcttacacaaaaggaaattatttgtcacaggtctggatgctgggaagtctaagatcaagtaccagcagatatggtgtctggtgagggagggactgcttcctggcttgtagacagctacaagctgtctcttctcccatctcttccttttcttataagggcactagtcccatcacaagggcaccacccacatgacctcatctaaacctaatgactttcctaagtttccggcttcttataccatggcattgcaagtgagggttttggcatatgaatgtatgtatgcaggggacagggagcgcaaacatgcagtccatggcagccgagttgtggcttaagtttatgccttttctctctttgttagtatacaaggagattggggtttcaacctcatagccaaaaaaaaaaaaaaaaaaatccctgagtttcagggggtataaaacattgccagaggtctcaactgtgctggagccaccacaggggttgtaagccaggtcaccctcgagtgtgtcagaactcaagttgaattcctagattggagtcctggttctgttaccttagttgtgagactttggccaggtcacctgatttttaaattctaacacctcagaagcctcgtgaggcactttcttttcatcttggagaaggaagcgtttaaagttcaaagtcaacacttcctccttgcaggaggaagtgtttaaagttcaaagttcctttgactgttagggtgcagtggcttatgcctgtaatcccagcactttgggaggccgaggcaagtggatcatgaggtcaagagctcaaaaccatcctgaccaacatgttgaaaccctactcgggaggctgaggtaggagaatcgcttgaacccgggaggcggaggttgcagtgacctgagattgtgccactgcactccagcctggtgacagagtgagactcggtctcaaaaaaaaaaaaaaaaaaatatttatttgatcaacaaatgagtgcctggagcctacactgggcttgaccttagtttatactctgggggcccttagagggcagacaggtcccttcttccctagagcctactctctaatggggatgatagaaaaactattagaaataaaacaaattcaaaagataatttcagccaggaattaatcctatgaaaaaaattgaagatgccttttaacctgggtctgggagggtctggattataggacaagggatcaagcagaaatctgaggagagaatattcggtgcacagggaaacgcaagtgcaaagattatgggaggaacaatattgatgtgtgtattgcaggtactgaaaaaaaggcagggtttttctgatgtattctcagtacagaagagaatattaggagataagaggaaggagggaggcaaggaaatagagatatcccatcatgtgacacagagaaagagaaataatatctcagcacacaaagactgtatacaagctacaaaaaatattgtgagatgcacctgtcgaaggtgaattgaaaggaaaaagaatgaggcacaaatcaggaaaagagaaggaagacatcttgggtgttcccacatatacattgcccacatgctctgcagaacagtgaaacattccattttaaattataacaagattattttaatatataaaaagattgggagaaaaatattccatatgttcagtgtgggtgagttgatgttcaaataaaactctcaactattgcctgcctgggttttctaaggcaaaatttatatgcttggcaataacagtagcccttttctctctcattttctcagttttcttttctctctctctctttctctccgtgtgtgtgtgtgtgtgtctgtgtgtctgtgtgttgtgtctttgggaactgtggggacagaatatttcaccccagccggcagctgtatatctttcaaacagtggtttcacaagccaaatccccctccaaattatttatggttcccattgaagcaggcaggattcaggcgcccatgtaggagttcagcactgggcctctttgttggacacaggccatcaggagacgactctgtctgtgactgctgtgtgaacctccgctgccgtagaaatggttatgtaactttaaacagtaatgacattttacagaaaagtgctttttaattgctatgtcttcattgttctctttcgaaattgcccaggagattctgcctccaagacagctcggcatgttctgagtttccatttttaaagagcagccagttttgtattttagctgctcccagaaaacccccaaccccaaacttcatctgttttcagttgcattaaatggggtaggtaatactgccttttgtatccttgccaaatggaaaaatgatttgacgcaattttctataaatgctctccccaaattccttttgggctgggaccaagaatagaatattttatcccctacagaagggagaaagaaaatgatgagcaagctagaaaaatagaactgagaatatagtctgtagagttcctttaagcaacagaaacttaaccccgatccatacacccagttgcctatgggggattgggatcagctaaaaataaatttggctctagaagagaaaatggtgatatagataaaatgactaaaagaattgtagactcagaaagaattgcacactctgaaagaattgtagactcagttcagaagggactttattcttgatttgttttacctcacgttttggtatgtgtgttatgcccttgtacagtagccctcccaaacagtcactcaaacccatacggactcattgctcatcaatgtggagctcactcagtctcacagcagcccgttgttcaactgtatagcttaatctgctagaatcccttccatgcatattgacatatacacctttctcaacagccctgtcaccaatgctggttcaacaggcacagaattctaaaccctcctgcttatcaaagctctgcaaatatgtgaagactgccttttgattatacacccacacctgtttttctttcattaatcctgaaggttttgttaaacctttaaccactttaatcagaggagtggcatcatcatcaatatcgtcatcgtcatcacatcaaaaataagaacagacaacatttattgtttgcttgctatgtgccaggagcttttccagataatttgtaggcattctttcatgtagtcctctcaataatctttgtacatagatactaagtggaacctaacaggcaggctgaatattttgcttgagatgacttaggtagtaagaagaggagccagtgcagccctgcccaggtttttgaccacaccgtgcagtgcagccatgcccaggtttctgactacagcatgcagtgcagccatgcccaggtttttgactacagcgtgtggtgtcctgccataaggcatgctggaggaatcatcttctttcccacaatgtccctctgaaaatattctcttttagctgccatgtgaagacaggttgaaaggatggggcttatttaagtatatataaaacctgaagaaaatggaaaaaagataaaaatctagaaacaactgtgaatagaaaatggaagaaatgctgaccttgttgagcaaatccctgatgagttggattaaggagtgtccctgaagcataaatgagaaaaaaaataatccaaataagaatacagttctcttttacacagtgagtagtagaaccattacctcatattggaagctaaaactgtttgcagctccaaatgaggtggagagaaatgtcctaagcgaaagtgccctaatgaattaagttagcccagatctgtccttctctctgggcaccacagacaatagaccactctgctgacttttcataggtaccagagtagtgctcatgtccaaataaatccttctctatcattggctctctgtattaagactttgaatattcaagtataaagagaggatcatgagatgtaatccagagtgctaatcctgtaaccatgggctggtcacttcctattggtagaccatggcttcctcactgttagagcaaagaagagaaaattaattatctagtgatgcttgtgtctagtgatgtgttagtttttatgttacagtggtcctattaaattatatcactctaattatgttactcgtacccttcaaaactaccaatgtgtacctatgatccacagaataatgtccaaattccctagcatataataaagccctttgcacactggcctctgtccctctctacagctattttctacagcacgagcacctccattcatccaagttcatttcttcactaggaatttccagacacatgatgcctttcctcttttaagaatgtccttcctgttcttcttttaacctagtgttctcttacttgcttttcaaccagcccaaattctgtctcctctatgaaggtttccctgctatctaaacaatgttatttgcagtcttctgctgttcatttgcctcatatggctctctctgctataggtctataaagccatgttatgatgatgtgcgtccatgtctacacctgctgattatattgtaaactccccaagggcaaggattgtgtcttttttttttttttatctctacaggcctagtgcctagctcagaacttgtgtttcataaatagggtttatataaatacttaaggaaagcacttgaggaaataaagaataataaacaataatgttatattttcaataagagttttctccacaaatggaaaaggtatataccatatgtggctctagcctcagtcctactataacagaatagagtatgcctttcagagatggccaaagtcatgacctgagaagtttaagtaaaagtgatgcaactggaagcctcaccaataataccctgtctggatctaggttggcccagaaatatattggttccaatacacagggagaaatgtagcagcttcagattcctatgtatcacctttggaaattgttaatgaaacacctttttttaaacctttctgttttcccttcttgctattctcacacaggtcttcagataatctttcctcagtatctgcaagagaagtttgtccagtcggccttgagctatatcatgtgcaatggggagggggagtacctgtgccagaacagccagtgtcgctgccaatgtgccgaggagtttccgcagtgcaactgccccatcacggacatccagatcatggagtacacgctggccaacatggccaagtcttgggccgaagcttataaggacctggagaattcaggtagagagtctcactcagtgccactgcatgagtggccttgagccaagtctgaaagggagctaatctaactggaattaggactgctgcaagggaaagttcagtgaccctgaccctttcactttggagtgtccagatgcaagtataatagctgtcacagagcaggcactcaataaatctcaactgaataaaattaatgaatagcataatccagtttgtggtcatatgatgtattgtttctgtcgtacccagaagacagaaagaataaatctgcataggaagcctctggagagggaagagtcagaggtagttgtattgattccttgggctgtgtatgtgtgtgtggatatttgtgtgtgtatgtgtttgtgtgtgcacccacacacttctgtccatctctataactagataaacatacctctatgtgtatatttatatgtgcatatgcatagagatatagatatccaaagaatctacagactatcaaagctcaaagtctcttttctggtatcttagttattttctgcctttcatagttcagaaaaatgagtttcaggggtggaaagacagtcatccaagctcctaaagtggatgaagtctgaagtaggatctctaccttcatggacatttgagttttgttggaaagccaggcattaattatgtaaccatgccaatgattaggaaatgtcaaggatacgtctgtaaaaagggaggagttgctgtgaacaaacgatgtagagttgggggtcaatgtggtcaaggaagtctaccttaaaaaagaacagaaatggaagtatctgactatggtgcagatatgagaaggtgattacaggtagaccaatgggaggcacaaagggcctaggagagagatgaccatgatgtgggttaaggagatggtacaagttgtaaaaactggaaatgtgcagatatgccaacatatttagaaggaaaaaatggcagagcttgatgttagattgtctacaagagttgaagagaaaagggatattgaggtgatactcataaacctcctttagataggcatgttagacaacttgatagatgttgatatctttcattgagctagaacaccctgaaagatttggaaagaagaccatgtgctcacttttctataggataagcttgagaatccttgagacttccaagaagagatgccaagcaggtacttaacatataatatgtgctcaagtacctgttaaataaatggactcatgcaaaaaagcattcctgtctttacaacaacattatatttcttaaatctgttataatagccaccttaaaggaagtactaacatttctgaattacagagaagggaacacctcctctataatcctcctgcaagacccagtgttttccctagggttgcacagttagtaaatggcaggattggtaatggaattcctgattccaaatctagtgctcacagcagatttggtaacttaattttactttgtcccccaggcctgaggttccctcatctgataaatgagaagacatgtttgtgtttttaatatttgagtttattcaagtctttagacaagaaattatttgatcaagcaaaatcttacctaggagccactgtgtaccacagataaaagcagagttctatggaatagcatttgaaaataactggtttctgtgaactctaagccctaacccagctctgggagcccagaatgcatcagggatcctgctcctacagtgctgtacagctcaaatggaactgtggatgccttataacgacacccattagtccactgaaaatcctgggagcccataaaagagaaaagttcatgatggaaatgtactatgatgattatttggccccaaacaaaggaagcatttgataaaatgcttttgcagaaagatttggctgattactacaaaaaacaaaaacaaacaaaaaaaaaacagagggaatttaggctatatgcacaaggagtaagactctttagcatacaatccttattcccaaggaaaagaaaccactttaagtggatggatgaggaaacacagaaaactgagatgctgctgaataagctgaacaggccaagaaaatgatttatgtcacactttctccccaaaaggcatacactccctctagatctcctgtgcttctctatttgaaatggttttaccctttaagacaaatccattcatccgtatgtgcatcacagccttgtgcatatgagttttcctttggtccatttttagcccttaaccttcgctactcagcccaggtgatttggagagattaatgaccagcccaaagtaaaagccattggttccttgatggctccagagtgtgggtggccaaatagggcctagtttctatacataaatggcagtctacatctccttgctaggggattcgttgtagtacttctacttttattcaagaaagttggccaggtgcagtggctcatgcctgtaatcccagcactttgggagaccaagaagggcggatcacctgaggtcaggagttcgagaccagcctgaccaatatgatgaaaccctgtctctactaaaactacaaaattagccgggtgtggcggcacatgcctgtaatcccagctactggggaggctgaggcaggagaatcgcttgaacctgggaggcagaggttgcagtgagctgagatagtgccatttcactccagcctgggcaataagagtggaactgtgtctcaaaaaataaataaataaataaataaataaataaataaataaataaataaagttaatgtatttaactcttaaattctattttcttatcagacccaaatttgggttcattgaaggcctgctttcccctttgacatccacggagccctctgcaagataagctttatgttttccatgagaggagagtctagctgtcccaaacagaacagagtcatcagggcctgtctcctgccttcagccagctcactgagtcaatcaatcagtgtagagtcttgtgtcatcctgtcaatcttatgctaccatcaaccgagtactttctgtgtctcaggaactagttaggtagatgcagtcctatgccactatgtcattctcagcatttggattagatactattattcctgttagcagatggggaaactgacgccttgagagaataagggtcccacagctgttcagcactcaagatgtgactccaactcttgcctgtctaactgtctataattaaatgcctgagttttttctaggagtcagagacttctattttttatcaccttttatttactgttttctcctaatgtactgagcctcgggattgccctttttatgtgtcgagaggaaatataatatactaagtaagaacacaggatttggagccagactcaagtcttaattctcctatctactggccatttgaccttgggcaacttctctgtgccctattttctttaaaatgggggctctaaaatacctacctcataggtttgctataaaatatggttatatatgttaggtgattaggactgtgcctggtgcctgtcaagagctatgtaagcattttttaaaataaaatgaaagcataaatgcatagtatacctaaaatgtccttggagcttttataacatgaagtgaaaagtgttaggctgaagatttataatatttatataaatccaaccattggccttttttcctacaaaatgatcaaccccttgatatttttaattttccagggatggggtgatagggattagaattacaacagattggattattagattggaaaacagaaactcaggacacagacctggatcttgtcatttatcagccacgttacctttaagaaatcatcttcccattttgggcttcagttttcctattcatagaacaaaagagctgaactagataatttctatggatgtgccaagttgacactctgaaactcagcatcacaaactgaggcagaaacttttacctgggaggcccaagagtttgtcaccatctcttaagctggagttttttgaaatgtgagttgatgctagatgggacacccatacaacttcaaacaacactggatcaccgggtggggaagttgatccatttcagttctctgtggaacctgcagattacatcaaaaagtttcagtttggtgctagcatgcctttaacacctaacacttgctaattgcctgcatttcaacatgagagcagtcatggaggtttgatttttttagcaggcaacagtgtctgactagaatttattaacattatcttcaacatatttatttttatagctaccatcttctgaaggcatgcaatagtgattttctttggagaattcaataaacattttgttttccttttttttttaatttttttgagacagagtcttgctctgttgcccaggctggagtgcagtggtgcagtctcagctcacttgacctctgcctcccgggttcaagcgattctcctgcctcagcctcccgagtagctgggattacaggcacctgccaccacgcctggttaatttttatatttttagtagagatggtttcgccatgttggccaggctggtctagaactcctggcctgttatccacccgccttggcctcccaaagtcctgggattacaggtgtgagccactgcacccaaccttgttttcaatttttaagtgaaaaacaatgatttgattcaaataacatgttaagtaaatgtaataatatacgaatattactatgaggttggtattccgacgccagaagtttgggaagccctgtcttaagcaagaatgcggtatgcagattcccttcataagaaagcatagtagcttttgccctttctagtaggggcaggacagactaatgcaatgttctatggcccttaagaaaaaaaaattatgtttgcaggcctggtttattggaaagtgacactaagcattcaaggccactttagatgggtgttatcatgcttagcccttctctctcggcctttgtctctcactagatgagtttaaatcatttatgaagcgcctccccagcaaccacttcctgaccatcggaagcatccatcagcactggggcaatgactgggacctgcagaaccgctacaagctcctgcagagtgccacggaggcacagagacaaaagatccaacgcactgcccgcaagcttttcggcctcagtgtacgctgtcgccacaatcccaaccaccagctgcctagagagaggtaagtgttgccaccacctccacctctgcaggcacctacctggcgttagctacattatcttgctgcagagtgaaatgcaatgcagatggtgcatttgtggggtggcaaacaggacctcgcatggtccagaccaacaattttctggattgcctctgggtcctcacctactggctccacattgtttcagattccacattgtttcctgaatgtaccatgaattttcagcctctgtgttctgtctgattcacctgattgaggaggggaacactagccctgatagttatgtggcattatcctggctgttaaaaatatatttcatatttaattttaaaattactgagcaaagccaattttagcatccccatcttaatggtgaaaaaactggattaactaattaatcattcgccaccttatttatgaggtcctttgagcagagccaggagtgagtgacacaaataacaaaatgtaatacaaaatgtcaggagacacttgcggggtcattgagtgcagggtcctcacctgagagagtgtcaccttcagtgcctggctaccttgcttgcctcccctagttccagccatgtcctggatataccgggtattctgctagatggtggagaatacagagatggacaagacagggcccatgcctccatagaattagggtttactactctctcaggggcacagaaggaaggagccaggacttgaatccaggttttttggactctattcttccggggcatttctgatctgcagctggtagttcctactgtagaggtgcctccagggtttctaaaagggcatcacaagacagcaaaagggcaggttggggctctctctccaccctgcttcagacagagcagctctgctcttatttgttgcatatttgggggttctaccttcaatttagttctaagaaaaagatccactcttaaaaagaacaagtccattcacattcacctagcataccctgtgtcagtcacatatttatatatatgattgttaccctgttgtacaaatctggaaatggaagctgagagaggtcaagtaatttgtccaaagctacagtgtaaatcagtggttctcacttgggggtgacgttttccccaggggacatttgaaaatatctcaagacaattttgagtatcgtagcaagggttaggggtattattgcacaggcagttctcacaacaaagaaatatgtgacttcaaaagttgctggtgctcaggcttagcaattctgatgtaagagagacaagatgccagctattttaggttgatgcaaaagtcatcgtggtttttgccattattttttaagttttgccattacttttaagtaacagcaaaaaccacgatgacttttgaaccaactttaataaatctataaatcaaaatcttatcttcctaactagtctgttctactggcactcaacatttaacaacggcagtcttctaccacagtccatccacctaattaccccgatgaggtgcacccttttttctctcgtttttcttgcgtcagagctaatgctgctattccctccatgaagtctttcctgattgtactagccaatacagaaagcttcttattctagattcccactaatctaaaatcctttccttagcatatttctctctctttccccccttatgaaacctcctccttgtacagacattcaaactcatctctgttttccctattccctccaaatttgagcccactgctttgcatctagcttgtgataattatattgttttgtggatcaaatagaatttcttttgccagtttcttgttgcaatgctgctgaagcagggactagaaaaggtcacaaacttactttcttgtcgagcacaacagatgctcagactgctaccacgagcaagtctctgaagaagcttccttttagatccatcacacatctgccatgagacctgcatcgagcactgtgggaaattcagaaatgcacacagcgaacagtgctgtggaagatgtcttgtagagcaggagtggggaggggttcttttatcaatcagaccccatatgtattagtttatgatggttgccataactaagtaccatggactcagttgcttaaacaatagaaatttattttctcatagttctggaggccagaagtccaagatcaaggtgtcagcaggcttggtttcttctgaggcccctttttctggcttgtggatggttgtttttttctacctgtgtttccacgtagtctttcctctgtgtgcatctgcgtcctaatatcctctctctctctcttttttttttttttttttttttgagatggagtctcgctttgttgcccaggctagagtgcagtgtcgctatcttggttcactgcaacctccgtctcccaggttcaagcgattctcctgctcagcctccccttgcgagtagctgggattacaggtgtgcaccaccacacccagctaatttttgtatttttagtagagacggagttttgccgtatgggccaggctggtctcaaactcttggcgtcaggtgatccacccacctcagcctcccaaagtgctaggattatagatatgagccaccatgccctgtgctaatatcctctcttaagaggataccagttatattggattagagctgacctaaatggcctcatgttaacttaattaccactttaaagaccctgtctccaaacacagtcacagtttgagatcctgggggctaggactttaacatataagtttggaggggtatgtaattcagcccagaatattataggaggtagcttttgatcagatctttaggtgaaaaagctgtgcatcccaaggagcaacgaagctcgatgcaaatctgattgaggagggccatgtttgaccatgataagaattcaaacaaataacctctttcagttacggtgattgtcatctcagaaaatggagagtaagatccaaaggtcccaaagacattaggcaggcatatttattaaagttgagtgaaatctccagaacaccaagcatcatcagatatgctaagttcaagggaagactcgagaggattttagaaggagggtagctggataggtattacaagggaagaaggagggacaaagctgggtaataggagtaacactgggaaaagtcaaggagtctggatttgtcctaccactagtaagctgtgtgtccttgggcaagtcacttcaccatgctcagtgcaggtgtctgcatctttgaataagtctctgctctccttctgcaagtcgtcaggtgtaaatagctaaaaatgctctaccatcatgggaccttcaaagaaagagctcacagtgttgccgtctctcctactaaggaggagaaaacctgccctaatcatcatattcttctcacctggagaggatgtctggcgttccaccattagcaggtcactcaattatattaatttgaggaattttgagtgctaggtaccgaggggtaggagcacacagacactaggctctgtggctaattcctctgaagccttcccaggagagatgaacttccttggacgggctgtgggctgcttcctgacatctgaatctgaggctttaatgagtatttctcacaccgcagggcacctctctggcatggagcagtgtcggacagaggtgctaacactgggaaccttgggccacctctagctgagcaagctggtatttgcaaatgaactgattgcatggtttcaatgtgtctgcttgctgaagtctgtggaagatgagtgtgctgagcaggtgccattactgcagcaggtgccacagagatgtttacttgtctcacaaacaggtggctttgttaaggtaaggtgggagagggaaagagggaacaagcacagggccttagccacacatggactggtccgaatcctggctccatcacttaccagacacagagctttatgtaagtcctgcacctcatttgtgaaaggggataataacacttgccttcaggttaagtgtgatgattaagattttaaaatttaaataaccttggtaaagtgcctgaatcagttaaaaggaagggaggaagggagagagtaagagacagaagggaaggagctgtcacttagtatgtgtattctaaaggtcaggcactgttctttagcatcttatatgagattaactaatttcttcctcactacagtcttatgaagcgatactgttaccattcctattttacagataaaggaactgaggcacagaaaggttaataatgtacacaaggtcaataaatgttaatttattgttacttcaaagaaatgttaagatttagatttagtgagaggtcaattatagctgattaaaacttggcttcaatgcttgctagaaacttaatattggctggaaggcaaaaggggtattttggctctctattggtgtaaaacaattcaccccaaaatttagtggctcaaaacaacactatgttattatctattatgaatctgtatgttgacttggtacagctgaggatatctctagttggctggggctcttgtcatctgggggcttgactgggctgcatctccacaatgacactctctcagagccagttgatgctggctgtcagctgggggctcagctggggctgtcactggagtgcccacacaggacctctccacggggactggacttcttgcagcatggcagctgggctcagagagggagtgtcctgagaccaaaagaaagctgtgagacttttacacagcttagccttggaagtcggagagcattatttgtaccacattctgttggccaaaagcctaacctggcttcaagggtgtgagtattgggaggtgcagttcattatgggggcaggggacatatattttggagatgaggtacaatagcaattgagtagaattggagctagaggtgactatcagatatagggaacataagattaataataataacaacaataatgaagcaatagcagttacttactgagcagctagaataacaagcaatagagttgtctatttgtaaagattctggagttagactgccttggttcaaattccaacttcgtcacccggttacattgtaagtctggaggaagttactgaaacctttgagcctcaattttcttatctgtaaaatggagctaataatagtgcctacattataaggttgttttcaggattaaatgccttaacctacataaatttcttaggacagtgagtagaacatggatagcactcaatacatgttaggtattgttcttattctttttcccccaagaactgatagttggcatataaatttcttggcactcagtaattagttacctaatgaaattgagcattggtgacatatattttttatctaatactcatgccatctctgtgaagtagatgctcttggatcatttatgggttagggaactgataaggcagatgtaattaatttatccaaggtcacatgggcaggtaaggagcagattagatttattttgctgactttactgttggacttgatggtcaagatcactgtgcagagcagcaagaatgcatgctgtctaagcagtgggcagtggcagataggagactgcactgggtttgggacgccctggtttagtgtatggtaaagccaaaggcagggtttgctcgtcaaggttgagggtagtagaccaacattgaaatatatatactgtagtgtgctgagatgcaggaaatggccctgaacatggagccctgaattaactctcaagcccaagcagaaacccagaaagacatgttccctgtaggtaaccagaagaggcctggttcagtgcagtccaactcagcatacatttcctgaaagcttactatgtgccaggctttggaagcatgaacataagtaagattcattccactccagcgcccagtgcttgttgagaggacagcaacaagataattccggaccacacctgttgatggggaccagtaatgggtcgaccagatatttattgggtagtcattatatattaggttctgtttgaggatctggggatactgtgatggatttctgttagcccgcaggagagctgaccctagtgtcagactgcagctggacatatcaagggaaggcagggacccacagtaagattcctgtggcttgtcttgccaccaggagatccttacactgtgcagttaaaaagggaaagatggactttaagtttggtctcagctattactggacactgagactttttaagccttggctttatcacttataaaatgggtataataatttctgattgcctatctcagagggtcactgtggggctcaccaggggtagtgtataaatttgtgaactctgaatgctgtagaaagggggctatgcaattgggatgaacttgaagccaaacacatcaggatgggaatgggaatgggctaagttcaggttcatggcaacatttaatagttaacacttctaaagcatttaccatgcaccagccacagtcttatggctttcatcttatttaatcactgtaacaaccctatgaagtagcgctaatttatcccactttatgaacagagaaattaaggcatagagatgttaaatgacttgctgatgattaaatagcaggtagaagacaggcttcaagcccaccagaatcccttcttgttactcctctgctattctaccaatctccgagacaagatgatccaaggtgtttaagtgacctgccaagactaaaaactgcattgcatagtggtggaaattgcctgtcatggcaaaagggagatgaaggaaggacggaagggagggatgcaggagagaaaaggaaggaaaaaaagaagagagagggaaataaggtagaaaggaagggagggaggaagaaaagaagcacaaagtcatcttgggcaatgctgaatttagctggttcctgtgcaattacataaatgtttactaaccaccttatcttccaatctcgtgtcagccactgaaaggcatttaaagatacaagcaactgtgcgttggtcctccaaccatcattatctagcctctgggtgtgctaaaaagacattgtttcatgaagccagagacctaagttcaagtcctattctgtcctgtgtgggctggactaaacctataactcacactctggagagcactgggtacagaaatcgtgccttgcagaggtgaggtacaggttgagtagtgaaaaaattgtacctcaccttaaacgagagcagctctttagcggttttctttgtggaaattctgaattaaaattcattcaagaacataaggtaatttttctttctttctttctttctgttttgctaaaacaaaaacaacaagactcaattatctctgaggtccttctcaactctaagagacataacatttacagagaatgagagtaatagttcaattcaagactattggtagaaggtcagtaattgaatctttgagcagcattgctttcagatgatgctaattagtcaattttaatgagtagcctatagttcaaagtaaaatcttcttttgcctgaaattacaatggccttttaactaagtctcccagaatctactctagtcactttccaatctatgttccatggcagtcagaattcaaattcaatcttgtcacatccctgtttaaaactttttggttactacttactgcttttaggagaaagaacaaaatcctcaggtggctgacagatctgccatgatctggttcccacctaccccttggctgggttccacaccatttcttgtctctctcagtgacaggacagttctgctaattttctttgagttaactaaatgtctaattccacccactcccagtagcccttcatttcaaaggattcacatgggctgctccttctgcttgaatgtgcttccttttttttcttttgttcttcactatggtagcttctacctgcccttcagatctcaggctcaaagattccttcctcaagaacatggtccctgcattgaaaggctgtttcaggacttattttatatgcttccttctcattctaattttccaattgaacccaagttccagtttaccatccagtttaccagtatatcttttttcttttctttcttttttttttttttctttttttttcttgaggcagagtcctgccctgtcacccaggccgaagtgcagtggtatgatcatagctcactgtagtctcaaactcctgggcttaagtgatccttcagcctcagcctcccaagaatctggaactacaggtgtgcaccaccatacctggctagcttatctaatttttttgtatagccagagcctcagtatgttgcccatgttggtctcaaacttctggactcaagtgatagtccctccttggcctctcaaagtgctaggattacagacctgagctactgcacctgactactgttttccctttttaaatctatttattaatgcctatctctcctatgagactatcagcgcacacatacatcttttctatattcttcataactttgttcttataacttcctaccacatgacctgtcacacaatagccattcaaaaaacttgttcaatgaatgcacacatagattatttgcttctccgaatatgccacaaatgcatgttgatataatcttctgcaaattgagttccgtgttcgtatataaagtgtatgtactttctacatatgttgaatatatttagattatcttcctcattcacaaatgaagaaactaagatctaagggaggtaagtgacttttccagggtcactcagggaatttgtgaacagatcgtaaccaaaattcaggccagtaaactgacagtccagacagtttagtaaaattgaaactgcaaatggcgattgtcttcaactgacttgaatccaaatcctgaagttatttcttgttaagtctattactttgggaaatgttccctactgaagaaaaaaaaaaaaaagaagaacaagaaaaacagacactattcaattcaatgaaatgagataaaattcctagcatcaagtaggtgtttaaggtcagtgtgatttgatatttcttacttatatctggctatcacctgggtttttttaaagattagagtattgtgaagcaaataagatccatggaagcttaacttgagggcagacagtagaattattagcattttctgatgatgcttggtctttgatttctttttacttcacaaattcacatggccttgacccagcagtccgagccttagccaagcacaatgtaattacccattgttgagatgaaaatctcttgggggcatcaacttcaggctcagatgctggggccgtagcttctgaactcatgtcagcttttaacatatttccttctccatacagtgtttaattggtgtctatagaaagactctggctaccaagataatcgttatctctattctgatgaccctcaatattcatactgattttgattcttctctgtgaaccctgtacttatttgtctctggatttcatctccatagactcctgcagtggggcggagggatatggcttcttatattttattgaactcaagtcagtttcagtttattagactgacagtcccggctctgtcatttattagatgtgtgacctccaaaagtctccaaacctacctgatccctctgtttccccatctgtatggttaggataataagaatagctaccccacagagttgatgtcctagtcaattcatatgatatatgggaaaattcttcataacttgtaaagaaatatacagatagaatgttaatatattcaaggctgggcacggtggctcatgcctgtaatcccagtactttgggaggccgaggctagcagatcacttgaggccaggagttcaagaccagcctagccaacatggagaaaccccatctctactaaaaaatacaaaaatcagcctggcgtggtgatgcacacctgtaatcccagctactcgggaggctgaggcacaagaatcacttgagcctgggaggcggagattgcagtgagccaagatcacgctactacactcaagcctgggcaatagagcaagactgtgtctcaaaaaaaaaaaaaaaaattaatattttcaagagcacagcagtagtagaccctagatatttgatgacataaataattgatgacaacactttctatttccaagaagtggatgtttctgttgggtaaaataaagcacgagcctatcaaacagaatgtaatcatataataaagaaaaaaagaacttaagaaccttaggacttcagactctctagtctgacagaccaaagtgtgtgactgtcatttactattgatagtacttggcatagtattaaggcattcaggcttcaattttctgcatggcgtgatggagagaaaaatagtagccagccttggaaagccaataatagaacacagatgccagggttaacacatagcaaaatggcaaagcatggggctctttgttggacgaaattggaaccaatagtttgttgggtaattgaaaacgtgaagttaaactaggaaatcctaaaatgtatacatgctatacatatatgaaccattttattttaacttaaaaacatataaatgcacatttcttggccagcctcttgaagtaaagccaaaatcttttttgagggtagtggtatattctatttaacattctactggtgttcctgcataaaccataccataattgcgtaacatttcaaacctcggtttattcaaagtggagcaacagcttagactcttaaaaaacaaatgtttgcagatttttttgttacttcccctttatttaaatcgatagtcatttttgtcaataacttgtctttatagaattttcccactgaattcaaattagtttccacagaaaaaagcaattcacatttcattgatttattttagttttaatttagttatttcataactttttagctatattagaagatataataatagcaaatgcaacgggcataaacaggtttgggaataaacgaaactgactttcagctcgtatgcttgttacttggtggaaatagaaacgtggaaatgtaacccaccagacaagagtgttcagtgctccatcagcttcacacaccacatttatctgatgggaggaagagtcattttcccaaagttacttcatggaggtcaattatgagaacttgtcccacttgacagagaagctgtgattcctagtaacttgcaactcttagtggaacaacttgctcaaggtcacctattatagtaagaaaaaaatgatgataataatacctgtcatacattgaccatttattatgtaccagacagagttgttgatgctttacatatattaatgtgtgtaatccttatgacaaccctatcaaaaaggttctactatgcttcctatattatagacagagtttgagtagcaaagggaaatgctgcaagagaagagagtgagagaaatgcattcctgctggggagactggaaaaaatactttcctctgtccggattactttattcatcctttaattttcagattcatccctgatttcttaggaatatttggtctgactcagtgaaccaagttgcaccatcctattaaatgcctttactgcatcttctgtttcatttttttctagcacttgccatatttgcaatgctgcgtttaaacccagacttcccctacttgaccacaaattcagtgaaggcagataacttgttttccttgctaaccaatgtttcctcagtgacgggtaaagtgcctggaatatcacgacatagcctttgctgcactgaagtgaggggacatttcacatgggagctgagggatgattatgctttgtacttgcagtgaaaagaatgattttccattcaagaaagcaatacgtacctatgaagaatagagtgtgggattaattttatccagaaatgtcaaatcagaaatcagaaacaggatgtaagtcagaattaaatacctgggctttggaaccagaggactgaggttaaatattggcaagcaatgtgctgagtgtcctctgccctgagtgtcctcatctgtaaaataaggataatatctcctccacaggtttattgagaggatcacccaagacacatattcactgttcctagcatgtagtaagtggtcaataaatattagcacttagtgcaattgtccttattgttattgaataaggttagacctttatgttgggaaattatggagggattaaatatctagtggtggagtttgcatcttatcattaaggtgatatgaagccagagggaaaaataatagaagggatgctgtggtttagtaaatgttctctgatagctattagaaagatgaattggagaatcgatgggatctctcttttgggtgtaagaggattcagtatttcttctctgtgctgatatgatctgtggattaaagcactgcttcccaaactgggattggcatcaccgtcacctggagtactttctgaacatagattactgggccttgtgtccagggtttttgattcagtagaactgaggtgggtcctaagtcccaggtgatactgatgccactggtctaagcgccataccagacttggattaagtctgtcttcactgccttaaatatggtcacatctctttctatgcacttggtagaaactaagcaaaaatgagttcccctaagtgaatcctataggactttgaaaaggaggaaaataaggaagtggtatctgtttgaataagtttagaaaatgttgaattacaaaaaaatgctaaataaagaagaggtcaagttttcatatgtttcaaatttatttggccataaaatctttctttttgaagtttttcaagagattgggctcctcaaaacacagctttggaaaaaaaagtggtttacaccagattaagaagctatgacacagattatttggtgtgataccacaggttgtcatattcccttcttgtcagtagagatcgtcatctttcagtaagtcttctttgagttgagtttctaacaccttctgcttaagcagatgctaatggctttgtctccctgcaggtaccacccctgctgagaggtggcacgactgctaaccagcagctgcagaagtaacagcaggaaggtgctccatttctggtataattaggaaataaatttaccccatgtggcttagggacattcctaaccttaaaaagtaaactattaccaagacaaataccttatgtatagattactttaaagtttgcaaagggctttcacactgatgatgttatgtgatcggaataaccagtggatgagttagagtgaggatcagtcggcctccccgtttacaaaggagaaaactgagactgacagaaatgaatgacttgcccaagattataaagtaatactcattatcctgttgccatcctacataggcataggcctcttttcttgtcaaataatatttacattaatatttatactgaatcttcatttattcattcattcatttattcattcaacaaatatttagtgaatactcactaagtgccaggcgggatacaagtggtaggggggtgagcaagacaatgagtgcccctgttcacagacagctcaagatctagaagatagactacctagaagataaaactggcccagaattggtttggcatccatgatttactttagaaacctgaggctcaggaaggctaaatgacctaatattatgaaatcataaaattttgtacctgaaagaaacttaaaagattgtccagtctattcttatcattttcttaaggagtaaaatgaaacagagtgttttgtccagaataactatgttaatttttattatgtagcaaattaccataaattaagagacttcatgtagatttattatgttatagtttccaggggtcaggagtttaggtatggtatagctgggtcttcactttatgcttcacaggctgaaatcaatgtgttggacagaccaggctcttaccagtgggttctggggaagaatccaagtccaagctccttcaaggtgttggcagaattcagtttcttgtggttgtaggactgaggttactgtttccttgctgtttgttgctagggattctatgtgaatggctaggggcccttctccaggccttgcacaaggtcctcttcatcttcaaaagaataaagatgcatggagtccttctcacacttcagacttctccaagttctgccaaagcgagagaaaactctctgcttctaaagggacacatctgattggattaggtccactaagataatcttcctctgtaggtcaactgtgttatgtaaaagaacacagtcaccagagtgctatctcatcaccgttacaggtcctgggaattagagcctggaaccttggggaggaagaaggcatttttagaatgctccctagtacagtagcatagttcgggaataatagaatgaaaaagagataacctgagttctctttggagctcataacatatactgttctgaatatatattgctgtataacaaattgacccaaatttaggggcttaaaataccaattattatattatgttcctgatttgtggatcagtaattcatgctggaagttgctgggcaattgtgttctatgtggagttgattgcaatcactcattggtatttagctgggagcaaagctggcttggaagtccccagaaggcttccctcacatgtctgaagcagagatggccagaaggctggcctcagctgggcagttcttcctttccaaggtctctccgtgtagtcctacagcagagtggccagactgcttagaatggatctcagaggtacaaaagggaattttccaagggataggaggtgaaagctgccagtctcttcaggcccacacctataaactatgtgaatcacttctggcttactacattggtcaaagccactgtaggatcttcccagattcaaggggagagtacatagacctgttgtctttacgggagaaatagcaaaggatttgtggccactggatacatagagtaggtttttcatttgttcatttttccagtgtaaaacattaatttttttgcaagcactttattttttgaaaacaaattgtattgtgtgtatttgaggtttacaacatgctgttatgagatacatatggacagcaaaatggttactatagtgaagcagattaacatagctatcatctcacctagttactttcctgttacaagagcagctaaaatctacctatttaacagcaatccccaatgctgtattaattctgtaaatgtgttcatcctacttatttgttattttgtatcctttgacctacatttctccatttcctctctccctacaagcagagtaaccactatttccattatctatttctctgtctctgtgtatttgagctctttttttcttttccttctgcatttaagtgaaatcatgcaatatttgtatttccgtgtctggattatttcacttacaataatgttttgtagatctatctatgttgtaacaaacagtaggatatcacacttttgaagctgaataatattatatcatatacatatggtcagccttccatatctgtgggttccacatccatgaattcaaccaactatcgataaaaaaaattttaataaaataacaatgcaataataaaaataatacagattttaaaaatatagcattataaccatgtcatagtatttacattgcattaggtaatataggtactctataaatgttttaaagtatacagtaagacatgggtaggttatgtgtgtaggttatgcaaatactatgccataaaaagaaacttgaacatcatcagattttggtatttttggggggttgaggagccagttcccagtagatactgagaaacaactgtgtaccacattttctttatacatttatttgttgataggtatttagtttcttcccttatcttggctattgtgaataatattgcagttaatatgggagtgcagatatctttatctgtgctgatttcatctcctttgggaatatacccagaagagggatttctgtgttgtatggtagttctatttttaatttctttaggaacctctatattgttttctataatggctgtaccaatctacattcctaccaacagtatagaaaggtttccttttctttacaccctcaccaacatttgctatctcttgtcttttttataatagccatccttatgggagcagggcaatattgtatagtggtttcaatttgcacttctctgatgattagtgctgttgagtaccttttcatattcctgttagccatttttatgtcttctgtggagaaatgtctgttcaggtcctttgttcattttttaaattgggttatttgtttttctgctattgagttgtaagagttctttgtaaattttgattattaatctcttgtatgtggtttgcaaatactttttctcagtctgtaggttgccttttcagtttgttaaatatttcctttgctgtgaagaagctttttagtttactataggctcatttatatttgtttttgtagcctgagcttttggtatgatatcaaaaaattcattgctaaggccaacgttgaggagctttctacttatgttctcttctaggagttttttgggtttcagatcttccaatgaggccttttatccattttgaattgatttttgtgtatgatgtaagataagggttcaatgtcattagtctgcatggggaaatctagttttcctagcaccatttattgaagagattatccttttcccatagtatcctcttggtgcccttgttgaaaattagttcaccatttatgattggatttatttctgggctctcaattgtgttccattggtctatgtttctgtttttttatgccagttctatattgttttgatcactgtaattttgtagtataattttaaatcaggaagcacgatgcctccttactttgttcttctttctcagtattgctttggctatgtgagttttggttttcttgagattactttttctatttctgtgaagattgacatcgacatttttatacggattgttaaatcattatattgctttgaatagtgtgaatatgttgataatattaattttccccatccatgaacacagaatatcttttcatttatttgtgtcttctttaatttctttaatgttttgtagttttcagtgcacaagtctttaacttccttggtcaaatttattcctaagtattttttttgtaaatgagattctttttaaaatttctttttcaactaagttatttgtgtgtagaagtgctactcattcttgtatcttaattttgtataattcaactttatttaatgcatttattctaatagttttttgtggggggatctttggggttttctgcatattagaattatgacacttgcaaatagagtttattctacttcttcctttctgatttggatgcttttttatttctttttcttgtctggctactcttgctagtacttccagtactgtattgaatagaagtggtaagagtggacattcttgcctggaattgaatattagtggaaaagctttcagttgtttcctgttgattatgatgttagctgtgggtttttcataaataccctttattatattgacaaacttttattctatagctaaatttatgagttttaacaagaaaaaatgtttaactttgtcaagtacttttttctgtatcaattgaggtgatcttatgattttaatcttttattctgttaatgtgatacatgacacttattgatttgtatatattaaaccagccttgcgttcctgggatcaattccacttggtttagatgtgttgttaaattcagcttgctaatattttattgaggatttttgcatcaatgttcattaaagacattggcctgtagttttctttttttgcagtgtctttgtctggcttagatatcaaggtgatgctgcctcataacatgtgtttggaagtattccctctagctctattttttggaagaatttaagaagtattggtaacaattattttttgaatatttggtagaattgagccatgaagccatctggtcctgggcttttccttagtggaaggtttttaaatattacttcacttcaatgtctttgttagtggtctgttcaggttttctttttcttcctgattcaaacttcataggttgcattttccaggaatttatccatttcctccaggttatccaatttgttggcatataattgttcataatagtcccttatgatcctttttatttctgagacatctgttgtagtgtctccactttcatttctgattttatttatttgagtttccttattttttttttttttagtctagctaggggtttgttgattttgcttagtttgtcaatgaaccaactcttgggtttattgattttttttccatgacttttgtgttctgtatttgatttatttctgttctgatcgtcattatttccttccttctgctaaattacagtttagtttcctcttcttttactaactccttaatttatttgggatctttcttcttgtttattatttattgctgtaagcctccctctgataacttcttttgatgcatcctataggttttcatatgtcatgtttctactgttatttgtatcaagatatttttcagtttcccttttgatttcttctttgacctattggttgttaaggagcatgttcttttatttccacatacttgtgaatatttcaagatttctcttgttactgatttctagtttcataccattgtggttggaaataatactagatataattgtaatattattgaatttactaaaacttgttttgaggcctaacatgtgatctgtcctggagaatgtaccatgtgctctagaaatgaatgtatagtctgctgatgttgaatgaaatgttttatatatgtctgttaggtccatttggtctaaagtgcagttcatgttcagtatattttggttatttttctgtctgcttgatctattcattgttgaaaacagggtgttaaagtcctctactgttattgtatagatatttatttattccttcaggttcattaatatttactttatatatttaagtgctccaatgttgggtgcatatgtatatttatatttgctatgtcctcttgatgaactgatgcttttattgttatacaatgaccgtctttctctcttgaaataatttttgacttgaagtctattttatctaatgtaagcatagcaacccctgttctcttttgactactatttgcaagaaatgtcttcttacatcccttcactttcagctgtgtgtcctttaagctaaaatgggtctcttataggtagcctatagttgagtcttttcttttgtcaatctactcagccactctatgtcttttgattggatatttacagttaatgtcattattgatacggaagaatttactactgatattgggtaattgtttcctggtggtttaatagatcctttttttcctttcttccttgtttacctttgtggtttggtgattttctgtagtgctgatctttggtttctttctttttctcatttgtgtatctctgtaatattttttttctttgtagttactgtgaggcttacataagatattttgtagttataatagaccattttaagctgataacttaaatttggttgcatataccttttacctttaccctccccccaactatttatatttttgttgccacaatttatatgttttatactgtgcattccttaagaacttactgtggctacagtcatttttggtcattttaacttttaactttcatactagagatttgatagatttatatatcactattatagtcatgggatagtctgaatttaattatgaatttacctctaccagtgatttttatgctttcatatattttcttggtagtaattgtcatccttttacttttagttgaagtacttcccattttttttaaagatggggatcttactctgttgtcctggctgaagtgcagtggcatgatcatagctcactgtagcctcaaactcctgggttcaagtgatcctcccacctcagcctcccaagtaggtaggatgacaggcacataccaccatgcttggctaattgtatttttttatgattatttttaaaacttttgtagagatggggtctcactgtgttggccaggctgctcttaaactcttggtctcaagtgatcctcccctctcagcctccacagtctttgagattacagatgtgagccaccatgcctggctctaaacattttttctaaggctggtctagtggcgatgaatcttctcagcttttctttgtctgggaaagactttatttcctcttcatttctgtgctaggtgtaatattcttgattgaaagttttttttattttttctttcagcactttaactgtatcatcctattatttcctggccttttaaaatcatttctatgatgtctttgatattttgattataatgtgccttgtggaggacttctttgggttggacctatttgggaacctatgagctttgtgaatctggatgttcatgtctcttccaagacttgggaaatgtttaacaattatatcgttaaataagccttctatgcctttcttcatctattattcctcttacactcatcatgtaagtacttgtttgcttactggtgtcccataatcccatatactttattcactctttttaatttatccaatttttaaattccccctttactgggctattttaaaacacttcccttcaagtccagactttctttcttttacttgatgtaggcagctattgaagctcttaattttgttttttaattcattcattgaattattcagctttaagatttctctttggttctttttaatgatatctttttgttgaatttctcccagatcttgaagttttattaattttattgaattatctgtcgatattcccttgtatctcaatgagttttgtttttaaagatcattgtcttgaatgcctttttaggcaattcacagtttccattttggaggatttgttattggataattattttgttcttttggtggtgtcatgtttccttgttttttcatgttctttgtgtccttatgtttatatctgtgcatttagtggacaatcaccgattataattttatagaatagctctcatagaaaaagacattcccctgcagatgtgtcctatggtgtcagttgggtaaggtgcttaattctggttctgggtgggcgcactggtgtagccatcatgcaacttcttcagttgtaatcaatgtcagaaatttctgtgggtaccttaatagcctagtctacaagactttgtggcagtggtggtggcaaggtagattgttaaggttattggcaacaagggcttcagggatcctgttgttctcatttttcccacagtgtgaagacttagctgaattgaattcctttcggagttgggtataatataggtaacaggcagccatagtggcactgttttccaggacacaggtgcttagagtggcaatggaactggggtcctatgatcagtgtcttgttgaatactgtggcccatgtgacatgggtgcagctttactttcttagctctcccaccaagcagaggattacgattccaaggcacttcagtagctcaggcccagatggcagcgatgtaaccgtgactctgatcctgggtgtcaggacactgcactggtatggctcccggaaggaagaggtgtttcagtggctcaggttctggggagcaggatacaattgcagtttgggttggagagccagcagggcacaaagacaactcgggcatcaggagagagggtactgcttagtggtgactctggaccctggaatggtgggacataacagctacccaaatcctctgaggcgctgtagaaacaagaaccaggaatggcagggcgtggctgtggcttgggctctagggttcaaatagcagtgcaatattggctttactgcgcattggaggtagggcctctcagtcgtgcatacttcagagggctggtccagatccagggcagtagggcactgtagcagtttgacatagtggacaaggtgatacagatcagccaaggctgtgcttccctgggggtcaggtgctgtgtggactcaagcaccagggttgtggctgctccctgggccaaagctccaattacctgagactagttggttcaggtgctaagtgtgcaaggctgctctgccagcttgggcatggcttttctgctgggctggagcacctggtctccaagggatagaacaccaccagggcttaggcatgcggtcatggctgcttccatgtgtcaaagcttcagtttcctggggccaaggtacaggttacttcaggcatccagaaagtgaggcttctctcctgacttgggtgtggcttctctcctgggccagagtacctggtcgtggaggggcagggtgccaaattgcagctgttccctggccaaagcttcatttccctgggggtggggcaacaggctggtttaggcaatgaggggacacagctgccttaccttcccagacatagcttctccactgggacagactgcctgctccaccgagcctaggctgtgaccctaacatctgagcccaggcagtgccctgggctcaggtgccaggagcagggcacagcaacaaatgaaatgggggagatggagtgcctcccaggcagcttgttccccatgggtaaggaactgcagcagcttggctggggaatggagcactactgtgtatgatcatagtgcaatgatgtcagtgcctcagggatggagaagcgcagtggctactggccactagagaaaaacacactctagcagggctttgctttcaaaatgtcacagtgcagtagcaggttgaataaaagggtcgggagtgggatacaacgtgggcttcttttctggagtagtacagctgtgcaaactccaggcagttccctaaactgggctcagggcccatgaagacttttcccttcagggagagggctcacctggttctgagctaatcctgaccggggagaggaggtagcagagacaagatgttttgtttccttctctatagagtcatcctgcttttctgtgcctcacagggttttcaccacccccttactgtacttcagtgctctccgttagtcactttagtcaaaatttagttgtttgttcattgttttggtccttttttgtgttgggcaacgagtgttagccacctctagtcagtcatcttgctgaccacaagcctgtgataattttagtacaaaggctaatgcactcttcagagatgttgtgaggaaatattttgttatgcaagattgtcctttaaaatctagtcaatcaagattgttgtttagtggatttatcttaaggtttcagccgctgtctaggtgcatattttgttgttgtgtgttgtcattgttcttgttaatgtttttttggtgttcttgaaagctggtttaagtgggggcgaatgtaccataaaatactattattctattatttggagaggggtatagatagtgtgggtactgaatgagggaagggaggggatgctaccagttggtgggtattccagttatgatataatccccaatgtgcattctaggactggggaactaccaccggaagtacccactggacccactgtgagatggacctgagctaaaactccattcatcatctgacttccataaactcttattctgattggtagaccacagtgatattttacatctcctggaattaatgtcagtttagagccagtgtgcaaaagtctttggaaagcattattatttccttttctcactcagtatacagtcacccaggtaagatgttataggcctgtttggagaaggctaggaggaagattaacagtataaattttgggaagtgtgcaggcttcttcctcaaggggaagattctggttctgggcttccaggtactactcgtgtgactgcaagcagattacttaatgtccctggactctgtttctcatctgtcacagggaccaggccttgcctaagtgttatttagctttaaggttctggaattgtcactataaactcataggcagctctccccaggagaagttgctactttgatagtccctgactactgatttttgtgtgcatgcatgtgtggagtggggagcagggggtataatttgagcaaccaagacttattctgagtgtgtattaaattgtcctataaataagaggcacaagcccacaatgtgaagtcaggctagctcagggcatctggctgtcaatcacaagtgcttacaagtgtccttctaactatgtggcaatgaagcttttagctgagaatatcttcggaactttctttctatttatgggcaggaaaaaaaaggtagtgaggtccaaaatggtggcaaccgagggtgtacaatctaggtgaggggcaaggagatgtgtggcagtggctgagcttcactgcgagtgctgtccggggtgtatttaagtcaacactagtaggaatctctccatttgcacccatgcttgttattctgcatttgtagcaagtagggcaattgactcacttggctgatgcaaggcaagaaaataagcatctccagttcctttctgttgtttttggttttttctttttttctccccccctgtggctcggaagtagcttcctgtttggaatagaatctgtaagctcaggggatttagtcaaaaatagacataagtcttataatttctatggactgcttctttttaatcccctgtcagagccatcacccaattctcctgtctacctccaccctccacgtcctgccaacaaactcacgcatgggtgagttttagtcccagtgatgtgacaagtcactagtgaccatcaggaagttacttcccttctctgagcctcagttttttcatatcgttacaatgaaatgatactctctcaacccagcctgggacacaaatcaattgtgaggatcaaaattagagaacaaacagaagagcttcagaaagttggaaagtgatatgaaaatgtcatgttttgctgccttattaatatcattctgattgttttaaaggacaatctttttggtaaatattttactaaagtattacatacgtacagaaagtggaaacaacataaatgtacagtaagatgaatctttacaaagtgaattcacacgtatgaccagcaccagatcaaaaactaaggcattctctgtactgtacagccccccgtgtcttcttctaagccttatcaaccttctccccaagggaattatttttttccactgcttcatccagtgtaggtcagttttgctttatatatgaaatgaactctttgtgtctggtttctttcaccttttcatctttctaaatggagatattcctccattttgttttgttttgtgtagttgtggctcactcattctcaaaaatattttattgtttatatagaattctcttctactgctgatggtcatttgactagtttggcattattccaaatagtactgcaatcttatacatgtctttatatatgccttttggttgtgtacatattaggcatggaattgctgggatgtactgtattcatatgttcaacttactggctattttaatacatacttccagttttctgaatttgttgatgcaagttttgttcctagcagtagcctaggagagtttcaattgttccacaaccttgatgacttagtgcttaccttctttttaattttgtattctaattttattttgccatcctgctgagtaatatatcattgccagtttaatttgcatttttctgatagtgaatgaagtggagattcattgcatattgactttttgaatatgctttttgatgaagtgcctgtccatatcatttgcctattttcccttttggttatctgaattttgctcactgatttgtagttgtttacgtattatcttagtctgttcaggctgctataatgaaataacaaagactgaggagcacataagtagcatgaatttatttttcacagctctgaaggttgggaagtccgagatcaaggtactggtagattggttgtctggtaagggcttttgggttcaccttctacctgtgtcttcacatgttggaagaggcaaggagtctctcttgtgtttcatttatgagaacactaattccactagtgagagctccactttcatgacctaattagctcgcaaaggcaccatcttctaatatctttaccttggaaattgaaatttcaacatacaaatttgggggaggggtatacaagctttcagaccttagcatgtcttatacatacaatctcttgttagctagaggtattgcaaatatattctgtcattgaaagttgtcttttcattctatggtatcttttgatgaatctgttttaatttttgtatagtcctgttaatcaattatcttcttttacggtgagcacttttaagaaatctttgcctactttcataaagatgctcccctatattttctcctaaaagttgttttgttgatgttgttgttttacttttttcatttagatctgcaagccatctgttttgatttaggagtacagaggaagttaagtgtcaagatttattttgtttaatatggatattcaactgatccagcagcatttgttgaattctttcccactctgagtttttaaatctataattactgatttcagagggatcatttactatgtgagctcaagagaaacacagtttatttgcatgagagacagtgtgtacctactatatgttagaaacttaatgcacatcatcttatctgagcctcagaacaaccttgcaaggattgtattattattccattctgtagttgagaaaactgaagcttagaaaggacaagcaattaactcaaggttaaataatgagtagcagagctatgactcaatactcctttttttttctttttggattccaaagctcatgttagctctttcttcttcaagtatcttggtgacagcattcattagaactgtggagactgaataaccaatgagttgaagatattaggctatgatcaactgggctgttttagtaaccaagaggaataattttactgaaggcatttataaagcatagttattccttgccctcagtaacaatcatggttagtaatggtcagtcattacttcttttcactggaaatctctctagagctttgcatattccatcctagctcttaagacaaagtgaaaagtagatgttaccttccccatttgacagataagaatactgaaggtcaaagaggtcaggtgacttatttaaggtcaaatagcaaggccaaatatccaaggtcaaataggggtagagcagggcccagcacttatttaacttactctctcacctgtgatcaccgcttctcactgccaagatcatagatctagatgaccattattgtacttcagggttaaggcccactagaccctgggtagtcccctcttatttcatagctttttggttgaagtctgttattatacagtctaactactgcccaagaagaataaaccactcttgtagccctccaccagggagtgtcctgctgtttttagcctttctgtcacccttgagaagctccgggcgccttccttcacttgtcttcagcacattcatgccccaaagcaaaatgctgaatttgaatatgcagctgatgttgcctgtcacctccttccagacacagaactgtgtaattgcaaaaattgtttcgtaatcctcctcaattaggctcctgacaacctaattttaaagaccctattggattttttacattgatgctcttctccttcttccttcttccatcttcctctgccctctccagtaagacctattaccttcactccacaattgaaaattagaaaatagtttcagcatgacaagggaccgtaacattttcttttggtatttcttccttattattatgagctacttaatgaggctgtgacaccatgtgaagaactgagagaaggaaaaacaggttattaaagcaatgttagaaactcaaagagggtaatgattaaaagctaaatatttatctgggaaaaatagtgaacagagtgagtctgatggccagttataattcatactagcacatccatagcatttctgaggctgttttcagcggaatctcaagtattctgacaccactgacttgacgtattcatctcttataaataccacttctttaacacacacacacacacacacacacacacacacacacatgcacagagagagtcacacacagcacaactaaagaacagcgcatcatcagaaacctaaaaaaacaactgtttgtcttctcagtttagtctgtggtctgtggaatacacattttgtggagtcacagaattacttgggcacccattacagtgtcaaagaaatgccaaggaaaaagcaaagggcataaataaaagaataatgcagagctccaatttcatttttttccatttcctctgtacttttaaatacacactcctggtaggcaaatgggagttatggattatagctttctattttaacctagatctgtttttcttcctctctccttggcactcgatttgtatgatctcccctaaaatgccactggccccacactgtattcccatcttaggcaaaacctccaattaaaatcagcagggagtctgcttgaattaggaaccccagcctgggctccccagccagggggttctgaaagggagatgtgtacctttgaaagcactgatgggaagccctgggtgacggagactgtcctcgaaatgatgagcgactccatgctgtgtcaccaggagacctgtcaggttgccagaaattcctggctgaggcaaagacagaacctgcaggggggcagctgaggtgttaacatggtccagagcctctttcttctccagttgggggtttagagggcagggaatatagagcatgggcattgagggagtattgggtttggacccaagaattctgaactttgctctgctactcccatgctgtgtgaccaaggtgagtcgcagtctctctgtggccttcaatgccctcatcggtgggataaaaatcacaagggaatcctatctcatggggttgatgtgaggataaagtggtaactgccatgatgtagaaaacacttaagaaacactgatttttttgacctcagcaaccaagtctctgtgttcaggcctaaacgtgagaaagaagaacattcccaaggtttcttcttgaagtttccctgcttctaatggtcaaaactgctttattcagagccagtgtgggtacctatcaatcaatcaggctccagggttttccagtttagaaatgaaaatgcaacttccttctttctcctactttctccttccttctctcctctcagccccctatcagaatgaattgaaatcccatccaacagaaagatgctgatttggatgtattgcatctcagctttggctgcagatggaagatgctttggatccttagggacagagaaaagcactttaaaacctgcttctccctgcctcacactgactggctttcagtggggttgtgtcagcctttgtgagaccctcccctctgaagcagcctattaagctgcttctctgttgccggggttgaggaaggctatcaccaactagcctgggaagtggtatttatagattgcaatccctgctatccctgatccccagcatccccctatgcacttgtcgggagccccaattatctgtgagtggaggagagggaccctggcaggtccagaggaagcaaggaatgtgataataggcccttcacaggctcaaactttcagtatttttccgttatttcaatttatttcttttcttgtgtcttgctttcttcttattactcaccatatcattataattttacattatgatacctagaagagagtgcactgataacttatctgagatcacaaaggtactccacattcagataccaaattttgtgatctcagacaagtcatctcacttctcaaggactcatttttctttgcctgtaacatggaggtggtttcatgtgctgttcagggagacagtgtgaagaacctccagcactatgcctggtatacagtgagaactcaatagttgtaagtcactgatgctctcagctggtttaggacactgcctacaattgaaccttgtagagtttatgactatccatgataactactgagagaactggctggagataggggaggtataggagattgatttgattgagggtttttcctcattattgcaatttgcttgtattcaaaagacacacacacacaaacaatgaaatgagctttttgtggttctaatctcaaaatgaaatatggaaaagcaaaagaaagtttgttgacctgggggatcaggactcactggtaacattgctttacctctctgcccccactgtctctgcagttggcctctctagaaagggaggagaatggacaactagcccacccttaaatggcccatccaatagttgaattaggaacccccgcctgggctctttcccaaatctgtgagtgagttaacacagatgatgccttggctgcatctctttgtctctatcctacccactctaatttcattccatttcatcctccctgtccagggtctcctccatagcctgtgtctgctcatttgctccacatttccccaccatctccaacaccaagtccttttctccacttatcacccttccccactctccacctttcccctctgttttctttcctctttccctcagcctcgtgctccctgctccccgtgaacaccacctgctttctaagtcctcttgctgtatcattaatgccttctttgatacagcccacaacctcatgattattctgaggtcaggagatgcaggtgccacgcagctcgcgaatgtatctcagaggccctctgtccccaattcctcctgcctgacagggctggaatcctaatttgccactagccccgttgcttattgcagcatcaccaggaactttcatctttttatttccctcaccgaggattctgagagttcagccacaatgaagcattgattcaaggagtgggggctgtggtccttacaaagggtcccaatgatgagacacgagaaagggggcgctctacggggttatagaatgccttgcagatgggaacagaggaactctaaatggggtactgtcctgtcacttggagagggagtgacaggggcaagtgtgggccatgtgaaaggggcattttgaaatgacgctctcgtcagatggaaccacgcaatcagggccgtgtggagggcccctgcagctcacaaaaatatcagatgactcatacccaatattcagtcaatgttctggtttgggaggtgggagccacatagctcattattattccagctccgtttcctgaaggctgggcctgctgctgttctccaggctgtaataggattggtctcacgaagcagaaactggggaggcctggagctgtgtgggtggatggtacggaaaacgaatactgcagtcctgaggggagaggtagaagtttgtttttccttttttaaatgaaaactaacaagaaaaatatgaatattctttatgcattcattcatcaaacattgattcactcagcaagcatttgtagagccagcctctgggctaggtgctcggagaagaagggacctctcctctcaagcctaagagcctggaggggaaactgacaaagaaacgaggggtttcaatacagtgttttgaatactgtcagggaggttttatcgccaggtccgggtggttctgtggatttaaaaaggagagggtttcaaggagcccactaattattccgccattttttcccagccgataagcaactcatcgaaagcaaagcatgctgggaagccatttcaacagtatccattttcaaatggatataacaaaatggttttcctcaaactccagagcgatagtgaaatccccgagagtgtctcaataccttcaaaggaagagcttattttctgggataagagtactttttattattaccttttccgtaattgctctgtgccaggctcttttaagcactttaaatatattatctcactgaatcctctcaccagctgcctaagatgggctttattatcctcattttagatattgatactgagacttaaaaagagatgaagtgacttgatcccggttatagaatgcagctttgaactcagctccgcttgggccaacaaccatacttttcaacattaggctctactgcctaattaggctcttggtgtttgtggtttggggattgtggctcatcagtggaagtgatagaatagatggattgttaacacttcctaccacagagagtacaatgcaaattagcttctgtttctagttttataaaatgaagatcaggaaccactgagagcatcatcgtcatcatcaccatcaccatctccacagcacgacagccttaggaaaggtgctcttgactctcgcttgacagacaatgcaaaaagccacagctgtgagccaggagactactctgattgtttgtttgactctgagcagtcctttcacccttagcttccattgccatgtctgtaaaatattgctgacagtccctttgcaggaataacaaccgcttttattgagctcttaataagtaccaagtttggggttaagccttcacataaaaattcatataatcctcacatagctctgtgtggtgggaatgattaggaaggtgaagaaaactgcccaacattacctcagcttgcaggtggaggagccaggattttcagctgtctctgactgacctcaagtcccaaggtatttttagggtgttgctgtgaggctcaagcgagaaaattggagtgaatataccctgtgcagggtaaaaagtgctagacacacaagagtttattggtagcatggaagacagccaaagggtgacttgaatggaaaaaaggaaagatgagaggcctctaagctgactgccttgcatatttgttcctactctgatgctgcttcttatctgatggaatatctgtcttcattagaatgttttggtggctgaaatcagattatagactttggtatcatttatagtgttgagggcctgtggggagggggcccagaggctgcaatagaaatcaactgaatggagagtttggagctctggaaaaatgcagggaaataacccccccttttttttattatactctaagttttgggatacatgtgcagaacgtgcaggtttgttacataggtatacatgtgctatggtggtttgctgcacccatcagcccatcatctacattaggtatttctcctaatgctatctctcccctagccccccaacccctgacaaaccccagtgtgtagtgttcccctccctgtgtccatgtgttctcattgttcaactcccacttactagtgagaacatacagtgttttgttttctgttcttatgtttgttagtttgctgagtgtgatggtttccagcttaatccatgtccgtgcaaaggacatgaactcatccttttttatggatgcatagtattccgtggtgtatatgtgccacattttctttttttttttgtcttttttttttttttatactttactttaagttttagggtacatgtgcacattgtgcaggttagttacatatgtatacatgtgccatgctggtgcactgcacccactaactcgtcatctagcattaggtatatctcccaatgctatccctccctcctccccccaccccacaacagtccccagagtgtgatattccccttcctgtgtccatgtgatctcattgttcaattcccacctatgagtgagaatatgcggtgtttggttttttgttcttgcgatagttgactgagaatgatgatttccaatttcatccatgtccctacaaaggacatgaactcatcattttttatggctgcatagtattccatggtgtatatgtgccacattttcttaatccagtctatcattgttggatatttgggttggttccaagtctttgctattgtgaataatgccgcaataaacatacgtgtgcatgtgtctttatagcagcatgatttataatcctttgggtatatacccagtaatgggatggctgggtcaaatggtatttctagttctagatccctgaggaattgccacactgccttccacaatggttgaactagtttacagtcccaccaacagtgtaaaagtgttcctatttctccacatcctctccagcacctgttgtttcctgactttttaatgtttgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccacttgttgatggggttatttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttgtcttcagttgccattgcttttggtgttttagacatgaagtccttgcccacgcctatgtcctgaatggtaatgcctaggttttctgtctaacgtttaagtctttaatccatcttgaattgatttttgtataaggtgtaaggaagggatccagtttcagctttctacatatggctagccagttttcccagcaccattaaatagggaatcctttccccattgcttgtttttctcaggtttgtcaaagatcagatagttgtagatatgcggcattatttctgagggctctgttctggtccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccagtatggccattttcatgatattgattcttcctacccatgagcatggaatgttcttccatttgtttgtatcctcttttatttcattgagcagtggtttgtggttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgaaacaatggggttttctagatatacagtcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatatcggctgtgggtttgtcatagatggctcttattattttgaaatacgtcccatcaatacctaatttattgagagtttttagcatgaagggtggttgaattttgtcaaaggctttttctgcatctatggagataatcatgtggtttttgtctttgtctctgtttatatgctggattacatttattgatttgcgtatattgaaccagccttgcatctgagggatgaagcccacttgatcgtggtggataagctttttgatgtgttgctggattcagtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagcgtatgtgtggaggaatttatccatttcttctagattttctagtttatttgtgtagaggtgtttgtagtattctctgatggtagtttgtatttctgtgggattggtggtgatatcccctttatcattttttattgcgtctatttgattcttctcttttcttctttatgagtcttgctagtagtctatcaattttgttgatcctttcaaaaaaccagctcctggattcattaactttttgatgggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtggggatttagtgctataaatttccctctgcacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgggtgggagtctaagtctctttgtaagtcactcgggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgattctttatccaatttgccagtctgtgtcttttaattggagcatttagtccatttacatttaaagttaatagtgttatgtgtgaatttgatcctgtcattatgatgttagctggttattttgctcgttagttgatgcagtttctttctagtcttgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattctttgctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcaaggagtatctttgtggcattctctgtatttcctgaatctgaacgttggcctgccttgctagattggggaagttctcctggataatatcctgcagagtgctttccaacttgtttccattctccccatcactttcaggtacaccaatcagatgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattctacacgtagttctcgagccttggttttcagctccatcagctcctttaagcacttctctgtattggttattctagttatgcattcttctaaattttttttaaagttttcaacttctttgcctttggtttgaatgtcctcctgtagctcagagtaatttgatcgtctgaagccttcttctctcagctcgtcaaagtcattctccatccagctttgttccgttgctggtgaggaactgcgttcctttggaggaggagaggcgctctgctttttagagtttccggtttttctgttctgttttttccccatctttgtggttttatctacttttggtctttgatgatggtgatgtacaggtgggtttttggtgtggatgtcctttctgtttgttagttttccttctaacagataggaccctcagctgcaagtctgttggaataccctgcctgtgacgtgtcagtgtgcccctgctggcggggtgcctcccagttaggctgctcaggggtcaggggtcagggacccacttgaggaggcagtctgcccgttctcagatctccagctgcatgctgggagaaccactgctctcttcaaagctgtcagacaggaacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaatcaagcctgggcaatggcgggcgcccctcccccagcccgctgccgccttgcagtttgatctcagactgctgcgctagcaatcagcgagactctgtgggcgtaggaccctccgagccaggtgcgggtaatataatctcgcggtgcgccgttttttaagcccgccggaaaagcacagtattcggtgggggagtgacccgattttccaggtgccgtcagtcacccctttctttgtttcggaaagggaactccctgaccccttgcacttcccaagtgaggcaatgcctcgccctgcttcagctcgcgcacggtgcgtgcacccaatgacctgcgcccactgtctggcactccctagtgagatgcacccggtacctcagatggaaatgcagaaatcactgtcttctgcgtcgctcacgctgggagctgtagactggagctgttcctattaggccatcttggctcctccgccacattttctttatccagtctatcattgatgggcattttggttggttccaagtctttgctattgtggacagggctgcaataaacatcgtgtacatgtctttatagtagaatgatttataatcctttgggtatatacccaataatgggattgctgggtcaaatggtatttctcattgtagctccttgaggaatcgccacactgtcttccacaatggttgaactgacttatactcacatcaacagtgtaaaagtgttcctgtttctccacaccttctccatcatctgttgggaaataacccctttctaacatgttctaaaaaaccaccatgaggatcatgtaagatcatcaatagaaatcactacatgatttctagcgtatgataaaatataatttgtttttgttgaagttggtagatgttatacaccctcatgggaggaatctgtaatgggggttgaaacatgtggtttaagtaaacaaataacccctaaggtctttttcattgctgattgtttacaatatgttgtcatccagaaggggtatttgagtctagacactttcatttcctgaatcacacttttctgggactagtgtataatggaatcaaagagctggaaggaccccaaggaacatttactccaaccccttcactttgcagatgaggacattgaacattaggaaggtaaagtacgatgtcatgcagctggtttgtggcattaggaggagctacaatgtagttcttacgtttatattcgatgcccttcctgtattgtcactgctccatccagtcctttcatctttttggcagctccagttcgcattatcagttggataactgtaactcacagacccactcatggtagctaaccttctccaattttcctttatctcccaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagatttattccctctttatgcttaattaattccttgtgtgtgtttgttttctcttctttttgactctttctcacacaggggtgggaatacagtgacaatgctatcttacccatagggcatctttcattctgaatacattaaaactaatgcaagctggccagtaggtgggattaggagggggtacattcacatagtcacaggacaataagtaattttggatatcagctcatcaaactccttagtttgagaaagaaataataggctcagagaggaatggcatgcccatgattacacccagagttactgcctgaatgagggcttgaccctcactttctgactcccttggcagtgcaccttcttccaaattacactggctgcttttgtattttctccttcaacatagttgccaagggatgaagttttttttcagtctgaggttgtttgtttagagagagagtttgaagaaatttctccccctttgctttctaaaaaaaaaaaaaaaatttaggtttcccagaaattctttctatattaaaggtaaagttagttagttaagttttagtttaaataaaatcagtgaccaaaaaacagggtaagttttagtattgcattggtttgccagacagaattccctaagaagtctaaatatatataatctcctttgataatacatatgcacatctaccacctatacacccactcccgttccccacacacagaaatataaacactgccacttccttggcatctgtgaaagggtgagaggccttatgagggttaaatcaggatgatagactaagaaagacagctttaacttgggggttaaatcaggatgaaagaccaacaaagacagctcatttgaaagcagttctgtaaaggatttggtcaaacatcacttcttagtctccagaaactctgagttcatctttttgctaaggtagtgcttgcaagagcttcctcctgagcatctggatcctcatttctgcattggaagagaaatgcagaatcacaaaattttaaggttggaagagaaaatagaactactgtgatctaaacttctcccagtgcaaatctcttcatcattgggaaatcaccaccattcactgactagatcataccagggacagggagctagctaattagctctatcttccactttctttgaattattaacattatttcacggaagaagagtaatagctcccattccagcttgtgttataaaccagatctaattggaatatccttccatactttgatcagctttgcatatttcacccactggctccagttctgcaatgtgcatttccttcttatggtaatgtcctcctggataaaatacacagacctgtctcagaggttattgaagtctgtgttagcaggacacaaagtgaacaccatctctagtgtagcttattttaaggtgaaagaatgggagggtttcaatgcatagaggtaaagaattatctactttgtctaagtgtgtctgggaagaagattctttttttttttaagaatggtaaattccaactttaatatttcagtttttagtatgaattagcatatgttccataccaactttcacagggtggcatgcactttacactgacataggtatttggacctcagattttgagaaggttcagtgctcatttaggttgaaaatcctttatgccagaggtcacatcacagcttatccatcaagcatgaaatttggcagaaggccagtcaatgaccaaacatttctcaaacacctagcaggtgaatggggcatgtccaaaatacacagatttgaaaggaaatcattcatgcttttgtgccagtcataaactaatgaaaaagacagacacataaaccaatttaaaaaacaacaataattattgtttaccatgatcagtgctttcatgcagtcaggcacacagagaggagccctgaaggaggtgttaactctgtttatggggttggaaaagcctttacagaaaggacttattcattctaagtgtagaaaaatgatcaggagttgggcaagtagaaaagaatagagtgaccaaaggaacagtggatgcgaaaacgattataaagtataaatatgcattgcatatttaagggtcagttccaatagtgattttaaaaggtgttatttgaaatagtaaacctaccaaagagagtgaggattttgactctatatgagcagtagaaacaattatccataatcttcatgatttaaagaatgaatttaagattaattgttcctcagttccctccctttcttttctccttcatctataccttccaggcacttccaaagactcctaatgtaataagcccttgtatttacacagtactttacagattgctaagcaatcttcatatgcagtgtgctacttaatccttatcacaattcaattaggaccttcaatctgagttcttttccagacttcattcactgcagttgtaggaaaaattcttcccttcaccttgaaaatattaactcagtcacttcatcttatagaaagaatacagcattgtctaatgactagaaaggtcagggaaacagaacaattttcaaagagaaagaaggattcagacatcaaaatatttattcaatggtgagaaaaaaaaatttgctatgaaaggacaaaaatttgtgtggatttccaaatgtttcctgcttgggtctggctggccctttgagctaataaggttcccctctagctggaagagaagcctgaagcctccaagtgatattttaattcaattagtgtcttaccaatttgatgcagcaaccaaggacctatggtgtctgattaatatgctgatgctaagacacaagagtgaacagaatgcctatttggataaggcctggcagcaaagcgtggcattgctatggaaaccacagaaggacattaattagctatcaaataaaatcattggaaaattctggaccctggcacatctgcccccttcaaagagaagggcaagaagaggtcacactaacagcaaagctcccttcagtgattaaaatcaaagttacatgtagtccagagactacatgttgcaaagtggaagaaagatgggggagcaaaacgggtgaacacaataggaatgaggctttgggattattcaagtccaagaatataatttggaatgtggagtatcttgttgggttgtctgtattgataaaatgatccaaatgacaaatatgttatcctatactctgttatgtagaaagaaaatgataataatgatacggatccatccactagacggtgataaatgatcaggggtagagaccatagagtccaagactaagggtgattaacccctaatataatagatgcagatcctataacttttaagttaatagagaaaaaaacaattgaaaagaaggcaaaaaagacaacaaaagaatcattaaaatagctggacacatacaaacatgtacaataacgaaacttactatacagataatcacaataaacataattggataaaactggtcagtaaaaaaccagagactacaagttattaatttaaaagtagataaaggttgaaaataaaagaattgacaaaaatatgttagacacatattgactaaaagaaagctaatgtagcactgttcgtggcagtcaagatagatttttaggaaaactactttattagagttacagaggattaatttaccaggacaaatggagagaagactgcacaggtggaattatagacttttagggctaaagaagatgttacagatctttaaaacttcaactttttgaattatataattatataatttatataaagaatttgtataaagagaggattataccaaaagtttgaacactgaccgtgagtttagtcctctttttactgtctggaagtaaaaggttttctagtctaatcttctagtcagtataagaatcaaggatcaaccccatgatatttatactaatgggttaccaaacactctctctctcttcatatctatatagatatatacacacatacacacacacacacacaaatatatatgctgccagaccacatatatataaacatataatttcttgttaccaaaattttatacatagacatttttccaactaaggatcaactaaatccttggatgttcataataatcttaggctgagtggaggtcgatctcttcttgagaattgcttatcagtgactccagccttagcaactctaaaaacctaaaaggaggaggctgcctgagtaaactcttatcaatattccttctctctctaaattgttaccaggacctgcagttacacatgtgatgccattccttacttttcagtattggatctaactgtcagcatttgcagtcaaggaacatagtatattctctcactactttgtcttggaaccctcctcccttctcagcaaactcacaaattgacatggatgcaaagaatgcaatgggatagatttgaaccaatgagtgggaaataacatcacgtttactaaataaacttgtcacctagtcaacttgggggaaattacaaatctctttaattttaattaatttgaggaaagttacagatttctttgcgatatcaaaagctctatctaggttccttcccaataaaaatgtaccttcatatacacttttgaaaaatatttcacagatgccttaacaacttttcttgaacattctggaatgctaccagccttgggtgagtacctctgatctagtctaaaccatgagtttagtttccttttcactatttcatgcatagtttgaactaggatcacttaccaagttaatataacttgcatagcaccctcctgcccatcagagaaggcagtctttatataaagataaacatcttgataggaatggtagttatggtcactttaacaaaaccttgaaatatatcatagaaacacatttatttagtagatacattatttgtgagtattaactgaaagaaagaggcttctaaactggcaagtaaagagttaggctaaaggatgaaaaagaatgccttggtatatatggcataatcagtagacagaaagcatctagatcactgaacctgggataatggtgggcatgaggtttgaaggagacattgttaaatcagtaaaagaaaaatatctgccaagtagcttggaataaacaaataggtttcatgaatcacaagttgaattgctctctgattgaatatttgacctccactcccaacatccctcacttggtaggtgtcccctgaaactgtgttgattctactcaagggccaatctctccctaagagtggacaatgagccttttccacagttcaggcttcatagtcttcatgaaacttccagatggaggtatttatcccagtccaggaagaaaatggcctggataaaaattttaaacaaaaagctgcagagctgatgatggggagaaataagggatacccacactgaaagtctgaattttgtgctgatgtcaccagagatgactgtgctttccctgtctagtgattcccctcaagctttaaccagggagcagagattgtactgactttgccacaggcctgaatgcataaggagattgtaatgcctttataaattagggatgattataaacactgccaagggtttgttaattatatggtgttaatggtgtaaaagataattataaattaataataatgtcacctaacattttgtgagtgcacaaaagtattctgagcttagagactagacccaggttctgggtttttcctgaattttcaggcacctacagaaccagaattagaactcaaattttctaattcccagattagtgatttcaccattacactcaagcttattcctgacatgagaaaataacagggagcatacagctgtggctaagagcacagatttcaagacaggaaatgggacatagagcttggctatataccagctgtgtgacttgactgagatatttaacctctcttgcttcaaatgtttcttctgtaaaatggagattcttagtaggtcctccctaaaatgggtgttataagaattaagtacttttaaaaaacctagaacagtgtctggcatgtaaggagcctatctatttgttaaataaatggcacaaataaaaaatataattttgataaacagatagatagacaaattcatcttaataataaactaaaattagttgagctcatggcactagggagagccaagtactatagtacgaatttgatgcaagttattttatgtcttagtctgttaggagtgctatgacaaaatactgagactgagtaatttataggcaacaaaaatgtatttttcacagtcctagatgctggaaaatctaagattaaggcatcagcagattcagtgtctgatgagggcctgttcctcatagatggccttattgctttgttctcctcacatggtggaaggggcaagggagcttgagcttctgttacaaggtcactaacccaattaatgcgactgtagggtcatggcttaataacttcccaaaggccccacttcttaaaactataataccctaaaacttgggtattaggttccaacacattacttttggaggagaataaccaacattcagatcataacatcttatttaacttcatggcaacccagtgaggtgggtctaattaacacttcagtttacacacaaagtaactgagacttagaaaagtgaagtaatttgactatggccatgcagccaagtaatctgacaggtggccatgatggaattatgatttgtcagtctccataaacaggtcttctaactttgccaaatgcaatttccccaaaagatacaaataaatgctctaagaaagttatctgtaaggatagctcagactctaaaggcatctggtacctctcctttaatacagaaccatgaaatccctccgtgagccagagtcaagtgtatctggatagtgctaaatgtactgacacctggaatcatagagcttccgcctgttctggagggcagattttccatctggaagaatgtagtctgactcagagcacagatgcatttcttactccttctcaaacacctcagggaagcctgctggctccaggtagggctgccagctctctctggcaaagcagtattgactgtgcatcactcttgtctgggaaggagtggtactaagggagtgaaatgggcagacactgagcagtggcatgggtattttagatcaggagatgaaaactgtagtctgttccccagcactaaggcacataatgaaggccgttgatctccagctcagccagttcccatatttcatcatagtgggtagagcggggaaacagtctggtccaagccccgtgaaaacctatctgaggtccaataaatgtagaccaatatagcttgaggggatttttagcatgaatgaggaggaggaatgacttctgtagacagtaagtggggccctgtgaaggcatcattgtccttgttcagcatcctctgtctttctactttctcatattatttgtgtctctctgatcccaaaattccaagaatttttatccttgaccataagaagtgaaccaatttcccgtctcttatggtgacactgaaatttttgacaggcagaatgaagacaccttatcataataagaaagtttaaatgtttacgaaagcattacttctataagtgatgtctccggaaaagggaactataaatgccattttctgctcttctaggttcagtcaagtcttaggattcagcacacattgatagaagaggaaaagaaggcatataatttttactgagcctctgtgatgtcccaggtatttaaaatgtatcttatttaattcttacaaatctctaagacagagttattatttccatcatacaggtgaggaaaccaaggcacgagaaagggctggtaacttcagttttgcaattactgatttagcacaagtgttaagacatgaggatgatatggagtggttaggagcagggggccaaaggcctgaaggggtttacttcttggttctggtcttcacaaactgtgtggccgtggaaagttactaaatctctgtaacctcagtctcttcatctgtcatgtaggtagaataactcctacttcatcttgttggcatgaggacacatcttttgccagggtgtcatcgcttacatgagttagtgcagttaaggccctgtctataacttcctggcacctagtaagcattcaactgaagttagctttcattattcccttgagccaggcatggctcaagaccaagacttggaatcattgtccctttatgctccttggccttccctattgtgtatgtgtctcctctgaaatcctctccagcacaggaactgagtggaagagttagagataaatctctgccttccaggagttcacaagtgaccaatgacaacaaatgtactttaaactcaaaatggcagcagggtaccatcagaggagacatcatttttaaataattaaaatggaatctaggctgggcgtggtggctcatgcccgtaatcccagcacctcgggaggccaaggtgggtggattacctgaggccaacatggtgaaaccccgtctctactaaaaatagaaaaattagccgggcatggtggcacacacgtgtaatcccagctattcagaaggctgaggcagaagaattgcttaagcccaggagacagggggttgcagtgagctgagatcatgccactgctctccaggctggcagacagagagagactctgtctccaaaaaaaaaaaaaaaaaaaaaaaaaaaaaaagggaatctggaaacaagagaatgaaagactaaatttgtaagggaaggagctcccagcgactgttcccagtgtcctctcccctgacaaagcttcctatagcctcaccccatttcaaggcaatcagggatgttgcttagcaaccccaccaggaacagtggagtgagttctgtcctagtagcattaagggttgctactgcagtcctgaaaaggaccaaactttcctttaaaacccctcctccaacacaagggacaccagcaaattggaggcaactgggaagagagtcctctgaggggtaaggatgaacagaaggcaggtaaaggggaaaataatccatctaagttagtggaaaaatatagagaaaaatattattcttattttcttcaagcactgcaaaaacttggtgggttaagagagatttgccaagccaagaacttggtgagtctgcttcactgaattttgatgtggcaattgaggccagcaggacatgcccagtgtattagtcaattttcacgctgctgataaagacatacccaagactgggaagaaaaagacgtttaattggacttgcagttccacatggctgggagtcctcagaatcatgatgggaggttaaaggcacttcttacatggcagtggcaagagaaaaatgaggaaggagcaaaagtggaaacccctgataaacccatcagatctcatgagacttattcactatcacgagaatagcacaggacagactggcccccatgtttcaattacctccccctgggtccctcccatacatgtgggaattttgggagatacaattcaagttgagatttgggtggggacacagccaaaccatatcacccagttgccagctcctgtaggcaatcactcccaatagctgcagcctcttggttaccacctacaagttcaatctcaaagtaagatatggagaaaatattatccttagtcagtagagactgaaggtgttaaagttcaactctatgttaattcattcaacgcatattttttgaggcttgcagttcagataggcagttgagcattagtttttaagtgtgatacatgttaaggagagggaagtttaagatgctattggagtgcacgacatggactcttaacctagattggaccgggaggggaaggttgcagaaagcacctgaggatctgatgtttaataggagtcttgaatgataagtcaaattgaatgaagagagcaaaggaaacatttttccatggggagtacacagtttaggcagtggtccagttcagctggaaatgagagaagtggatgaactggggatggggacacagagtagtagtagcagaagataagggtattaggcagtcatatgacgaagtcttgcaagtcatatgaggattttggactttatcctaagagctactggcagccattgcaaaatttccagcatgacgaaatataatcaaaagtacccagcatccattcagcctttctgctatcccatcctactctattgttgtaccacagtatttggatccctgctccagtctcttgaactccttgatttccttcttagattccctgtccctgaagaaagggaaccttgctagtttttttttttgttttttttttgccacatccgcactccttctttgatgtatagagtcctgctcttgcacatgagcttgtagcatccatttacctgtcatttcttctgtctttgcctgttacaagactatcagtcatagggcttatccctgtcacccatttccatgtactattatggctgcccccgatgctgtttgattagactacctctccattactctctattatcttcatcctccctataccaggtaacacccattgaagtagttatcttcccacacactgtagcagctgtgtgtgaaccaactacttgcccaggaactgatccgctccaaaagacctgtctcattttgagttctgtccagaacagagatgacccaaaatattcatcctaaccattcacctttttagaatagtggctaagcacactgcttctggagtcaatttcccttgtgagtgaatcttggcttgcactatgacttagctgggtgaactttggcaagttagttaatctctctgagactaattttattattcttacatgaagatattgttgcccaccttatggggttgttgtgaggattaaaagagactatgaagagaaaatatctggaatagcaccttgcactagaaggaacaaaataaatactggttcctcttcacccttcctctgaaagcacattatctgcacaaatttctggttttgatccttacgatatctttctaaaattggagaatcaaaggagattctgcatataaagcacagatatatagtataaacaaaataaatatagctaatattattcattattattataaatgaagcagcataccccaattgagagattaactgtgtcttattttcttgaatataggctcatgattaatgaacaagaggtaaccatccatatgataattcctttctgtatattcatatgtaccatgcacatactgcagtatttgtcttctaagttctcttttctatctttgagaaggaccagcagcctctaaaaccttcctgttagtttcagaggctgtcctgaaacaacaacaacaacaacaacaacaacaacacaccttccttttcgtttcagaggctgtcctgaaaacaacagcaacaacaacacacacacacaaaaacaactccctctgggagattaacagaatagctgaattgcaaatcttcatagctgccattgttatccgagtttagaaaaatggcatcccatgcagcagtagtgatgattaatattatgggctgaattgggtacccctaaaattcatacgttttaagtctgaacccttagtacttctaaatatgactatatttggagatagggcctttaaagagatgattatgttaaaatgaggctttggggtgagttctcattcaatctgactagtgtccttacagaagagacaatttggacacacaaagaaacaccagggttgtaagtccacagagaaaaggctttgtgagtacatagcaagaagacagtcatcaacagaccaaggaaagtggcctcagaagattccgaaactgctgacactttgattttagaactgctggcctcccaaactttgagaaaatacatgtatgttgtttaaataacccaatggtattttgttatggaagccctagcaaacgaatacagtggcccattaaaaattaggcaatcattgtagaggtaggtagaggccaggtggagagagatatgtgtttgaatcaaaagagagaatggttgtttgggcaatcccggctcagatgtcctgagaatgggtggatagagacctgcattttgctttcctacggagaactggatcaatgcaactgctgccctaggtgccttggaaaatggatgcctggtgtgtgtccttgaggccagtatctaggtcctcttgtgaagactgtaagaccattaagaggacaccacaagtggcctcagtgtgactctccatggaagcagcaccctcaaaggatgccttcacaacatttccagagactgtttgcaaggcagtggtttgaccactaaccggacctctgcctcattttcctggggccatatgtgcagaattgatgcagtctccagaaggaggttgcagggagcttcattaatgagtgcagtggtcatcctgctaatcaggtgggaggcaattcagaaccagaaataatatattttaaaaagaaagacatgtaacatttctagcatctgtatgttgtggaataaactaatatccatcatatataaatagagcaactagaaagtcacaatgtatattaaggcaagaggaatacttattttgatctctgttgcattcctactgcaagcataatgtctggcaccaggtatgtgctcagtaagcatttgttgaataaaaaaaaagaagcattcatatgttatttccttcatttcagagacgcacaggcagaggcccaagcagtaaagagacctcaccgagatcatgcagtgaatcaattgcagagacaaggcaagattgaaaacattttgactccaattccaatgctctgctgaaagcccatgtagatatttaacatcttttctgcctgggccagaatgtgcagaattatctagtgtgacaaatcctcttttcctccgtccccgtgcaaagggaattgccatcttctgtgatcatcaagctggcaacatcaatctggaagtttgttaatgacactgacctaaatctgtcacattgcaagaaactcttcacagcagctgggatttgctgccatataacagctttatggtatgtggaactctctaataagctgattaaaaaataaaatgtttgaagccttaatatgtacttttcagacatctgataagaaggaaagtgaatggaaacctcaagctgagtgtaaaaaaagcagggatcctgttgtatgagaagatgcacatccttgggttgaggcactttctcacagttatcagagcaaaggtctggcatgaccatatccttgtttaaacgtttcttggtggtttgtcttattgacagttcagtacatgcagaataaagtcataggtaagcagtgggccttcttaggatgaattgacttctgactatggctatgaaacaggaccattttatcacttatgtgcctgacactgacgtgtgcatctatatctctaattctctaaaagactctgaaggcaagatacacatggccaccctcattttactaaataggaaactgattctcagcaagtgtctttggtcttgaaactttggagtagcaggagtcacacaagctctgtctgacactcacgctcatattattaagccattctttccttctttcaaatcaagcaaatgtgagcacctactatgtgcttggtactgcagttaaatggcttgctacctcaaagcaaaggaaaatgtactagaaatcttcctcaattcagaaagtttttacagtgtgcttgagtgtaccaaacttctagttgaaatacagatctcattattatcagcacttttctattatagtaggaaacctaatctcatagatgagcattttataattaaatattgggcagaaaacaaaagttaatttagcagagctgggttacttaaaccgtgcacattcccaagcaagatttgtcttcagggctggtctttggccaactcttaggagaggggttctgagccttgctttattctgcttgatgagagtatttttgtatgcttagggccatgggccatgctgtaccattttgaccagatagcttctgctaataagtgttgtttatggtgaatccctgtttttgctctggagatctggaatcaaaatagttgagatcagttatacagatgttgcatgtctatgtaaccagtccctgctaaaaatcctggacatcaagattcaggtgagcttccctgtgaggcaacacttcacatgtattatcacacaatgttgcttggagaattaaagtgtccatgcaactccacaaggactggacacctggaagcttgcatgagcagtttcgcttggacttcaccctatacaacttttccctttgctgattttagtttgtgtcttttgctgtaatgctctttaacagttaatataacaacttctgtgagttcttccagtaaatcatcaagcttcagggtagtcatgggcacccctatataactatctgcttccccactcatcatcttctttattcctcttcacactcctgagagcaactgagctggcatatccattctgtgaataaggactcctgggctcactaaggtaaagtgccttctttgatggtgttttagggggtccaaagtcacctgcagtctaaaccagctgaccttgagaatggttaaacagttggagatctatgttttgcctgtctcactgaaaaaggagaggactgtggatgtggcttaggtgcacatgataaagggctctctatgactacatcccagaattatgggtacacccacccagtcacaaatggccctggatgactacagtcctctgtgaggaatgagtttccctcccaagcttatggcatgttagggagaagactgatgcacgactttgcaaggagacagagccagaaagtcacttgatctctcaaacacaactgtcagaacagtcactgcattcttacatgaggaataagtgaggaagtagagagattcatggaacatgcttctgattaataggtgcccttctatgcagactcagtgacagagaggaaagaaaattgcttggatatttcagaaagtcagcagtgctgccagaactagaactcccagtgttcctggaggccaggacatgtcctccgacaacattctacattgacctcatggcaaacactgtgctttttattgttgacttctgactctgagggtctccatgacataagatactgccaatgtttaaaatacaaaaaagcaataaacaaccttcattgaactcaattagcaccatatagttgaggaaaacaacctccctccctaaagacccaggactatttctaaaagactgtgcctgaaatataagataagcataaatctttagttcttctcaagctattttgcctctatcagaatgtggccagatattcagacctggccccatcagccacttcttagtcctgtctcaactctctccccttttatagactaaaaaaagctgttgtgaaacattaggcttctgtgtctcagcttcattcattcatttgttcatttattgagcactcattaagcattagctatgtattaaatgttaatctatattttgaggctgcaagaacaatgaagtccttgcctcaaagggtttaccctcagttttaagaagtagagcatgctgatgaaacatagaaacatggactcccaaaacaaagacagacttatttgcaggatacagtcaagatatagatgagagagtggtacatcttatttgcactctaaaaacacctacttctgccctgtcattcacatcagctccccattttctccccaacttccaattacctctttttgccccattcttcagttattcccaacacccactcatgatttgactaagtgccctcagtacctatatccctcaccaaccatgatggtttggaccagatgctctactgagcctagtgctcagtctgtaccagttcaattgccattcagatttgggccttgcagcctgccttggcaacttctgcaaggcttttgccggcagagctcaaattgcacctccagagacctagaggttgtgttgtactttctatggcaagcgtatggcctggaattgcttatccaagctgaaacacaatccactcacctcctggtttgggggcatgatttaaagccttaatggtgtctcatcgatttcttaaggtatgctcagaactggcactctgctcttgcatattttaatcattactgtttcattcttgcatcctgaggtgattttattggaagaatacatgcttgaagaagttgaattaaataaagataaatctcattaattcaggctccactaattcaggctgtactcaaacataactttgtgttatccagaagtaaaaaagattttctaaataaattaatgatggaaataagacctcagggggaagagaatgtttcacctgtttaaaaggcagtgcttccagacactgtagggatttcacaagggccatcaacatacaatttcctttgtgtttgtttattaaggctaaagacttattcatcaaatacaaatttcctgtttggcaaacctttcctttagtttgttattttgtagagttggaaaaaaataaggctacacatcttttaaaatagtcaccaaacctaatcctctccataatgctaaatatattagagacatattgtatctacacataaatacatgtgagcacacattaaaaatacaatggaaacctcttaaaatgaagtggcatatttatggtgggtaggagaaaaggtgatttttattttctactttatatttttaagtattttctgtaaagaattcttatttttatcatcaacataaacatgtaaaaaatcactaaagtttttgaatacctaacaggtctttcttccctccaaatagtatatattaagtaaagctgagtcatattcagcatttatgaatgaaaagacttggtaagtagtgtgagaagctgttgtaccacaattccaaaatttatctttaggccaccattgttggaagcaaacaatcaggcaatccattcaatttagaatatgaagggagccttgaatatctcttactttgcatcagcaaccacctgttatgatcatggcaggattgtgggagaagtcgaggaggatgttgattctgcctttgtatgtgttccacagaagttcagaggtgtcttggtcaaactgaggcagctgacacccagcacagtagactctgtggtaactgaataccttataagccattagaagtgctaaacacctcccattaaacttctccaaatcctattggttaccattacaatgattacattacaatgactgcaggtgaattgaatatcttatttgttccaggtaattttccatgcactttgaagatagaatttactttttcaccacaaataatcacagattgatgctcagggatagggaagaaattgtccaggtttccacagctggtgcactacggaggcgatattcaaagccacagtcagccaaaagaaagcccctaccctcaacaccatacagcactgagtgccacagcctaatagccagaccgcattccggctgttgcaaatatccatccaggcagtgcactgggaacttcaaagggccttagtgtttgctggtcattcttgaattttgatgtttgattcttgagataaacatgaggttgaattgaccagatacctcccttgagactggaacatatttataggctcagagaaagcacagtgtaaagaaagagcactagattaggggtctaacagttttgagttttaacctctgcttcttctcctaattgaatatatgatcttgactttgtgtttcacccctgtaaacctcaacattttaaaatcgatcagcatatacaccaatgaggagaaaaaatgagataaagtattttataatgactttaaactttctttttattaatataattttaattaatgacatcttcagcttcacaatcaactgtcctcaatgatctaagcatgcaattcagaattctctgaactagatagtgcacataggcttttgtttaacatagacttcagtaggtctttctggaagtaaatagtgccattttaaacaagaatgtgagtccagtctgcaatcaggcaggtattagtaatttctatttttcttgcctgccctaaccttctaaaactcaaatcatgaactcagatattttattattgatagaaatagatgtcaaatggcttgataaataaccagttaggaaggttgttcttactgtaataatcccaaaatctcagtgtcataacattataaaattctctctctccgtatcatagtccaatgtcagttgggtgtctcctcttggtgtctcctctgtaagtagaaacctgaagatccagatgcctttttccttgcaatgtcagcatgttaaatatgtggcctccacggattattacagaagagagagaggttcttactgaagattttagaaatcagacctgaatatgttgtgtattcctttaggccacattatattgtccagaatgagtcatatgatttcagcctactgcaagtcttactgtgtgtctaggaagtggagatggaatctgtgaatacggtggtttcttttcgggacatggggctgaaacgcagccacagtgcttcagtatgctgagagtctgttcttactggctggtgtctttgctgttccagttgttcagtattatgctggctgaaattgcttgttatagtgattaagggcagtgttgaaataggtttatgttttgtttcatttcattttattccattcccttccattttactttattttatgaagagagtgtaattttattgccacaaattaccatcccatatgtcttgtaattggagtcatagaatatgtagcctttccgatcgaggttttcacgtagcagtatgcatttaaggttcatccatgtttttgatagcttgataacttgttttttaatcgctttgttgaattggtgtaccacagtttgtctatccattcacatactgaaggacttggttgcttccagctcttggcatttataatacagctgctatatatatttatgtgcagattttatgtatatataaagtttcaaatcagttgggtagatacctaggagcacaagtgttggattgcatggcaagacaatgtttgattttgtaagagactgccaaagcgtgcaaaacgtaccgttttgcattcccagcagcaacgaatgagagttcctgttgctccatgttgtcaccagcaattggtactgtcaactttttaaaaatttgtcattctagcaggagtgtagttgttagaaatcctttttctttttttttcttttattttattaagttttaggccttttaaagcttcaaatattctgggaccactataaacacagccagacagtggcctagcaaatcctcttgacattgacattattcactctgagtgggtgactggataggtgatgatgtaagggaagatataattttccccatgcagattggataagcaattgcacagggttaagctgtataaaatactcattcattagagggctgaatgatcagctggtaaaatctctgatttgacccgtctcttgggcacagtgacagtgcccaccacagagacagtggtgttctctaaatccatctccttcacaccttcttggaacataagtttgttgctagagccgctctgtaatctattttccatggcagaattagctgagagatagacagatttaaatcatcacttaaattatatagaaaatcctgactctaaggtttaagggaaacacagagactcgttcttatagaaaccaagaaattgatttctaaggaaaagaatgcccccagggaagaggacatagcagatatgataagaaagaatcttgagttaatacctcagaaactaagcttccagctattcaactttctcttctgtttacacaaagcaaatagcttgtgtgaaagaatggcctccattcaaagataattgataacatcataagattcagtattttacctatgtataatacataggtgcaaaaacatgtgggagtacgtatatgaacaaaccttcaccccatactcagagggaaatacattactgaaaccaggcaaaaaagaatataaaatgtacaatcagaagaataagtgaaaccaaaattatttaaaagtattcagaaaaaaatatctcattgtctggaaagaaaaaagttaacttcagtaaagaaagaagtccataaagcattataaaagaagaaaacaagatgatagggtatagacataaaaagtgaactaaattaatttttaaaaaatttagaggagaataataaaaccattagagaaattgaatcatcattagaagaaaaaaaaaagtagagttaaaactttaccaaacatcaaaatttgtgaaggacaagtttagaaaaataagataaaataacaagaaataggaaagcagtaaaagtgatccagaaaatttagctaggattatagaagaaaacagccatataaatgattaatgtttctgaaaaagagaacaaattgggtagaaaacaatatttataatgtaacagaaaaacactgaattaaaaaaatacatacacaaagtgaaagtgtgtacaaagtcttcaaaaatttgatttagcagaaaaacatctaaagagaaacatatcaaatgtgagacatagctgtataagttattgtttctaagataaaaaatgactcctaaaggcattcaaacacacacacacacacacacacacacacacacacacacacacacacactcccctttggagaggggaatgaggaatagactagtttctgctgttttttttttttttttctaggcaacagttaatgctagtagacagtgaagcaatgtagacaggcaaggtgtaccctgctctaggggaagggaagtgtgacccaaagacttcgtgccatgccaaattggtgttcaagaataaaggcaatcaaaagccatttttatacatggtagaactcagagtaaacgtcacccatgagcctttcttgaaaaaagatgtggtcttaaagtccagtcaaccaagaaatgaagcaaaataaaatgcatagaaatggaggaactatggtaacaaagttctacatactgaatttattttaatttgaactaactttgaagaatggttggaattttggttaatatgcaaaatgttgagtattataaaccatgaaaatacatatgaaaatgaaactaagacaaattagaagtgagaaacagagaggtggatggaagtttgtgtatgcatgtgtatttgtttgtacgtgcacatgtgctaatttttaaaagttttcattgtggttggataattttataaatattacttatatctgagaaagcaaaaacttatagatatcattaataaaaatgaatgtagcaaatagggttttacttttattgttaaagaaacttctaacttaacagaaggaaatcagaaatataaaaggaaacaacaaaacacatgcccaaaagcaaaacatagaaaatataatggcacaaaaatcagaggtaaacataaaataaaatgatagaatgaaatcaaaaccagacaggttcaattacaatgagatggactcacatattattttttaaaacccatcatattgattcagaaaacaatatggagttaggagaagttaaaacagatatctccaaacaattgtaaaatactaaatagaggcatactagtctaacaaaagtaaatcagaaattaagttacaagcataagagaaaattaaaatcagagttaaaataattaaaagaagagcacttttgaatgataaaacaatggaggtctcattgtcatgaagtttcatgtttctaatatcacagcattgatatttttaaaaatgtaggctgggtgaggtggctcatgcctgtagtcctagcactttgggaggccaaggtgggcagatcacttgaggccaggagttccctgactagcctggccaacatggtgaaaccccatttctactaaaaatacaaaaaaaaaaaaaattagctgggcatggtggcaggtgcctgtagtcccagctagtcgggaggctgaggcaggagaatcactggaacctgggaggcgaagcttgcagtgagccgagatcacatcactgaccccaatctgggcaacagagtgagactctgtctcaagaaaaaaaaaaaaagtaaaaaatgtcaaaattagcacatacaaacgacattggtgaggctttccaataaaactctcagctgaagaaaaataaatcaagtagaagaaaaaaattagatgcaaagatattatgtaaatagcataactaataaggcacatattattaattttataccagagaacagcatattctttacaaatgcccatggaacatttacatatcccaatcttgtgttgatttacttcaaacttgaaaacttcaaagttaaaaaaaagaaattgtataactaaatttctgctcacaatgaaatcaaaatgggattgccaaggcaagatcagaaactccatttatcccacactccaaatgattcttagaacaaaaagaaaattacaaccaaaattattgaatatctagaaaataatgataacaaaaataccatagatcaggctatatgtcatagagttataattatgcttagagaattcatagttattaaagtatttatacataaaaaagcatgaaaataagttactcattcatctaaaaagtttcgaaaaagaagatcaaagtaaacagaagcaagacaaaaggtgggaattaatgagcaaaaaccaaaattaattattttgaaaacagaaatagtagaattaaaaaatacaatgaccatagtcaaaggttgtagctttggaaaaaatattccttaactatctaattttctacaaagtgtatgcatgtttgtatgtgttaagggtggcatatgtgactagaaaatgacaacatcgatgccaaaaccagataactggaacaaaatagaaaaatgcaatatatcacatctctggatattgttataaaactctaaagtcttagcaaatagactccatctctatatgaataagtaggtaaacacattataatccagtagttttcttttttctacgaaggaaagaactattcaagattaagtattacattaatattattcaatattattcaatatcttaataaagcaaaggaaaaaagactcagcatgtggttatctcaatacatagtcaaacaaatcaactataaagtgtacctaatttaatttgtatatgcttaataaaataatggaatagaacttcttttttttttttctttttttgagacagtctcactctgtcaccaggctggagtgcagtggcccaatctcggctcactgcaacctctgcctccctggttcaagtgattctcctgcctcagcctcccgagtagctgggactacaagcgcgtgccaccacgcccagctaatttttgtatttttagtagagacggggtttcaccatgttgaccaggatggtctcgatctcttgaactcgtgatccgcccgcctcagcctcccaaagtgctgggattacaagtgtgagccaccatgcccggccagaatagaacttctttaaccccgtgtaaaacaaaaagttgtgaattttgagacagtagaggcatttttattaaagtcaagaacaatgcaaagaaaatacggtgtaggctattaggagagttcacagtagtgttctttggggtgtggacttttcagagagactgatttttgcattatttgaccatttaaaccaaatatttaccatatgcatgcatttctttatagtaaaatacctaaaggaggtattttgtctaaaggaggcaaaatggccatactttccattgaataagtgagagttatataatttgtaaaggctatttcatagtttttatcaattaatttacaaataaataaaataaaatttattttatcttgaataaaaggaactaatagatgattgataaattgtaacatagtggttaaaatattagtctatggaggcatgcaggcttagctggagtcatcatcctgtcactaaaacatgtgtaatctctagtcttctattcagcaagcaactatgctctaggcagttttcttattttctatgaacctcaatttcacattaagatggggataataatggtaataataatagagataattagattaatacctatctcataaaactattatgaggattaaataagcaaatgaccataaagcttttagcacaatttctgacacagtaattacttaaagtatattagctataatcaaaaagagtagaaaaaatatgccagccagtcaccctctcactttaggattacctattaagatataaggtgagagagagagagaaggagggagagagagaaagagggagcgagggagagagagagagatctatgagagacacctatgtaaaacagacatgccatttatcttatttgtcttctaaacaaagtggcattcatatagtttgaaagcctgattttactcattagcaatgtattgccaatatctttccatttcagtaagcacacttctgtctctgctgccatgacttgattcaagccaccatattttcttgcctgaatctttgcaacagctcctaacctgtctccttgcctctattctatttcttgttcacggtcatgttactcaaattcttcaaacttgtcagcattccccactgcccacagggcccaagctctattatatggcataggaggcactggatgatataatatttgtttatttgcagagctttttatttcatcacattcctccatgaactttaggctcttgtcacaccttacttagcagagcaaaagactctagcacttgcctttctaggagtcaaaacagtggaacttgggcatggaaagcacacggactttggatccagaccaacttgtgtttctaatcttggttccaacaccaagtgtgatgtgtgatgtgttgccataggaaattcatttgatcttatttgctaagaaaatttgcttttgatgaaaaaaacttttcttgtttaaacatctaaataattgttgggcttacaaaccagaatacagcaataacttgcaaaaagtacagtgtttcccagatagtaataactggctttttttctccttacaacagaggcaggctttctaataactggacttttctttaatttccactatcagtaccttagttcccttagtcgttcttacttggattatgacaacagctttgtaaactggtctccaaatctcgatttggtccctcctcctatcctttctttcagattcatctttgtaaacatttctctgatcatgtctttctgctgtttaaaaatcttcaatgatttcccatgaccccagactaaattcctacctcctaacaatcaatatgctcttccagcccatggtatcccagtcccctacctttgtctgtgctccagcattctccagatctttcccatctctgtgtctgtgctcaaattgttcctgtttccagaatgttctaccctaaccactgcctttgggggtattactccacctttttgcccatattgccaacacttccatgaagctttcttggacgcaaatgggtttcacttcttcatattggcaccacattgttgggatgattctcacatgtatatattatatgtttacattataaatcttttttaaacctccggtagattaggagttccctatgaacaagggaggtaacattcatctttctacttccatcatctggaaccatagttggaacactacgataatttaaaaggtgaaagatttatatgatttgaagagaaaccagagtataacactatgataatgtaaaagaacactcattaaattaagtgagtgaataaatggctcaggagcataactttacctctacctcactaccaacattgtgtggttgaagttcagttgaataatgacttcagtgctgtaccattgtatggaaggcttaacagcaataatgcctacattttttgacacactaatttttgaaaaattaacatatgcatatatataaataatatgtatttgtgtatatgtatatacatatatgtgtgcatgtgtgtgtgtacatatatacatatatatatatatactttttttttttttttttttcattttatgcacatgggccatctcgaaaaagacatcaattttatgctgggcactgtagtagttattttatattttggtcacatttcattctaacatcccaactagacccatttcattatccctgttttacagatgagataactgagattcagagatgaaaacctagcctacttgcctctggcattatacattttcctattacattacataacctatagaaatacagttcctttttcatggcataacaatgacatgccagcttctgtgtttggcccattacatctgtctcttcttatcattatgcccttttgtaggacatgagattccagaggttaaatgattttctcaaggccattcaccaataaaaaaaaaattaaaactcctatctgtctggctttaaaactccagtgccctagattagactccatcactgccttaaaagacatgccacaaactattttattccactgaatgagatatgatgtaataactaatttgttaggctggttcatgaggttcatacaggagcaagttaagagacaacgtgtgtaagaatcagatcaccagggactttgcatgccatatgatgcagtttggactctctcctgcaggcaaagagaaaacactaactttagcagaggatacacaaacagaagagataactattgggactcctgatggtggctaaagcataggtgatgaagaggagtggactgaattgaaaaaaaatatttggaaggttgtccatttaacacctctgacaattgcctcttaagcaaactttgcaacaatatgaagttcatttcagcctctaatgtaactgttaaaactaaagtgaaatttgtggttactattacccatagacctctgtcaccattagtggggataagatactctccaataagaaaaatgatcattttacttcacaacatcattacatcattttaggagatagcaagatactgccctcaggttggtgtacaagagtcagtctttcctttgtaaaagaatcaatagctgttctgctagcaatggctacaaagcaccttttaaaaatagtaatcgtggaaaggctgaatccttcataataaaaatctttaaaacctttataaaatctctcagtaaagccactttcctggggagacctataattattgaaaggcaagatgagagcatcagcccatttcacataaacatgggcagtgtgagcctcagccgggaaagctgagggcagagaaataaaactcagatctgagaaaatgaaccaggatcaatttttcttcccaatgtattttattgtatacaaacgataaagcataaacagcttctgatttcccaccagactgattttttttctaaaacagctgtgtgctaacattaactctcaaatcctatcattccaatatacacgccacattcaagctccatgcattctgctgaagttaaccctattttcatgccgcttattgtacttgaattttaaattcaggtatttagttaacatttaaaatcttctctgggagcagtggctcacacctgtaatcccagcactttgggaggctgaggtgggtggatcacctgaggttgggagtttgagacaagcctgaccaacatggagcaaccccatctctcctaaaaatacaaaattagccaggcatggtggtgcatgcctgtaatcccagctacttgggaggctgaggcaggagaatttcttgaacctgggaggtggaggttgtggtgagatcgcatcattgcatgccagcctgggcaacaagagcgaaactccgtctcaaaaaacaaaaaacaaacaaacaaaaaaatcatagtggtggggttaatcataccccttcaatctctgctcaatatactagattagttgttattcaaaaggcaatgagaagagaagctggttaaagtcaagttcaccccaactgcccctccaagcaatacttctgcttttagcaacctttttcaaggtgctgtttccagcaaagtcttacaggacttagacaagtcttcttattttatactgcatgggcagaagaaaaaacagaaggccaagaaaccaaaactctgtgtggccttggtgatctatttcatcacctgggtctcagtttatttagctctaaaatgagggtgttggaccagtgctttgaggatacatagttttaatctcttggaccaattttgatcattcaatagtgactgcctcaagtgttgcctggattctgaagtagactccagcctcaggaggggaggatatcatgattgattagaggtgtctaccaaaagtgcaagatgtggtagcagcagcataaatgccaatttttttatattcttggaatatggtacttttagttcctatgtgattcctgctaccattagaaaagaggagaaaggctatataccttgactaagcatgtggattcaagagttgttggaagaggaattcaatattccagaaaatgatgacaaaacaggtattaaaatagaatccagagacaagttattgatcatgaaataagaaaatcagggagatgaaagtggagagaaatacgcacaggcatataaatgggctgacagttgagataaggcatgttgtgtgcagttggttctccctggcatgatgcttgaggtttagctgtgtattacggaaccctccccttacctgaaagacatatggaaatgtcccaagacatttttgattgacatgaccagagaggagtactactggcatctagtgggtggaggccaggaatgctactgaacattctacaatgcacaggacagtcctgcatgaataattatccagcctcaaattcaatagtgtcaaggttgagaatttctgtattaaaagaataaatcaaaaataaataatttaaatccctattctgcatgtagtctactgtgccagggactccagtgttcatccacatgcttgaactcctcttcttctttaacccacatctggaccatgttttccatccattctttaaagtcagctatgaccatatgatagagtttggttcaatgggatgggaatgaaagttacatatgacacttctgggactgaccctttaataaactttccaatatctctttttcttcttgcaatagctgaatggagaggactcgctcacctagagcaagaaaagccacaaaatgaacggagtgtgggccttgaattactatgcagagaagagcatcccctcaacccttaattcctcacattggattgtgtcgtgcaggaaatataaactttaaacttttatttcatcaaacccttgaaaggtaatggtgatatatgacaggaatttggctacttgagtgaacaattaaaaatctgaccaattggactgtcttagtccattcaggctgctaaaacaaaataccttagattaggtaatttataaagaagacaaatttatttcctataactctagagtccaggaagtccactgggaagacattagtggattcggtgtctggtgagagctgctcttggcttccaagatggctctctgctgctatgtcttcacatggtggaagagcagaagggcaaactcacacccttatgtttttttttttttacaaggacatgaatcccatccatgaggttggaccctcatggcctaattgcccctcaaagggtccacctcttaattccatcaccttagggtttaagttccaacatataaattttggagggacacatgcaatcaaaccacagcatggactgaaagttattccctagcaggatcagtagatcagcattttttccagcctaggtcaatcagttggtttgtttctatttctctctttcaactgtcttgtacgtagatgcaagttttgttaacttcccttttatgctctttattatcagtgtaaacttccccattcttaggaactcattgtgcatcttttttctttctttccaagcaggttgacaatctgccttagtagctacaatgtctcacaagcaggaacaaggggataagtaccgcccccccccattttttatatcaggatttccgagatccctgaggcatcttgacttcacaacagattacaggcaccttgtatgattttatttttaaaaatgtaaagtactatactaggctctatgggtgatataaatgtgttttatatgatcattgtcttcaaggaatttatattctggtaaaataaacataaaaatgcaaggaacgctaagataaatacattataagaatgtaagaatgtcccagaagacttcacagaatatcatatgtggttagaaatttcataaaatgatgaagttaagcactgtcctttatggttcggaaatgggtagaattttgatggtagtattttgatggtagtatttttttgatggtagtattttgatggtagtgttttgatggtagtattttgatcgtagaattttgatggtagtattttttgatggtagtattgtgatggtagaattttgatggtagtattttgatgatagtattttttttattttattgttattatactttaagttttagggtacatgtgcactatgtgcatgttagttacatatgtatacatgtgccatgctggtgtgttgcacccattaactagtcatttagcattaggtatatctcctaaagctatccctccccccaccccacaacagtccccagattgtgatgttccccttcctgtgtccatgtgttctcgttgttcaattcccacctatgagtgagaatatgcggtgtttggttttctgtctttgtgatagtttgctgagaatgatggtttccagcttcatccatggccctacaaaggacatgaactcatcattttttatggctgcatagtattccatggtgtatatgtgccacattttcttaatccagtctatcattgttggacatttggcttggttccaagtctttgctattgtgaatagtgccacaataaacatacgtgtgcatgtgtctttatagcagcatgatttataatcctttgggtatatacccagtaatgggacggctgggtcaaatggtatttctagttctagagccctgaggaatcgccacactgacttgcacaagggttgaactagtttacagtcccaccaacagtgtaaaagtgttcctatttctccacatcctctccagcacctattgtttcctgactttttaatgattgccattctaactggtgtgagatggtatctcactgtggttttgctttgcatttctctgatggccagtgatggtgagcattttttcatgtgttttttggctgcataaatgtcttcctttgagaagtgtctgttcatgtccttcgcccactttttgatggggttgtttttttcttgtaaatttgtttgagttcattgtagattctggatattagccctttgtcagatgagtaggttgcaaaaattttctcccattctgtaggttgcctgttcactctgatggtagtttcttgtgctgtgcagaagctctttagtttaattaatcccatttgtcaattttggcttttgttgccattgcttttggtgttttagacatgaagttcttgcccatgcctatgtcctgaatggtaatgcctaggttttcttctagggtttttatggttttaggtctaatgtttaaatctttaatccatcttgaattaatttttgtataaggtgtaaggaagggatccagtttcagctttctacatatggctagccagttttcccagcaccatttattaaacagggaatcctttccccattgcttgtttttctcaggtttgtcaaagatcagatagttgtagatacgcagtgttatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcatgacattgatttttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatctgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccgatcaatacctaatttgttgagagtttttagcatgaagggttgttgaattttgtcaaatagatgcaataaaaaatgataaaggggatatcaccactaatcccacagaaatacaaactaccatcagagaatactacaaacacctctacgcaaataaactagaaaatctagaagcaatggataaattccttgacacatacaccctcccaagaccaaaccaggaagaagttgaatctctgaatagaccaataacaggatctgaaattgtggaaataatcaatagcttaccaaccaaaaagagtccaggaccagatggattcatagccgaattctaccacaggtacaaggaggaactggtaacattccttctgaaactattccaatcaatagaaaaagagggaatcctccctaactcattttatgaggccagcatcatgctgataccaaagccggacagagacacaaccaaaagagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaacagatgcagaaaaggcctttgatgatagtattttgatggtagaagtttgatggtagaattttgatggtagtattttttgatggtactattgtgaaggtagaattttgatggtagtattttgatgatagtattttgatggtagtattttgatggtagaattttgttgctaatattttgatgaggcagtaaggtgtcaattatactagggggcagcagaaagcgttattgtttagtttagagcagtaatgtccaataaaaatgtcagtcacaaatgaaaaccagatgagaattttcatttttcaagtagccacatcagaaaaataaagtacaggtaaaaataatttaaacagttaattttaactcaatatatcaaaatattatttttcagcatatagcaaatacaaaaatattaataaaatattttacttttttcatttgtaatacttgaattctgtgttatatttcacacttctgtcacacctcaatttggactagtcaccttttaagtgctcattcatctcccatgtgccttgtagctatcatattggatggtataggactagagaacatgtaggttcaaggactttatcattttaaaaattatctgcattgcccagagcacaaatatttttacagtagagctcaatgcgatctgttaggaagaattgtttcaatacatacttccatgggagacacaggtttatgaagcctctaagacaggcttttctgttgtgttatagaaagagctatttcactacagaagaaagttttaattggttaccccccatcacctttctgaatgccagtctctgatatttgactttgacattttaatgcctatctttctgtctcagctacaagagactcattgcaatgaagtcaccaacatcaccctggggcagcaggctttaacattcttagacttgtgagcaacatcaccaactttagtccctgaaccatgtctgggtcttccagagctaattctgtggttctgaaggttgctcaaaatcacttttaaaacttttagacattctggatttaaaaataattaaacctgatgtccgcattttctgttttttaagttttctattttgtgtctacatttttccccctttgaatccatgcttgtctaatcacccttgtcttcttaaattctctgcaaaagtgtttaacgtgcataatggaactctcccccgacccaaaggacatatggaaatgtctgaagacgtttttgattgacatgactagagaagagtgctactggcatctagtgggtagaggctaggaatggtagtattttgatggaggagtgaaggccaaggcatttttcttgttcagatactcactgcttacttgatttcaatacccttcaaattgaccctctgacttaaatctcatcccccgccatcgattctccacactgttgcttgagtagtacttcaaacaaagttggggcatgtccttactcaaaagagtaccactgcctctgcagtgctctcaaattataggtctcaaattagaggctgcttttggagttttcttttatttagccatgaactgtgtataataagagtcataaaacataattccttcaggtgccctgctgagttcacctcttaactgcaactgcctggaatttccttcttagttcatttagcctcctttttgtgcattggaaaccctaggtttatggaaccaagtccaaacttttcacattgatggcttatcagtgccgtctcagattaccttttacagacttgcacaaatttcttgatgcttcttatacttattgttcctgaatgcaaggagtaagagctgaataaaatttcagtgattgttatgtgccaggcactgtgcttgaaatgcaagggttgctttaattttcagtacaatccaatgagatagatgacattttctagagtcagaaatcagggctatgaccttaatgagggtcacagagctactacatatgagagtgagatttcaactgtaagtactatcagatactaaagtccagcagttaagtacttagctgtgttttgacatctctgtagtgttactcatggccttctatcaccctagagaacccctcactccaatctccaggtggcaatacctttcttatttcattaggcacagactaatttcacccttcttcatctatgaagccttctgtgacatgtcctgatagatcatcctatcccttcatttgtacagaaggattcggcaaatacttcactaatactgtcctttacattggtagctggttcaaagtatttcacctactggctcttaataagtcactatttcttgcacctcaattcccttttcttgacatgtatgttctaatagtacatgtctcatcatgttgttgtgagaaataagtgccaatgagataattctcgtaaaatctttaaaacagggaccggaacaggaaattatcaatattagttaacaactttgctattattaactatccttaccattattaccattagactgtgtataaaggaatttggtttagatatttctataccccctgtgcctagcatcatgtctttgacacagtaagtgtttcataaatgtctggtgagctgaatcatggtgaactgctatttcttccatctttcttgaacttctactctgcagagcctcttatatctgtcagctttttgctttctacttcatgcaaatttccatattctttgttttaaaatatatctatctgctcactctaaatctagtttctcaatttcttttcttttctttttttcacttcccctgttttgtttgtttgcttgtttgtttgttttattttttcctaagggctgaaaatgaagtaagaaacaagataagttattttctatttacatgtagcttactttctagtggatgagaaaatgatatacagataacaagtaaatatacatactctgaaaaaaatcagtgtacgataatagacaatatagattaattggggatgggcgagctattttagtaggttgaatggtttctctgatgagacttcagtgatagatgagatgaatcaaaaagccaaataaaggtgtttccaggtaaggtacataaagtaaaaggtcttgactctggaataggcttggagcttaccacgaataacaagaagagagagtgtgagaaaactcagcccatgagactgagcgatgtcagttgatttatggtcatattatagactaaagtatacattttttccaatgactcttgggttgtggacagtgacacgatccaatttacattataagtggatcactttggcttcagtgtagagaaaagaaggtaggacgacgagagatgctagaccagttagaaaccactagaaacttccagatcatggttatggcttgaaataggggcagcaagagaaataatgggctgtgtttgtatttaagataagccttaggtcctgtctactgttatatatccttcccttcccttcccttccctcccttccttccctcttttcttccttccttccttccctttatttctcattttctctcccactccctttccccagcaggggttggcaaactgttcctgtaaagggccagatagtaaatagtttcaacttttaaggcagaaattactgtcacaattactcaattctgcattgcgatgccaaagcactcatagacagtatgtaaatgaatgagagtgggtgagttctaatataactttatttataagaacaggtggtagctgaatttggcccattgaccatagttaattgacccctgccccagggtcctatgaggtaaataccacacatcttatcctatatttcaataattaattcagtaagtatctctaacagatcagaactctctcctctccctcctgactcttcccagtttccctcattttcccctcctcctcctcattcttattaccatattactattattgcacaacagaattatacaattattatcatgtaatattcaatctgtgttcaatatttccacattgtatagtttttattcccaaatcagaatctgaacaagatctacacatttaatgtatttaatatgcttattaagtctactttaatcagtaacagttctcactccctctttatattagttaattcaaatgtttttggtttagagcttactaaaacacatcctaagtctatatatcagtacattttacatagccatgtctgtagaagtacatgcatgctccttagaccacacaaattatgagccagatgatgtctagccatatgctcctttgagcctatatgccccctgtaaagaaccaccattctattatttatagtataacttacttgtgcctgtttttgaactaggcataaaaggaatttcttttctcttacagaattaacattatttttactttagagaaaaactgggttatctgtcatgcagaatttcccatgttatgtatcttatctgattgcatctttatagtgttattataaaatctgaaagctatgtctagaggattgattagattcaggttagtagatagtaatggggacttcctattgcattccagggacacatggtctggtggccactctttaagtcacgttaagtctgactagtgggttgtgaattattttctcctctatattgagatctccttcgggctgggtcagtacctaatatattcctgaaagttaaacaccttgctttttgcctggcagagaggaggcactgaatcaataataatggagggtagaaaggaagaaatggcaagtggaaaacaaaagtttgaaaagaaggaaggaaggaaggaaaaagggaaggaaagagggaagaaatgaagggaaaaaggaagaaaatgatgaaaaaacgaaggaaggaagatagggaggagaaaaggatgaaggaatgggttaaggaaattatatggatgatcttttttactagatggagtttcttaagactagggtaattttcctgttcatctttgtatctctagtccttaccaaagagtagtaattataaaaataataataataaatccaacaaaaacacattatcatgaggtaattcttgtttgcaaacattttacttcattcacaattcacagaaacttttgaatactttttctaaaccattattttttcagatgaataaaataaggacctaagaaatgaagtcacatgctcctggtcattaaaatgccagaaccagaatttatttatttttttcctgcacgtctccataataccttctttggctcaaaaggcagataatgtttgttgaatgagtgaatgaagttataactcaagtgactggaacatagtaatggcttatataatgtcagccaatctcatcattaattttctactcatttctagggtctttataaaaggcctccttctcagtaagacctcccatgttaccagcatatatggatcctgcaattgttcatactcataacttattcactaaacagttcatatatttctgtcctgtcttttagagtcagtgaaaagcaccttgtgtgcagaaacagcatctaaaaggttgctatgtctgtcactgttttgactccagtgacagctaaacagtaggcactctataaatgcctctggatggattggttgaagtttaatctggaagcagctctgtgcagaaggaacatgagattgactggcgaaggctccaattctggctcaattactggctgtacaggatgagggggccacaggaaaaccaattaagttctctgtgctttgacttcccaactataaaattgaaacaatagtctctatcctcataactctcaggtgcatggtgaggttcaaataggataatgcaaactgtaaatttcagcagcgatacaaggttttattatcccagttacattataaccctctgtctacttgctacatattaccaccttctcacttaggtgaacactcaatattcaccaaatgattttacctaaatcaataatataaacaaagaaaacaagatgatctagtaaaagaggctcaggaaattgactctcagattgtatgcacagtattctcttggaaagggaggttgatataatatgccactaactctctaagtcagagaagaatttaccagaaagcttgcaagtaaatgcattttccacaattcactctagcacagcaattctcgggagataacaccattaatactccatttcaaattaaaaaacatatgctttttcctctttaaaaaaaaaagtgagggaacatgtcccattttcttccctttacaaaaacaaaagcttttaaaatgataaaaattgcctctgcttgataaaacagccatctgtatctgatttagttaagcattattcctatagctttttatattattattattgctggttggggaaaaatgcatacatacaaagagaggtctttggaaaggtcacactatttctagttcagtcatccctgaaacttcacctcatcttcagattgaccttaaaattgaatcctaatcctcaatagaaaaatttgaaataaagcttgagaaaattgtgctcattttttatataggatgtcttaccttctcccttccacacttttatgatgttggtgaagagatcaagaaactttagaataaagaatccctattgcatttggcatttatatgaccctctaatattgtaatcatttttattagttatttctcatgtcagctctgggagagagattggataagcttagtattcagagtgggtgagctccccatatgctgttaactccagtatgatggtcataaacaccaaatggcatgccatatgaagcaagcacagggcaggttttccaaatatgcaattaagataaggggagatgccatctcctatacaaatgctacaacggcttcagaattaatctcacggaaataattcctctgagtttagaacaaagagagcatgagagaaggtttgttgataatgcccttaaatgggctgcattgatattaccagctgaactctgaagataaagtagctgtgagaaatggggctgggtgtggttttgaatgtacatgtttatgctttgattaagaggtggaaatggtattacatcagatgaagaattagaaaatctgaagacacggattctggtgccctgctctgcaacctatacacttcatgactcaaatcctgtttcttacatttttgtcttctgtagaatgggtatagtgactctagcatgtcagcatgtaaaaagtggtcttgtcgaaacagggcaacctagataagcagagttatgagagcattctaagcagaatgagcaaagacacagaggggaacagtctctatgtatctgatgcaagaggctcagtgtaatggcatctgatagagcagtgggatctaagatgagaccagatcatggaagagtggggacattgtgccaggaattgtgcacaatgagccaagaagccgtggcttggttgcttttccttatagttcttggttggcttgtatgtttattttttagcaaggaagtgaaatgttaagtctttcaggaaaaaacaaattaatccaattaagtaaaatggattggtagaggaagaaaaaaggcagggaggtcagttaagagacttttgaaaaatttggttcaaatcagggcaattggaaaaggaatggaaggcagtggagagttgcaaggaacagagttagaattctgtacgcagccctttctgcatgacagatctatacaggcaggatgtgatatccgttataacttcctccgctgggctgtccttcgccattaggagatgacccctctgatgatgatgactgtgttgtgtgcagctgaggctgaagaaagtgacttgagggagcaggatttatcacacaagtcagaaggcagccttgtagacatgagtctataaggaagagcaggcgtttgctcccctgacctcccttttctttcagagctctcccaacctcctctcactccatgtgcccaggatccctgtcttcataatgatagaatcctagatggttagagctctgagggatgcactcataaaagaagagtgacatacatattggcaggtgttggactataagatagtgaatttgaaggggcaggatgttaggttcaaattgtgtttctatggcatccccatagtttgctgtactataatgtatatgtaccatacattatatatgttatatatgtgcatacatataacatatagtgtacatgtactataatgcataaatgcattagtttgtgagcttaggcaaagataaatcatctcttagcctctgtttcctcacttgtaaagtggatatacaaatgcttaaattacatgtattattgtagattaaatgagataatgcatgtaaaacattgaacacagtgtcctatgaacacagtgtttatggaatgaaagccaagaaaaaaaggtaactattctttttttttttttttttttttttttgagacggagtctcaggctgtcacccaggctggagtgcagtggtatgatctcagctcactgcaatctccgcctgttgggttcaagcaattctcctgcctcaccctcctgagtagctgggactacaggcatgcaccagcacgccaagctaatttttgtatttttagtacagacggggtttcaccttgttggccaggatggtcttgatctcctgaccttgtgatccacccgcctcagcttcccaaagtgctgggattacaggcatgagccactgcgcccagccgaaaaaaaaggtaactattctaatgagtaggaataacattgcttgctacgaatgtcacatttccccctctcattttcttttctctctccattttcctctctttctctcaatgccagtgaatatccccaaacaggttgctctcctcaaagagcaccttttgggatactgaaaaggcaccatattggagactagcatggttagtgtgaagcaaaaacaggatgatatttagaggacatgcagccagtgcacactccacattctgacatttttgaagcaaacatcaacaagacctgttactgtgcaatagtcttggcatactatgataaagaccttgtaagtaaaatggacattttaaaataaaacttacaacttaaaaagtttattttttaaaggagaaaattagtcaagagagggattgttaattatggtggacatcatgattgattctcaaatgttcaagtttattggtcctatccagtggttctcaacccagggacaactttacccccaagagaacatatggcaatgtttggagattttttttatttgtcataactggtgaggagtgctattgtcatctagcaagctagggataatgcttcttcaatgttcagaatagcacccccaggaccaagaattgactggttcctaaatgtcaatagtgccgtggttgagaaatcttgtttttagtaaatcatgctgactcttctctctttaccattgatgggttcaggaatccaacaagccaatgagtgtatctcattgtgttggtgcctcttattcatcgaaaggtaggcacacatccaaaataggctaaaggaagaagcacatttcaagattgggaattttgttccctggtcaaggtacacagagaaaaacaacatcgcattttccccatgttctgaactttaggaagtgagtctgatattaaagttcatatttcaaaagtaataaagaggagggacagaaaagattccagttcttgaagacactgaatctatttgcaaggaagtctaccctacattcagaaatttcataatgtgaataataaatactatcattgaataagttagtttacattggagcttttcttttttacttgcaaacataactatagtaactaacactctgcacaggtgatctcatacttttcgaggagttttgtctccttctatggtttcctgcttggagtgcaataatttccaagcaatatactcctccagtacgatgctttggcccaccagttggtacacaattctccttctttctatttctcattaatagagctgagaccagataggattctattattattattaatattattattattattatttttgagatggaatctcactctgtcacccaggctagagtgcagtggcacgatctcagctcactgcaggctccacctcctgggttaacaccattctcctgcctcaacctcttgagtagctgggactacaggcgcccgtcaccacgcctggctaattttttgtatttttgagtagagacggggtttcaccgtgttagccaggatgctctccatctcctgaccttgtgatccgcccgcctcgacctcccaaaatgctgggattacaggcatgagccaccgcgcccggccaggattcttaaaaaaaagaaagaagagaaaaatacttcaaaagaaagaagcaaaataaaaataaactcaagagaggaaaaagggaagttttaaaatgaaagttaagttacaaagtctctagccccaatgactatcacaattcaactcaattcaaaaagcatcaagcatctattcagaaacactgagaaattctgtagaggctgaggatatattggtcagaaaaggcagaatttttttttccacaaggagtccagtatcttgtgtgtatgggagtacatcaataaggagttatgagagtatggtgggacgggctcagtaagagcacagggaataaggaagatagccacccagaggaaggagtgatgtagctgatcacttttctgatttctttctttgcatctcctaatctatttcaaagtgaacaattcaatgttacaattaactgcatagaattatctcccagccaccatgatccctttatgatgaagatcactaaagataaattctccacccatctaccattcatccttttggttgctttctggtttgagagacactatacacaatgaaaccctgaatgactgtgcctttcagggaagaacatgcatacaacaccatacaggcaaggagggataatcagtccaagagtgctttacattcattacaatatgattcaaaacaataagtgattatgcagtgcaacaaaaagttgttgaaataacaaaacttacacaaatgcagatgtaggggaatcatcccttcataaacccgtactagggacacaatgtagaaatgcgaagagaggtgaacaaaaaaatatgtttctaaggaagaatcaataggacttaatgacatgaggaaaaaagtagagagtggagtggaaatgcatccagcatttgaataccagattaactggacaatgattgttttactcactaaggacaggcttgggggagaggttaggaagagaagatggtttaggagagtactaaataatttatcttggtcatattgcttcatatctactaggattgcagcctactgttgtcacattccaggactaattaaaggaagaggctgggaacagatataaggaaggaaacttaagaaaaaaagaaagaataaaaacaagttttttccaaactctgtctaccagtggtcaaagatatcgtgagttgatatgtgtcttctgtttcccacccctcccatttctgtcaagcataaaaaatagaccaatttgtcactgtgtctgcataatgttggatatgtgcgtactgttctcttcccttagcagaggtcactgaaagagtgtctctaagattgtctgaaggaaaacaaacgagcaagcccagagattggaggcaaggtgctctgctgtagcaggggaaatgcagagatgatgacttttggaaaattgcactgggtttatccaacacaggactgttttaatcactgcaccaggggacctgcttcaaggacggatggataatgcatgtttcagaaggctgatagggagatagtgtgcatcctcaaacgtcttgagcagaccattaagtgagcaaatgtccttggatatctgcttgggggcatgggctcagagtttcagaggagaattcaaggtttcccggtgggctcaaaggagcactgggggaggcagacagactgtagcagtactctggagagagaggaagcacattctgctaagttcaatcagggcttaatatcccccagatccacagacagtaactggaagacaaatgattgataggcagatgaacagacactctgatagatatgctgaccttgttatactctcatctcctaacttcccaaacctttcttatggaactgatacaggtgtcaaggacttagggaggcacaagggaatgtgagtgggggcttatatctactctcaaccttgtgattttaaagaaacagagagagctgtgacattgattatccaggtttatatcctagctttattacgaattacttggcaaccttgaagagatctcttaacctctctggttcttctcttgtaagtggaataagtgttcctatctgatggcacttgcaaacctaaaaggttatacaaatctttgttgctgttacaattattattttttaaatttttagtgttattttctgatgaaggaattgctttctgactgtggaaatgtcgtatcacttccctggatgttaattttcttatatgatgagtagcaccttgattaataacataaacaataataataatgatatttaaggagctctcaatatgcgcaaaaattattctaaacatgatacaggctcactatacaggctactttgggaatgttggagattttgcaccagactattgcaataaaccaaacaccacaataaagcatgtcacacaaagtcttatttctcagtacatataaatgttgtgtttacactctagttcagtaagtgtacaatagcattgtgtctaaaaaaaccaaagtacataccttaaataaagatactttattgccaaaaatgctaacaatcatctgaacctttagcaagttatctttttactattggaagtcttgccttgatgttgatgcatgctgactgatcaaacttttcttctgcagcttcctcaactctctcatccttcacagacttgaagagaattagggccttgctctggattaggctttggcttaagggaatgttgtagctgtttgatcttctatcgagaccactaaaactttctccatatcaacaataattctgttttgctttcttatcattcatatgttctctggagtagcaggtttagtgtacttcaataactttttctttgcatttgcaacttggccaaccatttgatgcaaaaggcatagctgttggcctctcttcactttcaacatgccttcctcactaagcttaatcatttctagttttgatttaaagtgagggacatgcgactcttcctttcacttgaacaataaagagccattgtaagattgtcgattggcctaatttcaatattgttttgtctcaatgaataaggaggcccaaggagagggaaagagatgggggaaggggtgatcaggggagcagtcaaaacatattcatttatcaattaagtttgctgtcttatatgggcatggtttgttgggccccaaaacaattacaatagtaacatcgaagatcacggatcaccaaaacagatataataataatgaaaaggttcaaaatatcatgagaattacaaaactgtgacacagagcctcaaagggagcacatgctatggggaaagtggtgacactagatacacttgcttcacgtgaggttgccataaacttgcaattcaagaaaaacacagtatattcaaagtgcactaaagcaaagcacaataaaacaagtaatgcctgtaaatgaatttactaaaaaataagcttatgctataggtaacattattatccatcttttgaatttgagaaaaatgaggcacaaagaggctgagtttcttacctcaaggcacacagtttgcagaactgggatattattttagacattttaacttcagggccacctatctaacctctttagtaccttgtctaatgtgttaatccatttatgtgttactgtaaaagaatgcctgagactagacaatttataaagaaaagagttttaattgctcacagttctgcaaaatgtgtaggaagcatggcattggcatctgctcctagtgaagcctcaggaagtttacaatcatggcggaaggtgaaggtggaaccagtgtatcacatagtgagagcaggagcgagagagagagagaggagaagtcccagattcttttcaacaaccagatattatgtgagctaaccaagtgagaactcacttatcaccaagaggatggtgctaagccattcgtgaaaaatctacccccatgatccaatacctcccactaagccccaactccgacactgggagtcgcatttcaacatgatatttggaggcaacaaacatctaagccatatcattccaccactggccccccagattttatgttcttctgaaatttcaaaatacaatcatgcctttgcaatagtctcccaaagtcttaactcattccagcactaactcaaaagtcccaagtccgaagtctgatgcacaaagttttatctggagatgagttcttttcaacctataaatgtgtgagatttaaaaaatgagtatttactcctgagatacaatggcggtacaggtattaggtagacattcccattccaaaaggaagaaattagaccaaagaaaagagctacaggtaccatgcaagtctgaaactcagcaggagagtcattaaatcttaaagctccaaaataatctccttggactctgacccacatccagggcacactggtatgagggataggctcccaaggccttgggcagttctaccctgtggctttgctggatgcagcccatatggctggtttgatgggttggagttcagtgcctgcacctttttctaggctgaggatccaagctgcactggctctaccattcttgggtctggagggtggcaacccccttctcagagctccagtaggcagttccctggtgggaactctgtgtgggggctctaacctctagtagaggctctctgtgaaaactccacccctgcagtaggcttctgcctggcacccaggctttcccagatatcctctgaaatctaggtggaagccactaagcttccttcactcttactttttgtgtactcgcaggcttaataccacatggaagctgccaaggcttatggcttgtgacctcaaagcagtgccccaagctgtacctgggccccattgagccaaggctggacctggagtggctggggtgcagggagcaatgtcctgaagctgaggagggaagcaagaccctgggcctggcccctgaaataattctcttctcccagctttcagggtgtgtgatgggaggggctgtctcaaagactttttttatttttatttttatttgagacagtgtcttgctttgtcacccaggctggagtgcagtggaatgatcatgactcactgcactctcaatgttctgggctcaagttatcctcccaccttagcctttcaagtagctgggactgtaggttcaggccactgtgcctgcttatattttatttttttgtagagatggggtctctctatgttgcccaggctggtctcaaattcctgggttcaagcaatgctcccatctcagcctcccaaaagggtaagcaaccaagcccagccccaaagacttctgaaatgccttccaggccttctcctcatcgtctcggatattagcacctggcttccttttagttatggtaatctctttagccagtggttgttttgtagcctgcttagattctttctctactacttgtccaggttacagattttctaaacttttatcctctgctttcctttcaaatataaattccaacttcaaatcatttcttggctctcatatctgattataggctgttagaagcactgcttagaaatttcttccgccagataccctgtcatcactcttaagttcaaccttccacagataacaagggcacaatgaagccaagttctttgctagggcttaacacaggtgaccattactccagttcccagtaacatcctcatttttttctaatatcttgtcagtctggctttcactgcccatatttctatcaacattttggttgcaaccattttaccggtctctaagaaataccaaacttctctctgtctctctttcagtctccaaagtttggaacttcttagagactgggagagacagagacggtggggggaacttcttagagactgagagggatagagagacggagagagagaaagagagagagagaaataagtggagatgctaggcttttaagcaaactactaactgagcaagaattcccttatcaccaaagggatggtgctaagccatttgtgagggatccacccccgtgatcgaatcacctcccaccaggctccactttcaacatttggaattacatttcaacgtg

SEQ ID NO: 12752 - DNA, 42394 bp, Human
ctgctgcagataggactttctctcccattctttacttttttattagccaatcaaagtggcttccgaaagccatttgtgatttgtgaaaaatagtatctttcaaaatgctgagttgaagcatctcgctcattgctccttgaatttattattctaatctcaaccgtagagctggaataatgcagctattaagttggggggcaaattcgtttctctggattaaattttttttcctccccactccctcattgcatcagccaaggaaggtgcggacctgcaagagatctgggggtgggtgagagaggtagtgagcgtcctgaagggctccttgagggacccttggataggcgagtggtttggtctccccagtcttatcttccccagataagatgccctaatgactgcctgctggctgggaaagttaccccgcccaattagggagaattcaggacaggttgtgccacagtctagaagtaaaatttccggtgagctgcccgcagcgccgtcccattctccccgctgcccattgtgaaaagctgggccagcgcttccttgtcgtaatttttaactacctgttataaaatttatgggtgggtttgtgaaaagaaacgaggtccctgcatccggcctagggaactgcttttcttactatggaggaagtctggggaaggcatgaggtatcccctcttggtcagggttgaggcacccaaccattgagattcccatgccagcttgatgcgggaccaagtggagagatgccggccttcaaatctcgagcccgtggggagagtgacctgcctgcaacccctcccccggcaaatagtctctatgggggaatttattctggactcaccttcaaaattaggggtctggaaaaacaggctgctcgaaattttagcacagaaggtggaattcagggcagtaaaaggttattttttcaggcctcggtagtacatcccagctgcccagacattgaatcaggaaatttttctgagaaaggcaggtgggtatgggcaatctgacacgatccaaaaggcttactgccttgcacccctccccgcaaaaaggaagtagagaccaagatcttgggctttaattttatttttaattgtaaaaagatttcaaataagccaccatttgaactgggaagggaaactagggatggtcttgggggaaaatgtcattctctctaagaaagggaccccggggatgtgggtcgttttgagggtcctagaagttgaccccaattctcacctctcctgctgcactgcaggattgcccagggtaggtctagtcccctaggttcttcagaccactccaggtcaggtttggttgggtggctgccagtggtcttccactactgttcctgtctagggtggagtaggagctttcaggggtacggcatagaggggatgttgttctcttactaaaaaaaaaaaaaaaaaaaaaaggtaggggtagggaggcaccctttcaatccctgcaattcaccagccatcactgcctcaaggccacaaatctttgcaaagctttgaattccgcctgatccaaccttaatgcccccatttattaaggacaatatttaaaactcggcaagccaggagaggcaaccgaccctcagtgcttgaagctttctttcgcctgggcgtccgccctcagctctttctgcgctcgcctgcagcagcctggcccgtggggagtgggcggtgggtgggggtaggggtggggtgggggtccggggatgctccctctatgagagaattgggtaaacatggcgaccgcggcgcccatttgcacacgctacacaaatgcatcgcattcccggttgtttgcagaaaatttacagctgagtaataaaagtttacgatcgactcacaagttggattggccacaagaagtcatgtggattccatccatgaacgtgaactttttattgtggtttgtccgttccgagcgctccgcagaacagtcctccctgtaagagcctaaccattgccagggaaacctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcggtaagtgtttccttattggttcaaatatgtaactaatggtccgtggcggtttcaagaataggacagcagcggcttctcttggttagggagaagagggggctggcgagagggtgggcgcgtagttaattatggggaggaaaattggcggggggagagaaacggggttaaactggaataccggtaactggtagtggggcgattgtgttgtcctgatgtcactgtgtgccaagttgggggtggggaggcaagggaacagcacctgtggggctcaagccggcggtctagggcgccagctctctgctgcccactgtgtcagtacctgcttattatagatcttcggtctcttggctaatggaactgggtcggagcggaactggaagctcaagctccaggcaggagagagaacttagaggctgtgcccattgccccctaagcaaagttagccccccaacccccaaacaaactttccagcttcccctccctgtctggcagccccctccctcccagagagcgcgactgctagagctcacacatgcgcagtgtgggcccagggccgggccgccgagcaggaagccggcgcagctaggcggccggcggggcctgttaattggcaattaggggggaggctggtggctggtgcgcgtcagccgagaggagagcgtctgcccaccccctgctcccgcccccactcgggcggatggaagggtgggaggtgccctgcgttgggtggagggtggaggttgtagggtgggggtgggggatgctgtactcaaaagccatcttgtgctcagagaaaagaggcctaccggctttcccttccggggtccggcgcccctcacccccagccgcggccatcccagccgggatgcccactggaccgggatgcccgctcgccacgcatggctgctctgggctaggacctgcctcgcctcggggggaggtggaaatggggaaggccctaggctgggcggggacaggcccagtcctcctggtagagtctcctaggtgctgtggaggcagtgaggattccgggggctgctggcttatggggtagaggcgtcagcctggggcggcgggagggtcctgggcactcgggatctctctaataattggtgctaatggcctgttgtatagtcttaacccgacgcatatggtttcataacacagtggcttaatttcttccaaatgtacgtggccctgaatgtgttgcagtttgatatatgaccccgccctgctccccggcctgggtccgaggctccgaggcggccccataagtgtgaatttctgtttataaacggcgacgcacacgcaaacgcctacacacccaggcagacacacccggaggcgtgggggaacatattccagacgaggtccgagagaacctgggggccagacttaccttaatctaagccaagacaccccctctacccccaccctctcccagaggcgcgactgggattctgcgccaagtcccagtgggggaggggatcgctccacgatttcctgtttaaaccctgacccgtcgcctgtgggggggcggggatgggggaagaaacctgtttttatcaaatttttaaaaatacagtttgcattcagatcaaaccgtttgggccagagctgacggtgaattttatctcccctccccccacaacccccttcccttccttttctgcccccgctaaattcccctttcgcagccatcataaaggcctctgaggtattctcccgcgggaagaaatggcattttctctccccctcccccacccccccacccccagtaggacttgtgtgtcggcagaggcgtctgacgaggggctaatttcgctttccttgtttacgatcgagaaaagcgcttggctctccccaaatgggcccagcccgccgcctgctcaggctgccgcgcgctctcccgccgctcaggcacggcccagtggctgatgccccgcggatccagcctgcggcaggccggaacccggagtctgtgggacctgaaaagggcaaagggagtgcggtgggacacaagaggggcccgagaggcccgaaaaagggagcctttctcctggagtaatgtgggaatcgccgaccggtgaggcctctatttctctctttcgcctgcattttgtccgcccccgcccctgtggatggccgctgatgggggggaacacaagtgtcctttgtccgtccccgaaagaaaaccttttccagagaaggccattcaggccagtggagattcacctagaatattagaagggccccctcccacccgaggggcgggcctgggcgaggctgaggtatttctcttaatcctagaacgacctcactgagtgtacccacagcgagatttggaggtgctagagttcgaggttggccgcttaacagcaccatcctgaggtgtctttatataatattttaattgattttctgtcccttcctggctacagccctgcagctcccccacccccatcctatgcccttcacccctagacccatccttacaagacagaggcaagcagagaaggcatagcagcagcgaccggcgctctgttttcattttccactctggccaggggataaactggaccccagtggactccaacaccaactctctgcttcccagttactttcgattttctttcccttctccttctttctctccctctctggcattcaaacagaagcacaagaggacccaccagtggcaactctaagcctccttgcaggccacattccctgctgacgtggtccttcctgcaggagagcccttctgtgattatctaataatagccagggtggctgagaatagaatctggctcaaggactctgcacacccggggcagagacactgaatctgtgggtcagggcctggcaacattccttggagcctccccctctgagcccactctttgggcacccttaggcttgcctgccccccttataaggggctttgtcagccctgccatccgctgtatttcatgtgctggttcctagctaaggagaattgggcagagcaaaccctttctcaccctggtctgacagttgtgatcccgacagaatgcgaccttgtttggagaaggcgaccttgttgggttggctgtgttctgaaaccaggcttgggagtgttatatatttattatatacaggcttaaatatacagactcaggcttatgcatgaatatatacagactcatatttccttggtggttaattgtatattaccatgcctatattcgctcaaacaccattttatgttcatgcaaaattttgttagtcctcactagatgagagtgggctcatggaggcaccgggtgcactgagcaggccctctgtgcatgctctgctggaaatatgtgctcactggaatcggagtatgcgggttccagtaaccaatggatgccataaaggctttctcagaccttattgcttttgttgcccaagcagctggactggggaaatactaaatcccttctgctttctctccacacctcctggcaaactctcccaacttagaaattattttacaagggagaccagttgtcttgaaattgagttctgcgggattcttttcacgggcatggtggggctgcaagcagttcggagtagtcagggccctggcgctggaagcctcactggagcgatgaagggatcagagtggttaataaggtggcctctggacagtgatctggggcagctgctggccagggtgcttggagaagcttgtggaaaaggcaagccaaaaggggtagggatgcagtgaatatctgtttctccccctgcttgccccagccggccgctcaccccgccccagcccgatttgcctgcatccgtggcggcagattgggagttctctaaggtcccccaaatacccagatctggttactggatgaactgcgttttaatcctcgtcgctatctgagccaggacaagacctggtcagggagacggctggtccgggcagcacgggagaggacgctggacccgctgcctgtggcctggagcactgagtatgggctaccaaggctgagaattgatgggcctcctttcccagcctttttcccttccagagacacaaaaagacagagcagaggggaaatatcaatgtcagtggaaaaccccataaaagaaagcagggaccagagcggggctggaggggttttccgctactctctctaggtgatcgggttcctcccaagactcttgtccagacaggctgcaccaagaggtgtgcagctttcttccaccttcctcccgcccttcaaggagggcagccttaggctttctgggccttggtcaccccaggcactggggtgacattactccaggattgtgcccctcgcccagcccacggcctctgccacggcgccgcagccgctcctgtttattgtgtctgtgagttgtttacttgttttgtctgctgccaccctgcgtcagaaacccgccaaaccagcgaactcgcccaggagaacaaagtgctgtgctatccccggactccctcccctttccagcaaccccctcctgccctcacaagctcctgcattctccctttcggaggggaggaagcagaaatagtcttaaaacagggcagctgtttatagggtcaggggaattatggggacaccataaacctctgggtgtccctgtggtggacagacttctgagcagcccttcccttgcctaggcttttcttccttcccctggtgaccacttggttaagggggccacactcattgagaaagttgagcccacccccatcaacccagtcccccactaccccactcctttctgcaggagtttccctgagacacaggttgttgggttttaaatcagggtaatgttggtggattcataaagctagatatagcatgtcattcttctcccacactccctctcctcagccccccaaaattgcagtgaatttaagcaaatcctacaaaattaaattgcccctttgctaaagatcctatatgtctccaatcctgccaggtgtagagtcagatagttggcttttggcctttaattttgctgctagctattaaatttaaaagagtatcattgaagtaagtaatattctcatttctgaaattaattttcccctcccagtctctctctctctctttttgccagcacagattaaatggttctttcagatctgcaaacaataaaggataaaattatttatagggaaatgaggatgctgttttattgttggcatattgttccagaacataacaacattttattttcaagcaggagaggttagaccagggggagaaagagggggaaaggaaaaaacatgaaaggagggcaggaacccacacacaaaactcctgccatgtataactggtaggacatttacaatttctatatgacaactcactgtgatgtcataataccgagttcttgaattttataattctcatgaacctctcaaatgggtccaagcagtgcttcatgtggaggggtatagaagaagccaggaggctggggatcctttgacccagtgcagagcagcacaccccctattgcggcttcttcctcatgtgacatcctcttgaggccctattctgggggctgaaaatattctggatattctgcattttaatttttctcctgggccaagcagggccacttgctttgcccccctcaagtgtccctaggcatctaagctctctccccattcccagatcacagagagctgtgtccccaggctctccccaagccccctcctcagctaatactcagctgcttggaatagaggtgggaggcttgggcaccagcccccaaaaagccagaaatgattttttccagatggagctggaagggggctcagggctgagcgtgatggggtagagatgtttgggacctattttacgttttaaccttaagtcagagaagtgaattgagaagccaaacaaatgccaatgtgagagtttgtatctgctgatggtagcagcaataagtgaagtgctggtaaggaaaggtcaggcagaaatctggaaagagagagggaggagaggaaatgtgacatgagttagcagagcccttccatatacctttcttctccgtttaattgtaataaagcaaaagcagctcgggtagcctctcaacctcttagctcaaaagaggaatcaccagcgcaggccttggaggtgtttgggggcagttctcagcagcttaacatgcccaatctgccctcttcctcctttccccctccctgctgatccccagctcccttcaactggtcagcccgggccctgtccccaaaatattagcacccccaaatgatatccatttctgtgttaggtgtgtcaaatttcacttctctccatgcctaaactttgaaaggaggagtgtacctttttggaatgcggtgtgtgtagcgggggcaggtatgtgctcagacagcttcccccatcatatctatgggaaactggaagccccttaggtgagccatgctttggtgttcccaaacagcattccctgcattcaggttctctggcagaccaggaggctctttgcgatctgatcctttgactaggagttccatggagatcaaaggagcttatttatacacaaaacaccaggcatttggagtagaatttattttttaatttctaaataaaaaagtctaatcatagaccaatcgggccaactgagcagtcgctccagaacagcaaagccttaaccaaatagtgtgattatgaggggagctgagcaattactgaaactcggctttctccgtaagagggattttagccctcgcccagtggcacaaaaggggccagcggggcaaccgttcttctcttgctcagaaaagtgagacttgggggtggtgggggcagggtcgggcagctgcggtcgcgtccaggcagctgagcacccaggccaggcgctgaggctgagcactgagtcctgaggctccagtgcttgggtccccgagcagcctcaggaggcaccgagctgtagttgcagcgcggcagtcaggaatggagtatgtgtatctgtgtgcgagggttggtgagttacaaacatccgcgcagagttaggggatctggggagagagaggagacagggagaacacaactaaggaggacctctggaaaatattgtccccaaataaaaattccagatctcatccctctcacttcaaatatccctccccaggaaattaatatatttcccagagctgagtggaaagcaaaggccagcaaggtgaggcctgcccacgaacttcttcaggctgggtccagtcccacccaccctttccccagttcagagctcacatgcccccagcctttccctggcctaaaggggagtaaggctggagtggtagcatttaacttgcctagggaaatccccaagtgcccaggctgcaatgccacccttatccttggggactccaggccagtgactgcaccccactcaggtccaaggcgcaggcagtaaatttctctcctataattagcgctatcaaaagcatgtgttttgcattggagaggactggagaagcaagtggcaatttttcccttgtattctttttctgtgttttttgaattctgtttttgaatccactaattaaagcttctctgaaagtgaaaatctgctcttgacaccaagccccttccgaatgcctgatttgggaggctaaggggccagagcagtagcaaggagacctgcaagcctgatggggttggggggtagtgttctctgatttctttaggctcgttttatagaaacaaagaacaagttctctcccctccttcccaagacttgtgcatatttacagagcacaactgcagttttaataaaacatctgttcttgcttctgctgatgagtttccataattgttttcagacaaatttaacaggaaaatataaatatatttagaaaaatctaagtcccagctttccccctatagacagccattcttttgccaaaaaaataaaattaacatgaaatgggaaaaagaaaatataatccaatgtagggaagatcgggctcatctgacctgctctccccccttggagcgaatcctttcagcaaatttcagctgcataattaaagatctaagagaaagaagagggcttcttctttcctcaggaatgaaaggtaattggggggggggggggtgttgaaaattaattttgccaaaggtctttaagcagtggaggaatttatttgtatttctgtttccccttctctcccccttccagcatttctgcctttttcacccagcagctggtttctgttcattataaatcggcgagacctttcagtctctgccctctgtttagggacgtcataaaacacttaactttctggggctgaggctcacattctgcctctcaggtcgccaacctccctgagcccaccgactttaggccccaatagagaatctccccaactttggggcccctttcctctccagacatggttgaggaggggctcaaggaaacctaggcatccttgctgggggctgtagtccatgctgccccagaagccccttctttcttccaaggtccttccctcccccacccagacataaaagagatttttaaatacatagaaaatcaacactcattgaaagtgaaacctcattaagacatcctatcttccatcattcaatttgttgtacattgcaacaatttaatatcttgaaggaaatatcactgacatgatttatccctctagcaatctctctctgaaattggagggggggacagagttactctctcttccggcctcttctacttgttacaccactacccttagggcagaaaggaggctgggaactctgagagaggctacttgtgtccaggggtgcactgacttgttccctagctcagtccccagagtactcctgccttgttgtctctcccccacctcttgccctccagggggcctgaagcctcagccagctgttggaaacctctgctcaggcatgccatgaattcgaggacagctggattctagggcaaaaagcaactcacattggtgtctatgtttgtgtacctgccaagtcaccccaaaaatgagataactcatctaaaattttttttcttaatttaaaaatcctcctctaccctttccccttcatttccttggggagaagaaagtgtgatctagaaggaggaacctttataattataggagtctttccccttcccttccaaataccgacaaatttctgtcctttctggaggattggggctgtattttctaaaaccaacacaaattgtctggcaggaagactcttcaaccccctaacgaggttcatgtattaactaacatgttgtctccaccagctcctgcacactgtctgcttttgggttcgaaactttatttttcccccctagcgacactccagggaaaccttaacgttacagaagatgaataaacgagttttttctcagcatagtcccgtttatggctttattgctacccattgattactccgctttgttacacagaaggaaaagatcataaaatccggcgacatccgggttcttgttatagccagctttccccccccccaacccacccaaaaatggtggggggggggggatatgagctttctctgctccccgcacactccccaccacccttctttgtcaactcaaggcattttcagcctatatcacgatatcaaattaagtttggactaatcaggagaaaacccccatctgcacactttccgctgtttcagttcgcctactgcggctccctcacaagcctcggattcagctgccttttcgtaaccgtctcttccctttttttagccccaagatgggggaataaaatgggcgttgaggttgctgagaggcccatccccaccacgggtgactggcacttgggtgagagctccttagaacccctttctgaagtctccaagcctcatagctcaggtccaggggcgcctccactggcggtgccctgagtctggagggggcaggggggcttctgaccaaggcaggggcttgagcctgcaggaagctaactgtccatcagagccccaccagccttctctttctggctggatcctatgtgaattaccccacaggccctcactggctccaaataataaattctcaccaacataaacaggagttgatgtctctagaaagattctcagagttttcgttcttcctctctctctctttctctctgtctttccccctccggtgccacctccctacattttacttctttttctcctttttctattgcattttttatacattttcccttttaggcaaaaatgctggaagagttttcccaacagaggggtcctgagaaggaggcagaagggagccaggaggcaaaggagagcagatgcgtggcccatttgcccactccagctctgccactgtaccctgaagtcttgcccctttagacctagttgttccccacatccctactacattcaagactctcagccacactctacttactcaggggaacaggttttatgaaatttctttctacttttgatttttttttaattattggtgaaaaaaatactagtttagtgatgggactcactccatggagtgtcaaaacaggatttcctgcaggatttctagggacccccctcctgtgctgggagggagttcttcccttggagaaatcaggatgtaattttagaagggggcagatataaaacatgaaaccagattgaaaatacaggggtttctctagccctggctctggccacagcacagcaaagttagctggggctgagagatttcctggtagtacagctctccttccctgagtcccaaggccctgctcagggacatgcacccctccttcaccaccaaaccagttcccttacatatatatatatatatatatattttttaaaagaaatccaagtcttactttcaaagcacacacttagtctcaactagggaatcaacagaagcagaagcgatttttttcccccttcctgacatctggcttgcgattggctgggagggggtcagctgactttgtcattttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggtgagttttacagctccgagatataaattaaataaactgaactggctttatgaccggcttccctagaagaacgggcggagagagttttttatggccccataaaaacaatcacgctcgtctcctcaccgagacagggccccctcttctgccccctcagctcgcctctcgctcgcttgcaggggcctggcccccttggcccctgacggattggagggccccaaggcgggctgagggggcaggaacagggcaggggatgaggggagggagcagaagataggggagccccccaaagtggagtcagtctgaggagaagggagggggagaggagaggcagataagtggggagaagtttccaaggaactaggatgcttggggagatgggggagcccagtccttgagaaagggggccctcatccccattatctgggatttttcaaaaatctgcttttagacttgcagctttctgtttgccttttgccccgcccccccgcccccccccccaccacacacctttctttgggacacacaggtcccaccttataggaggtctgaagttggggtcctcgctgtacccccagtgggggtggggcaaggcaaaagggagaaggctagagccctaaggaggctgtgagctgctggccaggttgggagggtcaggactttgctaggcgaaacagtctgcagaggacgctttgctgattgcttttagtgtgttttgtgcccggatctttaggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaactttataccgggaattctgttaattcgctcgcccgccggcctcagggtgagagctggagcaggctccaagcgctcccgcgcctgccggccccctgcaagcccccagccctctgcactcgccttccccggagcccaggcgcccggccccggccttctgttcgttctcgcgatcgcactgaggggctgggaggcctctctgggctccctgcgcggagcaacacacacaccctgcgggaaaaagccgcgtaggattttgttgcggggggagctgggatcagtcggtttgggcaccaaccccacgcaggcctttcttcctgcctgtggcagccggtgtcctcggcgtccgaaccctgaggcgccccgaaagaccagtaaagaagcactatccaggcaccagggtctcctccacccactcccgggagttggaggcggggggcgccgtgagagcaagccccaggcccgcgccaagctggctgttgcgaaacgtagcggaggcggagagcggagggaaagagaagaccgcgggactggagccctgtcggcagggattgagcgattcaaggacatctcgagagagaaagcctggaaactgagctctcgcctgctctggtactcctgacgtggccgggacaaaattccttcttcattacagctccagccgggctggttccttacttttctctcctcaaacgggtgaagaggcgggtgaggagcgcagccggaccctaaccatttatcaaccctggccttctctctccaagcctggccagagaaacctgagtgggcctacagggagaggtgttgaggagggtctccggagggaaaaaatccgccagagttttccgggcccttcagattccctccagcgcccccaccctcgcctccagtgcctccaccagtgaggagggggccttctcctggcggggcggagatttcctgggaagaagcaggcagggaagtatgagacttggggctacgggggaagaggatggggccgaatggctgcagataccctgcgaaggctacccaggcgcctgccctgcccaccccccaggtccgccccattcctcttggtagctcagaaattgctctcttgtgaaccttatggattcaggtccctggaaagcctagcccagagaccttttccccaaagggcacataacgggccttttcctctgccatgctcacgtaatatttgtggaggcttcaatcttgcttctccatgtcctcaattaacatctattttctgtctaaaacctctggcataggtaccacataaggatcgcacacagggaaacagagcagtcctctagaccattgtctggctctgtccgtgtccacacacacacttgaaaattgccttgttgccactctggggaccctagcatggtgaggtctagccaactccacctggctcctcacctccagatccatcccaaacagcctgcaacaccctcagcttcatgacccccctatcttgttctgaccactcaggatccctcctcctgggcgtcctgtctacctcttcagaagctaattctactttctcttgctgataggcacctcttcagcagtagtggagccttagggcctgagaggcaagggacttctacctttggtttagggaacctaagttaaaccccattggttctccagcctgggcataggccaccttacctaacttaatcccctttcctcagccatttttgaagattggaagaccctggaggttgggagaacgggactttcattacaaaaagcactctgtgcgttataagtggggcctcgtcttttcccaattttaaatagaatttaaaaggctagctcaggggttgccccaacaaccagcttctccttcacagtgtaggaaatccagccaccggaaagcaagctggcgctccaggatgcaattcccccacataggcaccaggtgtcgctgtgggcttgttgtcccggctacccccaattccaagaacctttttttttttttccctcccccttccctctttctctctctcactccctctcccccttggttgggctttgccaacatatcgagatgcttttcgccggcttccatcactaacctcccggaggtcatcaagccaaatttatgagtggccgctcgagtcacgtgactctatttaaggctcccttatttgggaagagcgcataggataaagaaagagatatctccacctataaattgtccactttggagaacaaaaaacccctcaacttcaaagagtcacaaatcacccttaatcaaaaagggtgcagaaatttttttgggccctccccgccatgagctcctacgtagccaattcattctataagcagagccccaatatccctgcctataacatgcaaacttgtgggaactatggatcggcctcagaggtgcaggcatccaggtactgctacggcggattggacttaagcatcactttcccaccgcctgcgccttccaactctctccacggggtagacatggctgccaacccccgggctcaccccgaccgccccgcctgcagcgccgcggccgctccgggacacgctccgggcagagacgaagcggctcctctgaaccccgggatgtacagtcagaaggcggctcgcccggcgctggaggagcgagctaagagcagtggggagatcaaagaggagcaggcgcagacagggcagcccgccggactgagccagccaccggccccgccacagatttacccgtggatgaccaaactgcacatgagccacggtaaactttaggacttcattttgcgctctcgggtccgcctgggttttataggccatgcggggcaaataaagaaaaaaaacctgcggccataaattttacgatccaggcatcaatggctcgtaaaactgtccactaaaaggcttagaggctgtgtgcgcccaaatttacgacgacataattggatcataggaacaaaacgtgtataaaaggcaatattcaatttttgggggagagggagggagttaaaaaaatagagggatctgaagggtgaggagcgcggggctccagagcggggatccccccgcggctccctccctccctcccctgcggagccggctccgccggcgcttgcggctccggaggattccagcgactcgggaggggcgggaggggggtccccggtgctcggatctcgagggtgcttattgttcggtccgagcctgggtctccctcttccccccaaccccccctcagcccctccggctgcagagtgaaggctgcggtggaaagtttcctgcctgggcggaggcgcctctcccggggctgggctgggctggcccgcctgcggcccgcgtggcctgtcttgcggctctcgcctcctctccctccggccgcgggtgggggcctgggctggggtggggacgggggaacgctgcaagctattcaccccttcctggcttggggtggggtttatgttccagagacggacggcaagcggtcccgaaccagttacacgcgctaccagactctggaactcgagaaagaattccactttaaccgctacctcactcgccgcaggcgcatagagatcgccaacaacttgtgtctcaatgagagacagatcaagatctggttccagaaccgcaggatgaagtggaagaaagattccaaaatgaaaagcaaagaggctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggcattccgcatccctaccgacccagggttcccgcggggctgtcggcgctgccccatctcccctcagctcggctcagctcggtacccggggcccagggcaagctccgcaggacttccccggagggctgcggcgtacaggctggcgcagaacgaaccttggcctgggccgtatctccggctcccagcctcagcgcggccctcccgagttaaggtgggcccggcccgcgccacaggaccctcgccggaccctctaacctcgccctctcctttgttcccggctggacgggttagacagccaaaggctggcgagagtctggccctagactcggggtgcttccttgtagcgactaaactagattttcacttatgaatgatttgcatatgaaaggagagcatcggcctagggcccccacagttgctctatgctttccaaaccttatctccacaacctcttccccccaaaacccgggaacctccccagcctgcgcctgctgcatgccctctcaggccggcagccccagcctgctagctagctcaactagtggggtttcctggcactggaccccagcaagtggtcctagaggccctttgctgtcccatagtccctgccacgaatttctgtgccctcctgacccattgctgttgtccaactatttattgactctgggtccttcctgaaactatattttgtcatatcaaataaagagagaacaggactaaagatgcagtggctcctgtctgtttggggcatgtattgggtaaaattgtctaaatgggctgtgagatgtagaaggagacccacaaactttaagccacccctttaaaaaattttctagcttctaggggcagtgagtagagggaggtgaaattgagctcctttcctgttccttggctgcaacaagagcctctgggggaagagaagggcacctaggcctcgagtactggcttttcccatgctgtggctgtccaaggccttcacgcctctgcactccaggaggcctctggactggcagcagcccccactgtgtgccaaagctgcggtgcaggaaccagtggctccaccgtgctcagccttaggaccttctgggcctctgaagatctttcctgggcctaggtggtccctgagaggccttgctggacatagagggagggctgagccctcactctagggacccatttggtctcataagggcctctagagggaggtggtattgcttggtaagggggtgttgggagagttggaggaggtgtgcctcagtatctaagatactggggaagagggagcagggaggacaatctgcagtgtgtatcagcctggcaggaaatgttcagactgtttccaccaccttctagggcctcgggctatgcaggacaattaactgggaaaggagctgcatagaccagtgctggagtcacgtctgtctgccatcatttatctcagtctctgggattttgtgtggaggggaggatgggttaaaagtgggggtgggaggaggcagataattcaggtagtgtctgaggatcaggtccttctccaggctcctgggatgggctgggggaggaagcactttacagtagaaacaaatgtgggaagggtccataaaactttactgcatttcctctcccacctcccacaacagggtgatttcctggagccaagcctaggccccccacactggtggggtgagggtctggagcttggctaagggattgcaccagcagccaagaagaaaggggagcagaggggctctggggaggggcaggggaatatttatgattattaatgctgatgctccttggatttattataaggactaacttcgctgcatcccactgcctaagctacccatcagtcattttttaaaagacccaagagcctttcctcaccccatgcttggcacataggcagtctcaacaaatgcttattgaacagtgcccacaactaccacccttccccttcgcactgcactcaggccaggttagggcgcctgttgtctctcctcaacttgcacacagcagttaacccagaccagtgctctctctctctctctctgaaataaaatgtgtaattttcttcagggagttattttaattttttctccatgctgagtaaaactattgagtgagcagtgaagcgtggagaagcactggcgtctccggtgggtaacagttaactaagaaagaggctgtggcacccgcacccacctgttccagcctcccaggctgcccaggccctgtgcttcctccccaggggacaggcgcaccaccccaggggaaaaccaagggctttgtcatagataggggcaatgttggttagagctgccaggcagggcacaccagccccaccgtgcactgactgcctcctcccggcagggtttgggcctctccttccctggaggagctgaaggtctgactcattttggcttgggtagacacagagtgcctgcctgccctcctccttcctgtcacaatctgcaggtctgcccaggcaccagccttggcttctgcagcatcgtcgggagtcagcggcggcaaccaagccagaggcctcgtacctacttccctacgctgagggtgcataaggcccagatccctgatttctccctgaacaggggcttctgctttggggcctggggtagtttccccaccagccagcctcctagaacatatttccaggtaacagggtctggcattgctctgggggagtttatggaggggtcttctgggttgcaagcagagactatggagcctgcctctccactttgccctggaacccaccccctctggcagcaagaaagaaggggaagaagcatgacttaccttcccgggggagtgggaagaggggggacacggcccactctgagcaattagaggaaagaggaggaaaaaataagaggacaaaaagatcaacacgacctcgaaggcgacaggtccttatggaaataagtaagtaaataaataaataaggatccaccctctcccccctctccaccctgcaagggggatgtgggggtggggcaaaggaacagcaccagggctttttagtgtaactgagcattagagaaataggcatgcttctatgtgaatttaggagtttgaaacttttggaggttatttatgtgaatagcctgaaggcaagcccgtgagtggctcttgggggaccacgtgatatcattaaaccaagttttatggtgtagggagagctgacaaacccacaatatatttacatcatatataatcttaactgtccagccacgcagctgctggtgaggtttaatgctaggacagagggcctggcagttagaggggattacggcgctggggacgatggtgagagaggttacatcttcgcaaatgaatcccaggcgaacgctgtgagttaattctctctttctctctctcagaccctttctcccatttacctaaccacccccctcacttgatagaaggcagctcccacttattagggggagggggaaaaggccttcccaggctggggtgggagaagagaagaagcagcagaaaaagctgctgggaagtaggaagatgggggagcttgtctaccctgagcagccctccccttcccactccttattctctctgactgcaagtcaactggggtagagaggccttggttgtttagagatttgccaggtcttcctgaccctttcagttgagaagaaagcaagcggcagcaacaagggtgtttggtgtctgtacgggtatgtaaactctagacacaagctcaaaatgcctctggggcccactgttccagggaggggtgagttcagcccttggccagtggcccaaggtgggaaactggggagaaaggcagggaaggagggttttgtggcttctacgcccacaggctactgctgcctgaactggcaaaagtatctcaaaggtggctgtttgaacccagaggtcccagagtgccccctccctccctcactaccaggcttggatgggcagctgtctcagcctccgtagtttggcatcttagtccgtctgaagccagtgtggtttcatgcttcctcctctccttctagctgcttgggtcttcctggcattcccagcccttgcctgagataaaactaggctctaagagccctagaggttcctgctgtgagtggagtgtaattgtgtgttgaatgggtgagggagcagaggcaatgtctttgctaggctgggaaagtaagtcccccaaccttaaggacagagtagcccctcggggatggagctagcagggcccaatatgagcactgcaccctggggtcaatcctcaggctagggcgcccttcaggtttctaggaaggagcagcagaagcgttgggcatgagaggcacatgtcttccacacctgcaattgctatccctccctgtgcgtcaccgggagctaagccaggaaagtgacaacatgtgaattcaggctcctgtactggccagccatgaatagccagggctttggaagcagggctgaatgccagcggacccataggtgcaactcctccaggctgggagaaaggggtggggagcagagggagtgagccagatatgcaccttccagaaggggagcatgcctggggagcagcggtgtctgggcatctgctttgtggagaggtgctgttgggggatgaggagggaatgctgttagcctcgcccccgctgctcaagggactggggaagaagcgagaagcaggcagactctgggagaaggaagggggcacagaggcccaaataaatggggagtcttagctgagccccattcttcagtctaggggtctctcacttgcatgaggagctcgggaacccgacatggaggattcccttgacgccatccctcagggcctcagtctcggccaagattcagcctcccccaccctcctccctgatacctttattttcctaggatcccagggaattctctccagcaacgcattggaaaaaactaattatcagtttctcccttcctcattacccgtccttcttggctctctccttccctctagtctgtgattttgagagtttctggaaactttcctatccaagcagcggagacatgggagtttctcttggtctgtaacttgactcttccccaccctccagcctccccagggctctagggagcgagtgcagtggtctttaaccgggaatttagccagggccgaagtcccacacccaggcaagactccaccctgacacccgccctgactctcggccaaatctcagtcccattcccttcctctctgtgtagacgggcattcgagggtgtttaaagatttacatagcgtcccttgagccctttgatgacttcttcacccccttttctgttctttaggctcaaaagttccatttaaataccacccctcttcctgtgataattgattctccttcccctcaaatagtttgcctcagttttttactgttttctaaaaagtttctagttccacctggaaacagggcaaacgcaaaggaggcctgaaattcttggttttcccacccactaccccaaaccctaatttggagtgtctctggagcggagggtgggcaggcaatcaggtgccaagctttccagccaacccgggaagcttttaattttgttcctaggactttaacccaaggagaggtcaagcaaccaatcagaaatgcactaagcagggtcacatggtccccaccaaccaatcagcaaaaactacttgggtctctgtctcgctcttcccatccggccctgttccttcctccctccctcccttcccaccacagccttagctcctgggtttatcctatctcagatttggaaggctggagtgatacccagcatattctagcctcctctgtcagtccctgaaccaactctgaggagtctttggcttgtctcctcagttgcttacaaagttgtatctgggagtcaatctcaaatgcacaaggatgtgaagttgtgggggcatcctctggattattcccacgttcgccagcgtgattctacccaattttctgggtgttgtagttgtagactctaaattagactatagagcaaatacagatatgaactccagccctgaattcaaattctggctgtgattattccccatacacttacaagtattcattctcttctgattttcatgagggcaggtggggtgagaggagagcccttttgatttctctttctggaaatgctccaatagccattagctttatcagactgcctcaggcatggttagggaagggagcaaaagtggagattttttgaaagttctgattggtacctttcgtttgtcgaataactttgagctagttaagggttctggaaaggaatgagcacagagaattccgactttcctcactctccacattaaatagttgatggatttgtttaaaccccttcccttccattcttttaacaggatataataatagtaataataataatagactaggtgatgatcctatgtcctggccaatagccatcaaaaggtacagccactgaaggtgtggatttcagtgtttgagtttacatggattaggccaagaacaagcaataggcgagaaactattgctgagtaagagcatctgatggcacagggagtgcacagctatgacagaaatgcttgtgtttcctgaacacttgggctgggccctgagccagtccactgctgggtccagacccaggtattctcccccagccacttctctagagctttgtttcagagtgaattttctggttgggttctcctccccttctcttcctgatctcttgccctctttgagctaaggggcaggagttctgatggactgtggcacctggacctctaagcacccccctgggggcattaagagtacaagaatgggaaggatagtccggactgagctgggctttgtcaacaatcccctcattgtttgtcttctggatggagctggtttggggacaatgccacaggccaggtgggaaggataaggatgagaagccagaaaaagagcagctcttctcagaaatcattgagccctcacttttcaagttaccttcaaccacactgctccatctgcttattttgagactaagtttcactcttgtcgccccggctggagtgcaatggcacaatctcggctcatcgcaaactctgtctcctgggttcaagtgattctcctgcctcaacctcccaagtggctgggattacaggtgcccaccaccacacccagttaatttttgtatttttggcagagatgagatttaatcatgttgcccaggctgacctcaggtaatccacacgcctcatcctcccaaagtgctgagattacaggtgtgaaccaccgcgcccagccttttcttttcttttcttttttttttttttttttgagatggagtttcactcttgttgcccaggctatagtgcaatggcaggatctcagctcaccgcaaactctgcctcctgggttcaagcgattctcctgcctcagcctcctgagtagctgggattagaggcatgcaccaccacgcctggctaattttgtatttttaatagagacagggtttctccgtgttggtcaggctggtctcaaactcctgacatcagatgatccgcctgcctttgcctcccaaggtgctgggattacaggcatgagccaccgtggccagccccatttgcctcttttatgagttagaattaaaggacacacttattcttccccagtgaatggtgtggcagattgttggagaccaactctcaccctcaatgtggacttctcacactggggtaccagatctcatgaagagttaggaaacaaagacagggggagattggttctatccacacaggcactgggaaaagagattttgtgagtgcctcgacccctccttgtgagtgcctcaaaaaggtaaactttctctttttgactgtcgttctctgtaactgctttggactgagtttttgagagggggaatgctgaaacatcattgttctaggatttaattaggtcctttttgctgagaagacaagcaccaccaccctgagcctcttctttagtgggactagggcccctgaagccctttgaggtgaaggagaaagaaaatctgaaatcagggtgccaaactagggttttggggtgaatgattcaatttaaggagaagacgatgctgtttgagagccaagaaagtcacatcctttcctacccctcccaacttttattggctccttgtgacccacattggtgtgtctgtactgatactatctctgctagcagctttgatggggctccaggagcccaaggaattgccagacaaggtctgggttgaggaacttcggtgatacaaatctctttatttttgaggcctacacaacccttgtaatcatctccctctcccaatcctaaggttcactgagaggcaaaaggggaacagagatacctcagaggaagcggtatgggtgtgcaatgtgggacttgggaaaattggactcggttatgcaggaccttgttcagcctctaaggaccacattttagcagctatgagaagaggttgaacacttgggctgggccctgagccggtccactgctccaggcatgctggggagcaagtgcagggagaaggctgcttctctgcatctgtacacatgtacagagaaagttctacagtgatctgcaaccccatatgggctgggtgaaatgtgtagcctggtcacctaggatcctttcagttctgcaccacaggtctcagagaggcagttcaggcttggttctgccctctaaagattctcatttaccccagcccctggccctgaacaccagaatacctgaacacacagaaacacatatatgtgcccaaggatggtatggtagaggtcagaagcctgggctggacacagtaaccagcatggaaccaacttcccactcctccctcccactccattcttcccgtcagcccagcttggaaaccatttgtcctccccaccccacccccacccctcaagccctgcgcagctgttgagtttccttccttctgcctttctggaaaactcaaacgctagagctgactccagggatggtggcagccaggctttctgtgatcttcagtgttgtgttggcccagattgagttgtcaggagttgaagagacatggagggtccaaggaggccagaatcttatctgatctaatccccctctccttctgttccaagctcaaactccaaactcctcagggctcccttgctcagacattagagataaatcttgtctagtaaatacttcttttaaaagtcaactttctggctggaaaacacaggctgtgtgtgtgtgtgtgtgtgtgtgtgtgtgtgtgtgtgtgtgtgtgtgtttagggagtagtaagggtcaggtctttcattttatgttgtgtctctccccatcccctgggtggaggatgggggcacaggctgaggttttattgagggtgcttttcctgttgggagtaaagacagggtcataaacgcctagagtagggtgttttgatctggtgacttctcaggaagtagcatctgaggttttgctttgtaaatcactctcccccaaagctggcttggcagattggattgcacttccccaagcccacctgaggcccctcctttcctcccttccccagtaaactaaaggagaaatataacagagcatctggagtcttcaaaatcctctgactccaatttcttttttaaaaggctaattggtgatttttttttccctcaaagttttcccctaaaaaataatgcaacgtttcatttccttttgcccatgcagtccctggtcccccaacccctcagtcacaaaggaactaacattgacagtaaatagcctcagagcctggctgtagatatcaggactcttctgttctggggctgatctctccctgtcactctttccccaagccccaaaccccctttgacaaggtagaacttcagatgtataagacagagttcataggagctaggaataagaggagatggcagcggggcataggggaaccccatcgtgtaccgcatgaatggaggaaactctgcagtctgtcactgggtttttttgtaattaagatgggtgcaggggtgtgtgagtgtgtgtgtttgtgtgtgtgtgtgtgtgtaagcccccagccttctcacatctctatgtaccaaacaaacaatatattttacctaaataactccatttcctaatgataatgagtcttcccctcctaaggatcccccaccccctggctggcaagtccctcccttgtgcctggggctacagagctgaaggaaaacaaagttaagagccctctaattcagccttagttcaagccagatcaggtcaggaagctttcaggcccaggcatcagggcttatattcattgccagcaaaatgcccctatatgctggaaatatgtcatagattatatgagttccgggccctcttagcacttgcgaagtctctagtccaccctcatttctttctcagagaagcctgggctgggataccccaaacccacaagcactagagattcctcttcattcctaggactccatgcaaataatcttcacagagagctgagcgctcccatagttatatatgtgaaaacgtatttatagatcgttctatgtctatatcaggatgtatgttttatattcctttttgttccacatttaaatgcagatttatagatccatagtgaacataacagtcctcggtcaaattcctgtgtgcactttaccaatctttctatagtggttggatgtatatgctaggatgtattggtacagctctcttgaaacacctaagtgaatatttggaaatttttttctttgttggaaagaactatgtgtgtgttcaatgtctattttgaaaattttatctagatttatgcaaggatcctaacccataaaatagctacatattgaagctacatatttagagatctttacagtctttgcatttttgctgaaaaacttacatgtttgaacatatgtttagagatggtttcataatgcatgcatctgtgtataggggcatagatctcccttctagaaggacttaaacttactgcatctctctgtctccctctctatctctgtgtctatgatataaaaagatattaggtgagtgggggtagggaacaaatatattttggatgtttggcttattaaagcaagtaattctgtctctatttctaaggccatctccaaaatctagtcccactaagttatctgtccctcgaaaacctactctaggggtcatagactgcctccaggctgcctctgtgacctgagatccaagccgaagctccctacctctcaaggtagccactaaaaagaagggggagagaagaaaggggagagtcctccagcccagttcctgttggatccccagggcaagaggctgacaggggcttgtatatctccctacaccccccactgggcctttgaaatgtgggggaaaaagggatcaagtccccaactgtttttatagggtgcccaaatgatgccagggttactgcacaacccataggttcctcctccccagttgttctcggtgcccagggcccaattaagcggccgccttgcgcccagcagccccgctcttatcggctgggattgatgcctccgcgtctcctgtatatcatttccaagattttttctgtccaactcctcggctcctttggcttccgcggctttgactaatgattgctacagatgccaacgtctccagaatcctaatagccaggcaggcggactcttatttacccggcaacattgctgtgggggagggggcctgggggacaagtattggggtgtcgtaggtcaggggacagggagaaggttgtggccaactcaagtgtcactgaacttcttcccagtcagaaagacattcccaatccccttctctccttgagggaaatatatatatatatatacacagttaatggtaactcattgctgcctcgttagaaaagatcaaagaatgaacacaacgtggtagaataagcagagcaatgtttatttgttgtaaataaatgagagaataagtggaaaaccagcagtttggggaggaaaaagagaaagggaaagaagtcagccacagtgggagaaggggctccttttcttcatttcttgtcttcccctttctctccccaccctaagtctacccttctcatcaatttctcccctctttcccttccttcgcctcaccttcaatcccttgggtggaggggctgaacagcgtgttcccgggcggaggtgcgcgcagccaccccaggctgctgccaggtgcccgctggggctgccagggcgaggaggcctctgggctgtggagcgaaagtcagatccaccgcctactgcggggtaggggccgcagtggggaccgccagccctgtggtccctctcgcgctgactggcgtaaagttgtggccgaattcgcatctcttctggtgcttctcgcccgccagcgcagggcccaggtgtttgaggcgaaggggctctagctccccgcaagcctggagccaggcgtcgcgcttcctccgggcttaatccagacctttcaacacacacctcattcgggggaggagaaaagcacaggaccgcggagagcccagctttgaggccaggcctgaagggataacccacacagggaacgttttcctatcagagaataatggagcacaaaataattcagaaagcgaatgggcaggaccacagcctgagagtcccgcgccgcggggccgctgcagagccggtctcccgagcaccgcggcaggaccatttcgttggaatgtagggcgaggccgaagcccgccccggacccaggccgcgaggtgcgcgccggccgccgaggggccgcctgtaaattacagcccgccgggaggactcggaaatacacaaaaggagccgaaagatttaaacagtcggaggcagaggcgtcccgaggcggccaaagcggaaatcaatcacgtaattaaaacagggaggggacgaagcccaaggctgggggtcccgggttcggaggaggcggccaaggtgcaggccgaggctggcgagcggcttagggacgtggctcgcccgccaggaccagagcgcgcggaggggcttcggggaagtttataacacatcgctattgattcccgcttggctaggaagagcagactctggtgccctctcccaggccagaccctgaagcctccgatggccccttctccgactttcccgtttttgtggggttgagacgcgcagttgcagttgaaggccgctccccagatcccactggtgccacgattttgccaaggcaagtttgcgaacccaaatggcatcaagatgctgcctttgggtttgaggggatggagggaggtgacaccccagtttcaggcactaagaaatctctctcggccttgattcctccaacccaggattcaaagcatgcccggaaagactctgatctatgggccgaggcttggaaggggtgtgcgaggcagacggggttattaaagggagagcttggggctgagcaaactggacccctttgggctggaaaggagaaagaacagctcctggaagagaaaaaaaggcacaccgggagctgtgttttgtgaggggaagatcttattattgaggttaatcatggtaatgatctggtatggctgggtcagcccaggagaccgcgctctccaaagttctttctcacagaggtttctctgggggagtcaagggttccccaacttcactatggttggggaaaataaaataaagacctccaatcctctcctctgccttttcctctccctcccttaaaaactccagaaaaagggaaaccttataaaatctccatcaccccacttatttttccttggctctctccagtttactaaaatgcacggtctttgggaattgagtttttctggagcacccttcttgtgaagcaacagaggtgacccgaccaagtcctcatgaattctgatgctgaccctggagaggacccaggattcccttgcctactgtagaattctctctctatccttagtttttcccagtctctgccttctttggtcttgggtgcataatctcatgggtctctggcagttcagaggccaagaacagattaaggcactttgagataccctcataaactcttaaaagtgtttccagcttcctgtcatctctttaatactgggagtaccaggccagggacccctccataaactaacctaaggccagcctgatttctagatcttttcaagccacatttaggttccttgaaaaataaaagtccccctccccagcaagaaattcaggtcaccaacctgccgcacagcaaggttcctgcatccacacatcagaattttcaacaacaacaattttcataataagaagtaaagcttgcatcaaagttagcaagggacaccccaaaccaaattttaaaaaggatatcatccagcagtcttgaagaggggtgggggtcaatgaggctgggatgagggaggaaggtggtggggaacccaacctctaactaacaatttctccagcataaaaatgaaacatcagattcgttagcccagggccttcatttttccccttccacattataactagttattgaactcgctggaagatctaaaggccatttgcgaagagacaaatttcaatggagtttccccatcaataaccccatggcagtgaactattggaacaagtcaaacacccgaggtgaaatgcaggtcactctgtctaaccaatattaaaatgcggccactttttaaaaagccactttaaacgagatttgaggaaaattgaattccaaggaaggcaaggcaaggcaagagaaatccatgagaggaccttgcctaaggtctccaaacaaacaagagaaattcatctttaatattttaaaggggggcaaattaacattccatgattgcttttttttttttgagactataagcgattccaggagaagaaaaaaggttgagtattttctggtgacacatccaggttattaaaatcattttagaccaattcattacttttactgacaagagatttaagaaaaaatcaattaagatttgcatattcttttgcatacattagccctggctgccggcattagaaagggacaaacacatacacacacacacacacacacacacacacacacacacacacacacacacgaaaaaaatgggctatgagccttgatttagttttgggttttcaagttgcccaaaggaaaaaaaaatcaaagtgaaatgaattgcctgattgcataccatctaaaattcaatttatatgagtgaaaggaaacagaaatgttgcaatttttaatccctaaaacaacaacaacaacaacattcacacacataaaccctgcatttcaaagagtagggaaaggaatgaccctcattttccttccctttgccctccaaatcctgaattggttcacccatttatttttctcccttggaaaaatcagagaggggtacgattttaatgcagcagagaatctatggagccgctgagctctctcagccggcagcttgttactggggaggggaggaatatgggttatccaacggtcagtatggtaatccaggcacaataaggcctcacacacaatggacacatatttttcttcagcgatgtcagaagggaagcgctttgtactgaaacgtgtttccgaaagagaaaccaaatcgagatttagaaaggagatggggtggaggggcaattgcagagagcatttggatgctggcaaaaggtagtcagaaaaaataaaaataaataaaactggggcaaagtgaggttgaggacagggcagaggtgcagcccctgggccagcaaggcgggaggcaggagggtgaaacacaaaagaagacaggaccagatacaaggattcatcacagatgagagctgctttagtacccccaccccctcccaattaagccattgctaagtgcaaaagcccttccaacggattttatttctgtgcttgtaataatatccaggtgaaaatgtttgtgtgtatgtgtgtggtattttacccatgtgacaggcgacttccttgctattaagctataggagcccaaagagagttgctgttgttgttttgtaaatgatgtagatgagtgtgggcacatttgggggaatcttggagatttcactttctggatgtgcatgttgaattagctgcacgaacctggaatgaaaactctacatatttatagctgcataaagaggcatttaatatattaataaatattaatagtgtgcacgcatatatgttaaccataataaccaaagacagacttgacattcagttgggggcatctgaaccctctgtgtctactacttatactggcccaaagtcagtctccttgacccccctgcagaagctcagaaacctggcgggggtgggatgtgacaggcaacatattggggaggactccttaacaagtacaggagggtgaagattgaagaaaagagggttagcgtcagggcacggatggtaaaaggtgagtgtgagggctgagaggatgagagtcaggctcacagctcacctttccaggtgaggcagccgcatccaggtacaggcctagaagggagactgggagtggggccgggaaggtttcctccctcttcatcaaccctctccacatggcaccaaagtttgctgagctttggacttcccggtggagccatctgggactacagttcagacttaggtactaggattcagcactggtttccctttgccctcttccagcaatttataatgaacccacccccaccaccaatgattaagacaaccccacacaacccaaaccactattaaccaagcagtagccttcctccgccccctcactcacagtctcaacttcctctccaaccaaaccagcctgtcctcacatgcagagagttccggacaagagtgggcaagggttctcagccaactctgagaatttgggaatctccattagaggtgttcagcctctggggaactcctgttccttcacctggcctggttacagtggggatgggcactgtcctcttggagagagagtattcagggaccaccaagcaccagctccttgggagctaagccctggccctgctgagcctggggtggggctgggggcctaagcattggaggagggaaggcaacgagggcccaggcgggaatccgcaccctttgggcacggctgtgggtccagcttccctctcattccagccctttggggaagccctaatttggaagtggggaccctctccaacatcccaaaggtgatgagaaaaggattggaatctcttgccttcagtctccctctcacaagggctttattttttttttccctttcccctcctcattcccttaattgcagatgttctaattaaaccctcaaatagttgttatgccgttttaaaaggtacttattcaagtgtcaaccaggctgggctgggaggaggtagcgtagggcggcgaattaaaggtagattgactaatcacggcggcgatcataataataaaatcagagggaaaaaaaatcacattacgacttttcgtggaaaggagggagcaggcagccagcggccgccagccctgcgccgccgccgacacaaagagtgcgggcgattccgcgagactgatttatgacgttttacagccctataaaagctgtagcgacgaggcaagcgctcctaccaccgctggcagatttagtctaataaataaaacataaacagttaactttatgtgtcacttttattgttatcaagtaaaatatagctgagccctggcaagctatgattttaaactataattgttatcaagtacaacaaggggacccggctccctccctgggctctcccctccgctaccccccgcaactctgagttatgggcgatcagttaattggaatcggtggcatgacaggaccacccctagctggggggggggggtggtggttaggaaagcagcttttcctggccccctccctcctctacggccctgtcacccccctccatcagagtattactgtgagtgggtggcagagagagagcagggggtgtgaatgggctggagaccccaaaggctggccgtgcctccccaacttggtgagcttagccttccgtttttggaaagcagcctggagctggcctttaggaattcgtgtttacatgtaaacacacgtgttacatggatacagctcctagccagaagcaagcaggctctacccacacaggcctccctcttagctaggtctgccctctgtggggacagagaaagaactctcaggatcttggctgggcaccatcacagggcactgactcctggcagaaagctctcctccttgccccagctccttggagataattgtcagaaaatagcaggccgggctgaatggggagtggaaacagaagccagcagtagaagagatcctctgctctggggctggggcagggagggtcagtgggtagcaggggaaggcgagacttctgaactctgcttttgccaaccacttcctgtctctcttcagcgggggctcaacccccagacctccagaaatgacgtcagaatcatttgcatcccgctgcctctacctgcctggtccagctgggaccctgcctcgccggccgcatggccagagggttgggtgagtgtgtatggggaagaggggctggactctggtatccttggatggggggcactccaggctctccagcctcctcggctcagcctgggcccctccccatccaacatccactccagtcctcattcaacttcctcttcctgcgaaagaggggcgctgccccgtgacctacacagactgagacacgatcgccatgaatggagacctctggaaaagctcaggagccgaggcccacggggcccagcagaggcctgaggggagaccctgggcgggggctgaatcactgcctcccgacagtcccccaatgcccgggctttggaggggagccgggagcttcccatctccttttgcaggggagggttgtcagtctggcgggatgtgcactgggggcactccaacctctgctagctaaccccacatcaccacccacccccgcctcccagcaccaccaccaccacacacacaaaaaaattggatacattttgaataaagcgattcggttccttatccggggactgggttgctccgtgtgattggccggaggagtcacatggtgaaagtaactttacagggtcgctagctagtaggagggctttatggagcagaaaaacgacaaagcgagaaaaattattttccactccagaaattaatgatcatgagctcgtatttgatggactctaactacatcgatccgaaatttcctccatgcgaagaatattcgcaaaatagctacatccctgaacacagtccggaatattacggccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtccccagccccgccagcctgcagccagccagcccccgaccatccctccagcgccgccagcaagcaacccatagtctacccatggatgaaaaaaattcacgttagcacgggtaggcaactttgctttttgctccccccctccctcccttcttccctagcgctccccaccctcctcggccccctctggcccccgtcctcctttctctccttccccctctctctccaggagcgactctgggttagcacaattgaactggatttacgagcgagaatgggtaattacatcccccataaattttatggcttagctactctgggcagtccgagccatgtgctacgatctgttatgtatgtgtgaaaactatgctcgctttctaagggcgcataaataattcagtgtcgttacaatgaggattcccctcttattacactacaaagtcttcagcttccttcaacttctttataacccatttaagcttgatgactttatttccaccactccctcctcctgtttctcagagctgaggatggggtgagggtggggggcggggagcctgctgcctctgaaccccactatttgcttttcccctccccccagtgaaccccaattataacggaggggaacccaagcgctcgaggacagcctatacccggcagcaagtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccaccgactccccaacaccaaagtcaggtcagcacccccggccggcgctgcgcccagcaccctttcggcagctaccccgggtacttctgaagaccactcccagagcgccacgccgccggagcagcaacgggcagaggacattaccaggttataaaacataactcacacccctgcccccaccccatgcccccaccctcccctcacacacaaattgactcttatttatagaatttaatatatatatatatatatatatatataggttcttttctctcttcctctcaccttgtcccttgtcagttccaaacagacaaaacagataaacaaacaagccccctgccctcctctccctcccactgttaaggacccttttaagcatgtgatgttgtcttagcatggtacctgctgggtgtttttttttaaaaggccattttggggggttatttattttttaagaaaaaaagctgcaaaaattatatattgcaaggtgtgatggtctggcttgggtgaatttcaggggaaatgaggaaaagaaaaaaggaaagaaattttaaagccaattctcatccttctcctcctcctccttccccccctctttccttaggccttttgcattgaaaatgcaccaggggaggttagtgagggggaagtcattttaaggagaacaaagctatgaagttcttttgtattattgttgggggggggtgtgggaggagagggggcgaagacagcagacaaagctaaatgcatctggagagcctctcagagctgttcagtttgaggagccaaaagaaaatcaaaatgaactttcagttcagagaggcagtctataggtagaatctctccccacccctatcgtggttattgtgtttttggactgaatttacttgattattgtaaaacttgcaataaagaattttagtgtcgatgtgaaatgccccgtgatcaataataaaccagtggatgtgaattagttttacgtcaatgtctgatggtttctttttattcccctccctctctggcctggtaacatcccatcttctctatagttgcctaagtttactttaaacaaacacacaaatcttagctctccattagtcttccaatgtccttagaagaacaagcaagggggttggggtatgggatcttcagaagaggggatgtggaagattaaggctgatttctccagtccccttccttccccctgagtctgcagagagaccagactcctctgggggcacttcagtggagctgagggtggggagtgtctcacttttctatagttaggtacagtttcttctttttgtcttttctctctcttcccttctccctcctctgtgctgagtaggcctgcctactttgtagacaagggggcaagtttagggagtgggaaggagaatagttttctttcatcttttagggctcttttgggatgagggattaaggaagacatcccctcaacatttgagttcttaaaagaaggaaggttttgagctggtgactctgaagcagcaaagtcacctgtcaggatgccttctctgtttgtttaggcttggaaaaaagactggccagaggcctgggaggtacccttgttatggataggcctcaaaggctgatgcctggagataataaaagacttttacctttttattctctaacttttattatggacctgccaggtgttgcgaagagacttagggagagtcaaggaccaccctctcttcctataacctcccaggtcctggcagcgtatggggatagcctgaacaagtttctctggctgtaaagaaataaattaattaaataaatttgtttccttggggctaaaaaagaaacaaaaaatcttgcctggattacctgaatacattcaagccaaaggctcccaaataattctggtcctgagatccaggccctagcaaggcctgcttaattttttgcttgtttgttaggagaaggtgggaggagggctgttggtgaccttcttctcggacgatttatccatatttcaggaagaaaggcaattagaagtagaagacagagggagaagagatctagggtatgcagggaagccagggataccccttccccctatccccaaattctggagtgaaaggcaacagcaggactaagttgtacaaatcacattggtgtgctttgaatttatttccttttgaaccacttgctggttgttacttggtgtgtgtgtgtgtgtgtgtgtgtgtgtatgcatgccctcacacatgtgtgtgttggggggagtctcttagtcctttagg

SEQ ID NO: 12753 - DNA, 9681 bp, Human
gggtggatgcggtggggtggggccagagactcgtgggatccttggcttggatgtttggatctttctgagttgcctgtgccgcgaaagacaggtacatttctgattaggcctgtgaagcctcctggaggaccatctcattaagacgatggtattggagggagagtcacagaaagaactgtggcccctccctcactgcaaaacggaagtgattttattttaatgggagttggaatatgtgagggctgcaggaaccagtctccctccttcttggttggaaaagctggggctggcctcagagacaggttttttggccccgctgggctgggcagtctagtcgaccctttgtagactgtgcacacccctagaagagcaactacccctatacaccaggctggctcaagtgaaaggggctctgggctccagtctggaaaatctggtgtcctggggacctctggtcttgcttctctcctcccctgcactggctctgggtgcttatctctgcagaagcttctcgctagcaaacccacattcagcgccctgtagctgaacacagcacaaaaagccctagagatcaaaagcattagtatgggcagttgagcgggaggtgaatatttaacgcttttgttcatcaataactcgttggctttgacctgtctgaacaagtcgagcaataaggtgaaatgcaggtcacagcgtctaacaaatatgaaaatgtgtatattcaccccggtctccagccggctcagcaggctcccccaatttgtctggatagagcctaggcccagtgtcccaggaaggtggatacttgggagtctttggcattcagggaaattggggggactctcctgggataaacagattctgcagcctcatagcccttgttagaactggcgcccccaaaatccctacgaaacaggtaaagtggtggaagcaaaggatggggggatgagcaaagtgccaggcttggagggggagtatccctgccccaccccaccaggcccaggcccaggcttgaaactaaattttgaattatgtgggaggtaggaagggcaatcaagacagttaaaaaaaaatctaacaccttcagcctacagttaggcacccaaaagccccactcgagccagggcatccctgtgcccctgaaatccatcgaggctctgagtgagtctgcgctctccatgccctgaactgagggacaagcactgcacagtgccgaggcgctggggcgggtgaaatttgtgaacttttgtactcttgtgtgctgctgtcggcaaagcaaaaataatgaaagtttgtgatatgtttgtaaatgatttcgaatgacccctcgccctgcccttcaccattagcgcgccggcctcagcccaaggcggctcggtgcctgtgagcagcgcctgcctcggggtctgcagcagcagcggaacggagaggccagcccggatcagggcccatgaaggtaaatgcgcgacttcttggagaagtagctttggcagacaacctggcttggtcgggcagtaggaaaaggagtagacacaggatattcccctctcgcttctttttcttctgccgctgagggcatttgttcctttctggaaaataccacttggtaaggaggagggttatttggatcctggtgggggagggtggttaataaagccgccatccttgggatggattatttttctttctttctttctttttttctttcttaagaagaatattctggttgttcgcctgcttggtaaccctgaccctggcagaagaatgagggaactcattgcttcaaattgtcgccaagcccattaggctacctgaactgtctcagaaagtgcgggtggctgcgtcgaacggtggtggctcagaggaagagattggggccggcagcgacctaggtacctcactctgggtgggacccagaggttgtaacgttgtctatatataccctgtagaaccgaatttgtgtggtatccgtatagtcacagattcgattctaggggaatatatggtcgatgcaaaaacttcacgtttcttcggaatagccagagaccaaagtgcgacatggagactagaagcagccggcgctggtcagccgcctcgttctgttttattaccttggactccaggaggatcagctgcgcctggtgacatagagcagcttttcctctccagaagctcctcacctttaaacagagtatcctctgggtgctgaaaagaaagaaagacagaaagagagaaagagagagagagagagaaagagagaatgcaagcctaattggttgcatggatgcagggccaaagggctaggttttggggtactagggagtgaggtacaaggccagcttgcccagtcccagctctgccctccaggaacatgaggtgcaaaggtacccaaatgggggcttgcttgtatttggggcctgtgggaagaaagcaagcttcaaagaagcccagtggggagctctagggtgcattttgacaaggtggaggtgcccttgccaccatcccagcccacccccagctacatgggcaagggcagcgagggccccctgctattttggcagggcccagctttggctgggaacccccgggcctgggcactggtagaaagcatggcggttactcattgcctaatttgattcaagctggccagattctggtaacttttgggtgaccctgatgaagacaaagccaggacggcggcctttgtatggcagaatccctgctcccgccggctgcaggcagggcgggcaggcaggaaccctcctcgcctggggcactctgcccaactcagaggcgagttcacccacccacctttcattgctctgtaccccaataggaggattcattctcccttgagctgtgcctacttggtgtcggggggcgggggttgcattcagctgggggtgagtggaagggccacggaaggttggcaaaatcagtggcagacaaaagctgggattacctgaggggaatggggtgctggggactggaactacattaatatctggcaggggctctcaaatgtgccatagcaagctacttgattacacgtatgttatttagttaaatttgtgaaaattatgagatgctcaccaacccggtgataaacttgctccctcgccattggctggcctggtcacatggctgcccaactttattcagttgacagcaagtaggagggccctatggaaggagaaaaaaagacaacacgagaaaaattagtattttctaccttctgaaattaatggtcatgagttcgtatatggtgaactccaagtatgtggaccccaagttccctccgtgcgaggagtatttgcagggcggctacctaggcgagcagggcgccgactactacggcggcggcgcgcagggcgcagacttccagcccccggggctctacccacggcccgacttcggtgagcagcctttcggaggcagcggccccgggcctggctcggcgctgcctgcgcggggtcacggacaagagccaggcggccccggcggtcactacgccgctccaggagagccttgcccagctcccccggcgcctccgccggcgcccctgcctggcgcccgggcctacagtcagtccgaccccaagcagccgccctccgggacggcactcaagcagccggccgtggtctacccctggatgaagaaggtgcacgtgaattcgggtaaggctagggtccagtaacctttctgtccacatcccagcccgttagcctgggtcctctggaagggggtgcgagtaggtgggggcgtgtggagcttccatgggcgccgcaattactctccccataaatttttatagctgagggagcaggtcaggaccatgtggctggctgctcggctgtgggcgcaaaagggggtggggatgggggggtgggggaggactccattttcagagcagggggaaggctgtggaggagcgggggatttccaaaatgcttgagggttccggacctggtggtgggcccagaagaaggagcacatttggggatcccgcaagcctggggtatgtgggtgtgtttgaggaggtgggtgggagtgagcgtgtgcgccggggagagggcgggagggaggaagcaagcgagcttgggagcgcgcggggagggccgcgggcctcggggcgcgccaggaagtgagcggcggaggcgaggggcctaactagtggccgggcgctgacctgcctgtcctgtctgttttgtctcgcagtgaaccccaactacaccggtggggaacccaagcggtcccgaacggcctacacccggcagcaagtcctagaactggaaaaagaatttcattttaacaggtatctgacaaggcgccgtcggattgaaatcgctcacaccctgtgtctgtcggagcgccagatcaagatctggttccagaaccggaggatgaagtggaaaaaagatcataagctgcccaacactaaaggcaggtcatcgtcctcatcttcctcctcatcttgctcctcctcagtcgcccccagccagcatttacagccgatggccaaagaccaccacacggacctgacgaccttatagaagtggggaccctgggcccatctctccctgcgcaccaggctgagccgaagctgcgggggcaggccgggcctgctgtcacctcgctgggctctaaggtactgtggggtggacctgggacaagcaggccgccctcggactaggttagcatcctgcccgagggcagccccctccctagagcgggatggggatgggagggggggcgggattctctctctaagtatattatatggcaggagctactgagaacataaaatcttggcgagtcattaaacttatgaaaatcaccgctcttggattttgaatttgcaaatgaaggttggatgctttatcccactgtgaatttggacattctcccccactccacccctccagggtgctttgtggcttaataatgtgggggagttgaggcagaaggttggccacccctgtgctaggtgctttcagtggaagccagagagctgggtcaggatttctggactttctgggttgtctatggaatttcatgtgattaaaaaatatatattttgctcccagtggccccacctccaaagaaatgggtctaagaaggaagtaaaaatgggttattttatgtttagatatttgcttaaatatttatttgttgggaaatgtggtacagaaataactgacaccttcatgccaaaaatcttaaaaaggtgaaaggggctgaacttcagggagcagaatcagagatatgtgcacttacttctgaactccacccctccccactctctggaaatgtatataggggggccttaacccttccagaaggaagcaaaggattcactcaaagttgcattcttgaaaatatatttccacatgtgtttttttcagcactgtgcttacaaccagttctgggtgattaaaggaaagggaaaaaaaccaacaaatggtccaacattttccttctggggaaagaaaacaaaacctctatgcactgggtcattagataatgactgaattttctgttccaactggattccaaatgccctaaataccctcatatagcagtgttttacaggaattagtgtatggcctgtgtaggggaggggctgtgcagtggggagaaagtgggaaggtgaggaactcttgctttaagaaggaaaaaaaaaaaaccctaattgaatctagaagtccacaaaagttagccttagagtttttttccccctgaagttttaatttttttaaaaaccaaatctaaggaagttttcctcagctcattaattagaagcagaatttgtaaaagtataaaagttttcaagcactcgtctttgccttgagaatagtggttttttaaagaatcactctcaacaggggagatgtcctctagtcgtttttcttctgcctctcctgggaagggttcaaagttcatttttctaaaatgctgaccctcaagcataaggaggaagaagtcaaagttaatggccagagttcatatactcagatgaaaccagtcttcccaaggcctcaggctccaaaaaaggttgtagctatcaaaaagtgaccaaagtgggaaagggagaaaggataagcttaaaatttaattttaagatccagaaggggggtatttttttcagtacttcaaaaacactttagaaggtttctgttgtaatttaaaaaatatatttaagtgggagggaaaaaagagtttctctgtaggcttgttctttggctgtgtctcctgagagctgagggcaggtattcactgcagtccctaggctgaaattccgcttctctgaagtgtcttccaagccttggtcttttgtattagaccctggggactgctctttgtttctccttggggtgagcctggctctcagacttgcacatggcaatacttgaatgtcaccacgtcgggatattaaagatggatattcgtgcattattcacatcattgtttctatgacaaaaagcacagagttcatacatagtcaagacgtcttttttctgacgccctcacgttgagaagctgaaaaggtattttaccgaagttcgggtaaattacagaatcaggttcatccagaggacaaattttctatttgattagctgtatttcagccgggaggactgacctctaaacccctaaccttttggactctaactacccttctcttcttttttcctctctaacatggagagcagtctttggatgtaccatttgaaaggagccgctatccttaggcaagttggaaagttgctaagctgctttcctaaaacccaaatctgtctatacattgaaccttctctttgagaaggggaaaaaggtatatattttcacaacatccaattacatatatataatagagatttgttgtatagattttcccccacctcagaagttcaggttactcacccccagtttcataccaaatgccacacaggcttaactgactgcatccctgccccagaggaaagccaagaaacatgttttcatgaggaaaacccaagctccttctcaaacatagccccactactttggaaagtaacttaatcagagaaacaacttctttgtttataagtctcagctctccttctcagcttggagggattcttttgaaatgttaatggagcctggatggcccagagtgcagcccccaaccctgaggtcccagtcggaccccagcatccatttgggcccacaggagtgggccagggaaggggtagggccccgtaaccacttagggcagggaaggaaatgggtttccatctgagaacgtgctttggagaaagctaggtgtggaaaagctccaatgcccatttgctattatttgtttccagtttgttcctttaaatatgagccagaagtgtttgtgttggtgttttaaaaacaaaaacaaaaaccgtgttggggtcctgactgggggagggggagagtgaagtgtttgctgaggacattgctcctctgactcccatctcactttgtccatcgcagccttttgttgggagatgacactgtcagtcagcccatgatgtctgttcacacgagatgcttttttaatagaattgaccaatgttttgctgccactgattaaagtattatttatactaattgttgcttgtagttttgatgtaattcattgatctatatttaaaataataaaaggtgtagcaaaatctccctcctgtttggtgccttaacagaagcattcatcctttgttaagtcttctaaaagctaacatttaacataaacaagttattattttctgcaataaattaggcaccattttttggggggtgcctaaagtgtgaaggttaaaccatgtaaggcttagcaattctattattaccacctccttaatgtacacacactcccagttggccaccatattttgtgagcattgggaagcctggggttgaattcagggtacagagtgttgggtgttaattttttgaagaaaaagtaattgcccaggttaatagggggatccaggttggcattctgctgggcccgggccaggccccagacctttttggtctggaagccctcagaggaagtctttgggaagtggtggatgagacaccttactggtcccccacccctaaggcagggagagcgtgctgggttctgggccgagctgaggctcctgggtggctgctctgacctgacccccgggcctccactcttgggcttctacttttccagtactgttaagctcctgtggggactccagcacctgcccctccttcttccgcgccccctccacccctcaggcaacaataaacactccccactataaaaagtgccctgcactacatttaccgcaagggcttctttacatcttggcctcgccttgaagaaggggccaagacaggagtcccaaaatagatgggggtgcttgttccagacaggaaatgagcagaatgcataaaatcagacatctgtccttaatatatggaagggcttgccccagacgcgtggacatgtgtatttataagtgcgcaggcagaagtttaaatattcagacacattttatgattgtcctctgcccgtcttctgcttaatggctcctcccgtgcccaccaatacatcaataccgttgtgtgtattgaatcgcgggcagggatgaggaggaagcgagtccatagcagagcccgctgagtatagagtacagtaaatcgggaccctcggcggacggcgcttcccgcccgcctgcccgccatgttggggagccctccctgccccccgcgccgggctgggcggccggggctcgctggcagccgggggagggcctttcataacccggagaattttctaagtgcgaggaagatgataagaatagatttctacaagtcccgaccacgtgattggcgaaataattaattcagcacgtcccttaagaaacacggagtcgtcattaatctgccacgcaaagggctctctccgacttggaaagtgcagggatcccaagaatatcacccgtccaggggggccgcgcggtgcccccggccctccacccccggcccccggggggcgcgggagcgcggccgcaggtaaatattttggcaacttttatttcatcagatttaaatccttaatgaacttagctgtcacggccgctgacaaatagttccctttgcttcctgatttggaactgcgcgccggcgagaagttgttagtggcttggatggtgacctttggttcagcaaagctttgcacttatgaaaaattactgagagcggccgagtgtgtgtgtgtgtgcgtgcgtccgcgcgcgcgcttgtgtgtgtgagagagggagagacagagacagagacagagatagggagagggtgtgtgtgcgaggcgctagggtgccagggggcgaggggtgaggggcgaggtgcacgcgggctgctccaagacaacaggagttgtaaaaaaccggcccggctggcggacgcgcctggcgcacgcgggccgaggttgcctggtcgcctgtgtctaccaggaacaatggtcgctgtcacggcatctgccgcctattcttaaaccggtgagaaaaggccctggccctcttttcaagcgagggtcgtaaatttttctttgcgtcataatagaaggctataaaatcgagttgaaattttaccccaggcaggttttaaccaacagataatgatttccgagttgcc

SEQ ID NO: 12754 - DNA, 29771 bp, Human
  misc_feature (1)...(29771): n = A,T,C or G
cctccaccttccagccatgctgcattgacctttttatcatggaatggtatgcagcttctctgattttgtcattgtcactcataatcccagcagacttgtgttataagcagctgcttatattgctgttatgtatagatatagaaatgtaacttgtcagtggtcaaagaagccaaggaaactgagcaaaggtgactgagaacaagtgctcagcatgggctccaacacccagtagggccttttctcattgatttttctcctacaaggaatttctctcttattgaaagacagtacagtttggggaatatcatttgaccagatatcctgctccattcttggaatgaaaaacaggtgcaattttagtataagagtctagctagggatgcggatgaaattaatttataacaggaccaggctgaggaaaaacaccaataaatgctacaaatagtttgtcactttttctaacagggaaatctctaaaggatgataaagatgctagctgtgtttaatagcaaatgttaatttgggggaatatgaaataatcatgatatctttctctctttgagccaaacgcagctttggaatttttctcactgtagtgttgtaggcagaaactatcaactgaggcaggcccttgcgaggaaatatttatcctccttagcccatgcaatgatcaggtttagacagtaaaaaatctatttaagtgactggattgctcatcttttatttactttactcccagtggcctaacctggaacatatagaagaaagtagtggaatggtttttccagacgcacttcagttacttcaggtcctcagtgtttaataaggttttgggagagaaaaaaagctattgctgtgtgaattcaataaatatttaaaaaatttaaaaaatcagtgagcattatttctgccatcatgtgatctgaactatctgagtagtatcataaatcttgggtgatgggttaccttgaccaacctccctttcagtaagaaacaaattattaacagaaagtgaaagagaaataaacctattcaatgtttcaagtccctcagaagagggtgaggcagctccccagttcgttgctagatccagcctggccaatgaaccctgaaaaagcccaactcctgctttcatcatggaagcacgggacaaagtgtctcttcctaaaaacagaagttagaccagaccccttcctgcctatgattcttcaagaagcattgcatcatcaacatcaggcataagcattaataaagaccctaaataataacagagacgaaacacatcgcaaagagagttttcttttatcccctttaaaatgtaaatactcccaggaggaatcagccaacatcattaggggttaatgcatatgtagaataactagggccaggatataaaataagaaatacgtagggaggagagaaaggcatccttgagacgactccaagaaggaaagttggggatgaggcgaaatttctgattttaccttaaagtgaccctaattcgatgaccttttgtggtttttttcttttttcttttttacttggccctgcccaagcaggacctaaaaacaaacagacaaaaaaggttactaacaactgttcctctccacgaaaatctgcagtaaaaggtaaaagatgtattcgttttgaagagaaaccagagcttgcgatgagcttctgtatctccgtcagccctctagcatgacattaggaaccctccaggagatgagtcttcacagcccgggttggcacctgcagacacgcacttttcaacgcccgcaccctgcccggggccggctctcccacccaggcctctctctgcttcagcgccgccccggccgtgggagtcggcgggcgcagtccacagctccaccaagacacagctgtcggggttccgggtgcgccccgcccgcggccccggtgtcccgcccctcgccctcagcccccacccgacggtctttagggtcccccgggcacgccacgcggacccgcagcgactccacagggactgcgctcccgtgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcgggggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtacggattcagcaccactatctgctacttttccaggtggtaactaaggggcgtcagataaggtggaaagggtcatccccacgagacccactgaagccagagcagattgctggatgctcaggttcccaggaacggaagggcgtaagttaggaacccagcaacctgctatggtgagcaaagaacatcagaagaaatacaaatatcactatatactggtctcggggccagccttggatgggactggggagcgagtgtggtacaggttggggacgaagcaacttggcaaaggagccatggacttggtttttgtggccatggaggggcatacgggcacctaatttaagtaaagacatgcacgagctggtggctgtaggctgtaggcttattcttcttccagcgtccccacccctcggtcttacctaaaagcattttaaacttctgggaagatgatcattctttctgaaaagcagtcgcagcagagccaagtgaggaagagccacacctgagtttaaatcacagctcaaccacttgctagccatgtgatcataggaaggaccttaaccatctctcatataacagtacctgcctcagagggtagtggtaaggatacaatgagaaaaggcatccaaagcactttgcacaaagtctggaacaaaaacttactcaattccagctgcaagctaagagagaggaaaattagatcaaaggagggaatgcaaagaaaggtgtctcttttgcttctgcaggagaaacaactcttgggaaaattttgtctacctccagtcttttttataatgagtggaagaaaaaaatgattaccactttagtgggatgacaggtgttaaaagaaattaaataaggaatagtgtgttatattgcttcctgctggctctgaagttttaacatttcctagttaccagcaaagcagtacatgctggatcactgaaagctaccatttaaggaagatttctgcagttggggtataatttaaatgggtcacgttaatattgttttgcccagttgatgataccctttcatcagtcagaaacctctgttcagtaaatggttgctgggttcaatgctgaggttagagggcttgtaactgtgaggcagcagatcacactggtagggtagacaagtaaggaagccaccatttatgaaacccctactatatgccaggcacacactgggtgttttactgagttatttaatctctcaccatcctcttatcacagatgaggaaacatgctctgagaaattaagtaacatgcccaagtcgtgtagctgggaagtagagaagccaaaatcccagagtaagacagtctgattgaaatgctcacccttgcttgctgctgcccctcatttctggtcatggtcctatagctgtggccttgggcacctttttgggcctcagtccctacagctacagagtaacaaaagcaggagacctcaagcaatgggcgagcagtcccactaaggatgaagtgacctttgctgagcccttgtgtgggaggtttctgaagctcacggggaacagagagtaacatcccctcctctttttcacctagcaccacactcccaaaggcaggctacttaagacgggagaaatgaaaaggcgcttcacctcaccaaaatgttggggactctcagacaatgtttaaaggttttcctgcttgaataattaatgtttcactattcacttaaaccaaacaagttggatattcaagcaacttattctaacagaataatattttgggggtaaatcttcacgttaggtttgaggatataaattagttttctacgcatatctctcgctactgtatgaaggaatttttgaggcctttcttcatttataaaatgtaattttgtatatgcatttatttatttttacttgccatggctaccactggtaactgaaacatatttatgaactaattaaaactggcaatgatactgttagtcattgtccttgaaagagaatattataaaaattaatatgttggtagagcagcatttcccagagtaggttccatgagaaataagttccatagaatatcaatgagcgttccttagagaaaatattacctggtcaaatgtgtgtaaacaaagctaagaatgctttgcgagattctcatagcttcaatgtcctgaagagcactgggaactccaggaatgggatgtagtgcctagtattctctaaactcatttgcccaggaagttcttctttggtggagcactccgtgggattagtatttcgtaggatggcctttagaaactgccatactatggtattcagtgctgattttgtttttgtgctggtgcagcttgcatctctgtcctcttcttcaagtgatctgcacatcaatttggtggtgacctttctggggcatgaaaatcaaattttcaggcctactaattagttatcccctttgtccccatctcttaaaaataagattttaggccaggtgccatagctcatacctataatcccagcacttagggaggctgaggtgagaggatcacttgaggcttggagtttgagaccagcctgggcaaaatagcgagaccccatctctgcaaaaaaataaattagccaggtaaggtggcatgcacctgtagtcccagctacttgagaggctaaggtggggggactgcttgagcccaggaggccgaggatgcagaaagccatgattgcatcactgcactccagcctggagagagcaagacccagtctcaaaagagagaaaaaaagaaggaaagatgaaagaaaagaaagaaagaaagaagggaaggagggagggaaggagggaggaagggaaggaaggaaggaaagaaggaaggaagaaaggaaggaaagtagactaccatttcctaatttttagtcaccttctagtcctctacgatctttttaaactggcaaataatattgctttagtaagttttctagtacctggaggttaaaattcttgaaattttcataactcttacatttaaatcattttcattcctcctttcttctcacactcaactaatatttattgagcacatgtatggtgccaggcactattctaagccctgggggcatactgtaaataagacaagaccccaagaagcttgtgttcttgagactgactctccttgatattgtttcatttatcacccaagcatcttggatgttctgaaccccagttccttatcacttttttatacatattagtaggtgaatattaccccataaacttaattttcaaagactattgagatcaacaccttaatggaggtgttaaaatgatggaacttcagacattaaggcttgtaatgaatggggaagttatttcatggaagataagcctctggacatgtgcttggaatcacttaaaacaaaccggacagaagatggccaaataggaacagctccggtctacagcgcccagcatgatcgacacagaagacaggtgatttctgcatttccaactgaggtaactggttcacctcaccaggactggtcggaaagtgagtgcagcccatggagggtgagctgaagcagggcagggcgttgcctcacccaggaagcacaaggggtcgggggatttccctttcctagctaagggatgccatgacagactacctggaaaaacaggacactcacacccaaatactgtgcttttcccaagctcttagcaacctgcagacaaggtgatcctctcccgtgcctggctcggtgggtcccatgcccaaggagccttgctcactgctagcgcagcagtctgagattgatctgcgaggccgcagcctcgctgggggtggggtgtccaccattgctgaggcttgagtaggtaaacaaagtagccaggaagcttgaactgggcggagcccaccatagctcaacaaggcctactgcctctagactccacctctgtgagcagggcataggtgaacaaaaggcagcaaacaacttctgcagacttaaacatccctgtctgacagctctgaagagagcagtggttctcccagcacagcgtttgagctctgagaatggacagactgccccctcaagtgggtccctgacccccgtgtagtgtaactgggagacacctcccagtaggggccaacagacacctcatataggcggctgcccccctgggatgaagctttcagaggaagcatcaggcagcaatatttgctgttctgcagcctccgctggtgatacccaggcaaacggggtctggagtggaactctagcaaactccaacagatctgcggctgagggacctgactgttagatggaaaactaacaaacagaaaggaatagcatcaacatcaacaaaaaggtcatctatgccaaaaccacatctgtaggtcaccaacattaaagaccaaaggtagataaaaccacaaagatggggagaaaccagagcagaaagctgaacattctaaaaatcagagcgcctcttctaaaccaaaaggttgcagctccttgccagcaatgaaacaaagctggatggagaatgactttgaggacttgacagaagtaggcttcagaaagtcagtaataacaaactcctccaagctaaaggaggatgttcgaacccatcgcaaggaagcttaaaacctttaaaaaagattagacgaatggctaactagaataaacagtatagagaagaccttaaatgacctgatggagctgaaaaccatggcacaagaacttcatgacgcatgtgcaagcttcaatagccaattcaatcaagtggaagaaagagtatcagtgactgaagatcaaattaatgaaataaagtgagaagacaaggttagagaaaaaagagtaaaaagaaacgaacaaagcctccaagaaatatgggactatgtgaaaagaccaaatctatgtttggattggtgttgggagcaggcccctcaaaatctggccataaactggccccaaaactggccataaacaaaatctctgcagcactgtaacatgttcataatggccctaacgcccaagctggaaggttgtgtgtctacgggaatgaaggcaaggaacacctggcctgcccagggaggaaaaccgcttaaaggcattcttaagccacaaacaatagcatgagcgatctgtgccttaaggacattctcctgctgcagttaactagcccaacctattcctttcattcggccatccctttgtttcccataagggatacttttagttaatttaatatctatagaaacaatgctaatgactggcttgctgttaataaaaacatgggtaaatctctgttccgggatctcagctctgaaagctgtgagacccctgatttcccacttcaaacctctatatttctgtgtgtgtgtctttaaattcctttagcaccactgggtaaaggtctccctgaccgagctggtcttggcagatttgtgtacctgaaagtgatggggagaatggaccaagttgcaaaacactcttcaggatattatccaggagaacttccccaatctagcaaggcaggccaacatttaaattcaggaaatacagagaacaccacaaagatactccttgagaaaagcaaccccaagacacataattgtcagattcaccaaggttgaaatgaaggaaaaagtgttaagggcagccagagagaaaggtcgagttacccacaaaaggaagcccattagactaacagtggatctcttggcagaaatcctataagctagaagagagtgggggcctacattcaacattcttaaagaaaataattttcaacccagaatttcatatccagccaaactaagcttcgtaagggaaggagaaataaaatcctttacagacaagcaaaatgctgagagattttatcaccaccaggcctgccttacaagggctcctgaaggaagcactaaacatggaaagaaacaaccagtaccagccactgcaaaaacatgccaaattgtaaagacccttgatgctatgaagaaactacatcaattaatgggcaaaataaccagcaaacatcataatgacaggatcaaattcacatataacaatattaaccttaaatgtaagtgggctaaatgctccaattaaaagacacagactggcaaattggataaagagtcaagacccatcggtgtgctgtattcagagacccatctgatgtgcaaagattcacataggctcaaaataaaggaatggagaaagatctaccaaggaaatggaaagcgaaaaaaagcaggggttgcaatcctagtctctgataaaacagactttaagatcagaagggacaaagaaggccattacataatggtaaagggatcaattcaacaagaagagctaactatcctaaatatatatgcacccaatacaggagcacccagattcagaaagcaagttcttagatacctacaaagagacttagattcccatgcaataataatgggaaaatttaacaccctgctctcagcattagacagatcaatgacacagaaagttaacaaggatatccaggaccagaactcagctctgcaacaagcagacctaataggcatctacagaactctccaccccaaatcaacagaatatatattcttctcagcaccacatcatatttattctaaaattgaccacataattggaagtaaagcactcctcagcaaatgtaaaagaacagaaatcacaacaaactgtctctcagaccacagtgcaatcaaattagaactcaggattaagaaactcactcaaaaccacacaactacatggaaactgaacaacttgctcctgaatgactactgggtaaatcacgaaatgaaggcagaaatacagatgttctttgaaaccaatgagaacaaagacacaacataccagaatctctgggacgcatttaaagcaggatgtagaggaaaatttatagcactaaatgcccacaagagaaaccaggaaagatctaaaattgacaccctaacatcacaattaaaagaactagagaagcaagagcaaacaaattcaaaagctagcagaagacaagaagtaactaagatcagagcagaactgaaagagatagagacagaaaaaaaccctttaaaaaatcaatgaatccaggagctggttttttgaaaagattaacaaaatagaccgctagcaagactaataaagaagaaaagagagtagattcaaatagatgcaataaaaaatgataaagaggatatcaccacctatctcacagaaatacaaactaccatcagagaatactgtaagcacctctacacaaataaagtagaaaatctagaagaaatggataaattcctggacacatacaccctcccaagactaaaccagggaagaagtcaaatctctgaatagaccaataacaggctctgaaattgaggcagtaattaatagcctaccaaccaaaaaaagttcaggaccagacggattcacagctgaattctaccaggggtacaaagaagagctgatatcattccttctgaaactattccaatcaatagaaaaagagggaatcctccctaactcattttatgaggccaacatcatcctgattccaaaacctggcagagacacaacaaaaaaagaaaatttcaggctaatatccttgaagaacatcgatgtgaatatcctcaataaaatactggcaagccaaattcagtagcacatccagcagcacatccaccacaatcaagttggcttcatccctgggatgcaaggctggttcaacatatgcaaatcaataaatgtaacccatcacataaacagaaccagcaacaaaaaccacatgattatctcaatagatgcagaaaaggcctttgacaaaattcaacagcccttcatgctaaaaactctcaatgaactaggtattgatggaacatatctcaaaataataagagctatttaggacaaacccacagccaatatcatactgaatgggcaaaaactggaagcattccctttgaaaaccagcacaagacaaggaagccctctctcaccaccctattcgacatagtgttggaagttctggccagggcaatcaggcaacagaaagaaataaagggtattcagttaggaaaagaggaagtcaaattgtccctgtttgcagatgacaagattgtatatttagaaaaccccatcatctcagcccaaaatctccttaagctgataagcaacttcagcaaagtctcaggatacaaaattaatgtgcaaaaatcacaagcattcctatacaccattatcagaaaaacagagagccaaatcatgagtgaactcccattcacaattgctacaaagagaataaaatacctaggaatccaacttacaagggacgtgaaggacctcctcaaggagaactgtaagccactgctcaactaaataaaagaggatagaaacaaatgggagaacattccatgctcatagataggaagaatcaatatcatgaaaatggccatactgcccaaagtaatttatagattcaatgccatccccatcaagctaccaatgactttcttcacagaacttgaaaaaactactttaaagctcatatggaaccaaaaaaagagcccacattgtcaagacaatcctaagcaaaaggaacaaagctggaggcatcacactacctgacttcaaactatactacaaggctacagtaaccaaaacagcatggtattgctaccaaaacagaggtatagaccaatggaacagaacagaggcctcagaaataacacaacacatctacaaccatctgatctttgacaaacccaacaaaaacaagcaatggggaaaggattccctatttaataaatcgtgctgggaaaactggctacccaaacatagaaagctgaaactggatcccttccttacaccttacacaaaaattgattcaagatggtttaaagacataaatgttagacctaaaaccataaaaaccctagaagaaaacctaggcaataccgttcagaacataggcatggacaaggacttcatgactaaaacaccaaaagcaatggcaacaaaagccaaaatagacaaatgggatctaattaaactaaagagcttctgcacagcaaaagaaactatcagcagagtgaacaggcaacctacagaatgggagaagatttttgcaatctacccatctgacaaagggctaatatccagaatctacaaagaactcaaacaaatttacaagaaaaaaacaaccccatcaaaaagtgggtgaaggatatgaacagacacttctcaaaagaagacatctatgcagccaacagacacatgaaaaaatactcatcatcactggtcatcagagaaatgcaaatcaaaaccacaatgagataccatctaatgccagttagaatggcaatcattaaaaagtcaggaaacaacagatgctagagaggatgtggagaaataggaacgcttttacactgttggtgggagtgtaaattagttcacccattgtggaagacagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacccagcaatcccattactgggtatatacccaaaggattataaatcatgctactataaagacacatgcacacgtatgtttattgaggcactattcagaagagcaaagacttggaacccaaatgtccatcaataatagactggattaagaaaatgtagcacatatacaccatggaatactatgcagccataaaaaaggatgagttcatgtcctttgtagggacatggatgaagccggaaaccatcattctcagcaaactatcacaaggacagaaaagcaaacaccacatgttttcactcatagatgggaaatgaacaatgagatcacttggacacagggcggtgaacatcacacactggggcctgtcggggggtggggagctgggggagggatagcattaggagaaatacctaatataaatgatgaattgatgggtgcagcaaaccaacatggcacatgtatgcctatgtaacaaacctgcacgttgtgcacatgtaccctagaacttaaagtataaaaacaaaaaacaacaacaaaaacaaacagacacatgtaaagtaaagctcagtgctttttatgtgtatgtgttattttatccttctgccagagataggtgatatagctcatgaactagttattatgggatagtcatgagatgttagcatcctcataatatagtgaagaaactgaggcgtgaaaaggtcatacgccttgcctaaggtcatctggatatgaaacagtagagccagaactggaatccagaccttcttcacaaattttgtgcctgttccagtatacccccactccctttcttttttattttatttttgagacaagatctagctctgtcacccaggctggagtacagtggtgcagtcataactcactgcagcgtcaacctcccaggctcaacctttcttcccacctcagcctcctgcgtagctggaactacaggcacgcaccaccatacccagctagtttttaattttttttttgtacagacaggatctcactatgttgcccaggctgatcttgaactcctggactcaagcgatcctctcacctcagcctcccagagtgctgggatgacaggcgtgagccactgtgcctggtccccactacctttccaggagcctgctcctccccaggccctgtgaactctgactactctgatttgacttattctaatatttccagcaaagtctccaagttgtgccaactccaataccaagaattggaccaacagatgctagtcagtgaatacagtgaagtttcaatataattattcttttgctttaatttttttaaggtaccaaatcctccggcttaggggcctgtgagtggcttcttgtcctcatttccctgctcttcatcatcatgaccttccctttttccatctggttctgcgtaaaggtgagattccataaggacccaaataggtaatttcctgaggcctctcactggccacaccatgcccattctcacttctgttttctggtacatgttattgctccatgtggaatgccctcaccccagactcaccttccaggatagcttactcctccaagaccttgctcaaatgtgaacaggaagccttccttgactcccccagactgtcattcccttcctggtgctcccatgtcactctgctttcactttgttctaacacttaccatgtgtattatattggctatgtctcgttcatctgcattctgtgaccagaatggatcatgacatccactccacacacttccacgaaacttctcaggcagcttctatagaccatgagtcatgattatgtttggcccacaggtggttacagatgcctgtccctgaagtaaatgaagacctgtgtccattctggaagcacatgccaagatggaattagaggagcaagagatttattgggagacattgcctgtgaaagattaacgggaaagaaaacaagagtagtcaggagaagccttcagacagttatgcaggcctgacacttgtgatatgagaaggggaagaaaggattgggcagaaagagcctctgactgtggtgcagctctgagaaagcattggccagcccaaaagggaactccggagcaaggtttgcttcataggagtcccacagtgggcagaaatggcacggccctagtactcctgccatctcagtcactggctgtagctgcagagaagactgtgtccttggctgaaacagtacacctgctgctggggctgttgttggttttactcctcacagcaagcagcagctctttcctcttccccttcacctttccctccccattttcctccccaagatacattttggtatcttgtgtttttgttttcatttatctcaaagtattttctcattttccttgtgatttcttctttaacccattggttagagtatgttgtttaatttccacatatttgtcaatttctcaaatttccttctgttattgatttctaatttaacttcattgtaataagagaatatactttatgttatttcaatccttttaagtttgtttaagttagttttatggcctagcatattatctatcctggagatgatgtttcatgtatgctggaaaagaatgtattattctgttgttgctgggtggagatgttctgtgtagatgtctgttaggtctatttgttgacagtgctattcaagtcttccatgtctttctagttccatccattgtttaaagtggggtattgaagtctccaactgtcactactgaattgtctatttctactttgaattatttttgtctttttcctcatgtattttggaactctgtttttagatgcatctatgcttatcattgacacacttccctaatgcattgatccttttatcattatacaatgtcccactttattgctagtaacatgtttgcttcttttgaagtccattttctctgatgttaggatagccattcccgctctactttagttactgttcatatggtatatcttttccatcttttactttcagtctgttcatatctttgaatataaagtgtgtctcctatagacagtgtatagttggcagcaggctcttctcaaagggtgacctgagcacctgcatgactgccacaagatacaacactgactcagccatggtttttgggaaaggctctcagatctggtcacttaagatggtaagccctaagaagccaattagggagaggaaacaaaagcagaaccaggcagttatatttgagcaaggtcttgaagaaataagactccccttcatctctggggagaatttgttttttccaataaaagcaggtaagaaacaagtaatgctaggaaaccaagcaattgggaattgcttggcatgctctaagaaccacatacagtcattcattctgattgtttcaagcaaggcagtgttctggcctcataaaattgtaaacctcatgaagacaaacaaaacatggttcccagcctcaaaggacttacagtgggttagtagatcctgttactttaagaagcacatttcaaaatgtgttttgttgggcctctttatcacatttttatatttggctagttattattcattggagctttttaaagtggagggaggataaggaaggaaaataaatttgtctatagtcacaaatcattctttcatttattcaataaatatttattgaatacttacaatgtatcaggcattttttaagcactgagaaaaaaaagattaattccgtatcatcaaggagtgcctcatctggtggggcatatcttaacatgtaaataagcagaccaagttaaatcagtgataaacacgcaattgaactcagattctgatactgggtcagaaagtgaagtttatttttaaagtagtgtgcagtaacttctctatttttcttctaatagacattctccagattctttttgtcatttaaaagtatctctgcacattttcagggtaaacacaaatcttctagatctatcaccagtgaaaattggcaaattaaaatccaattgaggctggccacggtggctcacgcctgtaatcccagcactttgggaggccaaagcaggtgaatcacctgaggtcaggagttcgagaccagcctgacgaatatggcgaaaccctgtctctactaaaaatacaaaaaattagccaggcatggtggcttacacctgtaataccagctacttgggaggctgaggcaggagaatcgcttgaacccgggaggcagaggttgcagtgagccgagatcatgccactgcactccagtctgggtaacaagagcgaaacttcatctagaaaaaaaaaaatccaattgaatcattttgaagcagcctcagaagaaattgcactctgaaacaaaacatcacaagtggtattaaaatatactccctctttccattaaatagctaatgagcaatacatataaaagctagtgcagaactcacagtaaaatataagatttaatatgccttgataagattaatttagggaaagttggccatggattttagataatcataagtctttaatcaaaattctgtctatgggttcaaaaattaacatggttaatatactttttcatttctgaaattttacacttactaaatatagattttggaaacttaagtattaatagaaattttttcctggttctcaaaacaaaaaatttctgatatctaggatcattcttatgccaaggccttttgaagactttttctttctgggagtgatttgaaaggattaaatttctctttaggttgtacaagagtatgaaagagtaattatattccgactgggacatctgcttcctggaagagccaaaggccctggtaaaaaaacactcttttttttctaaacacctctctcctgacttgccaatttcttcaacccatgcagatttgtaatatggacctcagattaaatgaagtaacttgattcatgatatctgaattttccaatctgttacttataggttattcaaatattcttcagagactattactactaggtcataggtagccaagagagagaattggtacagagagcccacatgccagggcaaggcttgctggaatagcaagttagcttaggaccaatggctggggactgatttgagtacgatgtgtatatggtcagagtcctgtgaattctcagagaaaagctgagctagttcccactccaggtgctcagatccaatcatgagaaacaggcaaagttcagcattcaaataacaaattgctcttcagttatagggatttaaaaaacatagattaagcatttcttgtggctcagactctgtgctaaccataagacatggtctctgatctcaggaccttaagatctagtggagttgatgtccagaggtccaagctcattatgggagacagatagaagtatggtcagtctgaaaggtttagtagtgggggtttggagatctaagtcagccaggaaggcatgaggagcaaagtcccatgtgtatattatattggagagggtctgagttccaggacacgcccacagagaccagactagggacaaatatcagagtttgaagattcagaatgaatatatgagtccacacaaaagtagaaccagactctgtagttccaggacaaagaacatcttgttctggccctggttttcaggaaccttctcaattggcactgaggaggactagtagctgactagtatcctggactctgtgaggtgctgcttgtttcaacaaagctttggcttttgcaggagcccacagaatccaatgggctctcagaaaatctcaataaatcaatctacaaatgtttattgcacattgatcctatatattatattgggtgggtgaggactaactagccaaccagaaagctggtatcatgataattgctattctgattacttctggggctcacattctaacgaatatgacatggaggttgctggctctaaagtttgacacctgggtacactcatggattcaaaaacaattttagagagcacctaaaaggcactaagtcagacactaaggctaacaatagtgcataggacactacttaggaaattcaattctagtgaaaggacagacacgcaattgagacctggggaggcagcaccatgactaaaaggaccacacagcccagtttgctgggaataatccctgtttatacctattgtcctggattacatattataatatataatagtgctctccttttaccctcaggtggaggtgggatgggccaatggtctgtaattagaggctaagaaaagtaatgtagtgtgcaacctgaccccagaaaggtgaaacccaaacagccttcatgctagctatttatctgtcacttcctcctcctctcttttaggtcttttcttttttttgccctgcctggatacctaccacaaggttgaccttcgtctccaaactctggagataccttttcatgaggtaagccaaatgatggcttttgctttctctatacattttccatggtctacctaccgtggacaaaatgattatttatactcaaaaataggaaagaaaaataatgatatggactacatcataacttaaaacttttgtgcatcaaaggacacaattaacagagtgcaaaggcaatctagggaatgggggaaaatatttgcaaatcatatctcataaagggttaatattcaatatatatgaagaactcatacatctcaacaacaaaaaaagtaaacaacctgattttaaaaatgggcaaagaactttgtgatagttaaccttatgtgtcagcctggctaggccatgatcatttgacctatatttggccaaacacatctgggatgttactgtgaaggtacttttttagatgggattaacatttaaatcagcagacgttgagtaaagcagattaccctcccctaatgtgggatgggcctcatccaattaattgaagggctcaagaaaaagactgacctccctttgaggaggaaggaattctttcagtagaaaagataaactcttccctgggtcttcagcctgaagattttagacatgctggcttccataagcacatgagccaattctttaaatcagtatttttttctctccccaccccagcatacctatatgtgtacgtgtgtgtgtacatatatatgtatgatgaaacctaaacacacacatacacattctatagtttctctagagaaccctaatacgaacttgaacagacatttctcaaaggatgacatccaaagaagatgaagatatataaatgggcaacaagcatatgaaaagatgctcagcatcactacattaggaaaatacaaatcaatatcacaaaatatcactttacactcattaacatggctactgtttttttaaaaacctggaaaataacaagtgttgaagaggatgtagacaaattggaaccctcgtgcactgttggtaggaaaatgtaaaatggtgcagccactgtagaaaacagtagagcagctcctcaaaaaattaagaatagaattactgtatgacccagcaattccacttctgcatatatacctaaaagaattgaaagtagggtcttaaagaatatttatacaactgtgttcataacagcattattcacaataaccaaaaggaagaagcaacccaagtgtctactgatgactgaagagataaataaaatgtgatatataacccacaatggaacattattcggccttaaaaagaaaggaaattctgacattctacaagatagatgaaccttgaggacattatgctgactgaaataagccaatcacacacacacacaaaatactgtatgatcctactcatatgaagcacctagagtagtcaaattcatagagactgaaagtagtacggtggttgcaggggttgaggagaaggagaaattggagagttattatttcatgggtacagagtttcagttttacaagatgaaagagttatggagatggatggtggtgatagttgcacaatattatgagtgtattcagtatcactggactgtatacttaaaaatggttaagatggtaagttttatggtatatgtattttaacacaataaacaaaattggggaaaaaaaactcaccccaatcctgttacccatagttaactgttgatattttggagtatatcctttcagatttttcagtgtatgtggttatatttacagatgggtatatatatatacacacatatatcataccatatatactgttttgtaatgtgtctttcttaacccaacaatatattgtgatcatcttttcatatattagctaaatgcttctatctctttattttaaatggacatacagcatttcatttagtggctgtatcacaatttactcaaccaattccctattgttgatgttaaattctttccaatttgtattccaattagcaatactgtgagtaacatccttatagctaaatccttaaaatatgtccttatgatcaatataaaaagggaaatgttaagacatctttctagggcttatgatgtatatcatcaaagcatcccctaacgtacactctagcgagcaacacattagagtgcttgtttcccagaacatgcttctcttttagcagatgctttattttggtatcagtttagaaagacctggtttggaatcaactgaatgtcttcttatgagaaaattatttctgattttttttacaaaaggatttaccacaggattaagttgtgcattctttcgtgtatttaataaaaatttcataattttcaaaaacatgtctattttaaataaagggtaggccaactccatttttctcttgcggagaaaattcactttgaacacatttagttcctctaaccccacataggaaaggagcccaagaatcaagcctgtcatccaaacttttttctgcctagatcgtgaccaaagacatgtttataatggagatagatgccatttgctactaccgaatggaaaatgcctctcttctcctaagcagtcttgctcatgtatctaaagctgtgcaattccttgtgcaaaccactatgaagcgtctcctagcacatcgatccctcactgaaattcttctagagaggaagagcatcgcccaagatgcaaaggtacttagataaacataatggccaatatgctgaaatatttatcttttattcatttgttcattggacatttattaaatcttctatggccagttccatcccttaggggccatccctttgggagctcatagctagttaggaggttgccaaattgactctgagtcaattatagttatcagtatggtgcttgttaatcagtcattgccgcagtttttgctctcaaacctactccagtgactttaaattcatctccaagtactcacctagtattaagtattcagaatgattgctggcaggaacggtggggttggtggggatggacaggaggggttggtacacaaagatgataaagcatggttcccaggagcttactgtctacctggggaaacaagcataatgagtgccaagttaaataataagttcaaataagacttccagataacaaaagctaagatgtcatagacctttacatgatgaattacccaatccattgtctagatttaatcaatttggaattagaggggaaagagcaagaactgcttcacaagcagctccctctagtccacagacagcaagctcagcaagctcattcacggccagggtcggtggctttgattcttaccaaggcaggtaggcaacaggtattcagaggagaagtgagaagacagcaggattccaggcagctggccaatggagtggcaattaccaccagcaatggagcctgtcactgaagcagtggggacacccaggcccagaactgggttaggaggttgtgaaccatggtagttggaaggaggacctcaaatagagggaccccaagaatcaaaggcactggtggcaattatgctttatgggatgtcccccttcaccctcctttccttattcatccttctcctttaaaggataaagtccagacacttgacattcaagcttgcccttgttacactgattataatatatatgcaagtgttctttgacttataaaccatcataaagcaaaaaatatcgtaagtcaaaaatgcatgtatcctaataaacccatgataaaagtcgaaaattgtcaaaccattgcaagttggggaccatctatctaagacactggttttcccagactacaacctccatagcagcaggggctatgttttatccatctcttggtcctcagcacaggcctgtcacacagcaggtagataatgttttttggataaataaataaatgacccaactattctagtctcacctcttgccacccttctcccactgaatctaatactccaacctactttagcttttgtccagcattcagcacttttatgctcccattgcctcctcttgggctgtatcttctgcatcgaatacttcccttttctccacaggcaagattttatttgtcctttaagatgccacctattctgcgacgtctttatcaacattccttactctcacccacacccccaaattagtcttctcaaggttctcaatgcactatgcttactgtttgtctaaccactaaaaaataatgagaaaagaagtgtaaaaagaagagtttgggtcaacatggagagctccatgccctgcccctcctttccagaatccacagtcgattttcttccctctcctgtttccaacttcaatcaagggggtggatgggactgagaagcaggaggaaactggaaccaccagcatcagctgtagaagtgaaaacatcctataaatgaaagacatctggaagagagactagagactggttctcaactcagtgcattttaaaacagatttttaaaatatatctgtattagttcctattacttctgtaacaaactaccacaaacatggtggcttaaaaccaaacaaaaattattttcttagtttcgaagaccacagagtccaaaatcagtttcaatgggctagagtccaggtgtcagctggaccaatttcttctggaggttctgagaggagaatccgtttccttgccttttccagcatctggtggctgcctgcatttctcagctcgtggcaccttcctccatctttagagtgcatcattccatttcctgcttctatcatcatgtcaccttctcttcttctgtagtcaaatcaccatttgcctccctcttataaggacacctataattacatttagggccacctggataatccaggataatatccccatctcaagagcctttaacctaatcaaaccagcaaaatccctcttggggtaacattcacagattccagggattaggacatgggatatctttggggaccattattcagcataccacaccatcttcaattgcacagatatttattgggtggcaccatgcaagttaaacaactctttgcaaggcactgtgaagttaaatacaacaggcaaataatgtcctttcaaagggaatgttgttccttagtacagaacaatggccaccagggtttaggcatgctctcctcccacctggaggctcccactgacatctgaattcttctttccacaggttgccttggattcagtgacctgtatttggggaatcaaagtggagagaatagaaatgtgggtaggaaattaactagcaagaactgtatgataaaggaaaatattctggtttcattttaaatttttcatttgaaaaattattttcactgagtactatagccatatcagcataaatttataaaaaagagaaacaaatcacctaatatcttacagccataacacaatcactataacatttggacaaattactctgattatttttttctctatgaatctaaaaattgttttagataaaatttacatgaaatttcccattttaggccaggcgcagtggctcacacctgtaatcccagtactctgggatgccaaggtgggtggatcgcttgaggtcaggagtttgagaccagcctggccaacatggtgtaactcttgtctctactaaaaatgcaaaaattagctgggcgtggtagcacatgcctgtaatcccagctaccagggaggctgaggcagaagaatcacttgaacccgagaggcagaggtttcagtgagccaagatcatgccactgtgcttcagccatgaccacagagcgagactcgatctcaaaaaaaaaaaaaaaaaattagccgggggtgttggcaaatgcctgtaatcccagctactcaggagactgaggcaggagaatcacttgaacccgggaggcggaggctgcagtgagtcgagattgcgcattgcactccagcccgggtgacagagtgagactctgtctcaaagaaagaaaaaaagaaatgtcacatttttgctattttaaactgtggttttagtataatatatttactaaggggtacatccattactattatctaatttcagaacattttcatcatcccgaaaggaagcctgtacttgttaagtgggaatcccccatgtactccttaatccctggcaaccactaatttagtttctgtctcaatggatttgcctcttctggacatttcacataaatggaatcatacaatatatggctttttgtgtctggcttcttttcacttagcataatgttttcaaggttcaaccatgcttgagcatgaatcagtacttcattactttttatgatcaaataatatttcattgtgaggctataccacattttattggttcatcagctgatggacatttaggttgtttctgctttttggctagtatgaataatgctacagcaagcattaatttgcaagtttttgagtgaacacgttttcaattatcttgggtctgtatctagaagtagaattactaggtcacatggtaactccgtatttaactttttgaggggcagctaacctgttttccatatatgcatttttatagttataatcagggtcaaaagacaattttgtaccttttatgcaatacattaagcgttgttcttatttggtcagttgtacccttttcaaaatcaattcttctcttttataaacttggatgaattccccttatctttattatcagtagtgtggctcttcaagccattgttcaaatttattagttggggcttagattatatcctaagcggaaaaactgagcacagctcatcaatacaaaacctgctgtgctgataatgagaaactacagctctactgtagcatcagcaataatacaaaactgcatttgaggcatcgaccttggagatctgcctacttttgacctcagaagtctaggaatggcacactctggtcactccaaatttgctactcatcatgagacagcagtagagaggcttgcaagtctgtgtgaaagctttggcccctaaatcatggctgcacacctacatacctgcattctttctttttcagtaaagatgtgaggttgccagctgggcttcagcactcactggctgtggaggctgaagcgcaaagacaagccaaagtgcgggtgagcactccatcctcccacccagactgccctttaggaaggcctgctcgtggagaacatttcccctttgcttccttactgtccattcattaggcactgggcagaagctgtcttgggcccttacaactctattaaaattgctctcttaaagtgtgttaatagtcccctgactaatgcaactcctctccctctctgaagctactgataatagtgaccactcactgcttgagtctcaccttccctctctctccttaaaggcatctcctccacacacatcaatccctcttctctagtgctggcatcttttcctgggtaatcgtagtcaccctaacttctaacttctaggtatcccctagaactgtatcccaagcttggcacaagttttagagggacaaccacgatcagggcccagttccctcaatgctagagccaagagaaggctgtgctactcggctccactcaggcatgacagcaagaagcaaagatgtggcagctagcagcttctggtaactgaggtgtgggtgagggggccttgggaagaggaaagtgaagaatgaagggaggcagatttctctgaaagaacagagagcaggtgaagataaaaacctgaaccagtaagaggatcattgcctgtggatcactgaggggaggcggggatgaggaaggggaggaggatagtccccagggcagttgcttctagatctctgagtgaagtcctcttcacccactttcaggtagcatttgtgtagtgagctcagcactttctcttcagaaatgtttacccattcactttccctgagttgggggtcaccctttcataacgtcatgcctttgcatggaatgctggctaatcttttctctatgttggcaaaatcctaatctttcaaggcccatcagatgctaataactcccctaatacttcatttatacttgtgatggctcctaacgcattccaccttaaattgtgattaacagtttaatctgtctccccagctcaagacccttcagaaagaagaataaacatgttctatgcttaaccgtgcttgccacatagtagatgctcagtgcttgtctgctgagtcatactgcatagtggtgaagccttcagggaatgaagaacaatcactttgctttcgtcacatgttttctagatgattgctgcagaagcggaaaaggctgcttctgagtccctgaggatggcagctgagattctgtcaggcacccctgctgccgttcagcttcgatacctccacacccttcagtctctgtccacagagaagccttccactgtggttttacctttgccatttgacctactgaattgcctgtcttctcccagcaacagaactcagggaagcctccccttcccaagtccttccaaacctgttgagccactaaatcctaaaaagaaagactctcccatgttataggaaggatggggcataatgtgactgtaaaggggcctgccatagaaaagtcacatgcctgagggagacactctgtcctcattccctgcccttcctttggttgccatatggaatggccatggaatgcacgaagtcacaatgcaccatccatgagaagacagtgaaatgatgtaatgacagagaaggcagacaacatgtttccgtgactcatctagtcagagcaattatgggaaacagctttggtcaacattctactttggaaagaattttgagtctagatgtggttaaattttgacttctgggaacttggttcagatgtccctttcactgtatgtcctctgacccctttggcaaggttgccacagctcccacagcccttcctacaagcacctatcattgggcttgtcacactctattgctcttctgtcccgaagatgcagtcttctctccaatgatactaccaagtcttagttttcctcaaccacactcaatctttttgctccaccctgaattcctcacacctaaccctgatagttacctaaagtgacacttaaatgtttcagagtgaatgcaaaaaagagagatgtacttggagtcggatatacaatttatccctaattaaagcatttaaaaggaattctttttgtggagattccttttttaaataaagaaataaataaaaggacaaaaacatctgacacatgtggcttaaaatctgagggagaatcactataaatagtgggccagagagtaatctattttcagtatagaacttaccagcttgtttatttcttcgaacagtaataatattaggtaacctatacatgccctgacatattgttttcttatacagatatttcttaatatagatacatttctctaagtcttattttccattaatttgcattatacaattagaaatgcatatctgcagaaaaaataagccaataagaaagcatatctatacttacagcaaattctctataaacttaaaaaagtcactaacattataaaacattactaacattactaaaataatgttagtaaattctgaagccaaaggaacaggcaaatctctaaactatgcaggggtgccgaaatatggaaatccaaatgtggaatccaaatggctctcatatccaaataagtcaaaggcaggtaacaaaatctaccagacccaggagtatggtgtcagaaacaagaaagcaaacactgatgaagcagcaacaggacatgggttggggaactcctaggtgatttcctagaatgtctcatcatctaggatgtggagcttgctttcatggaccagccggggcatgatcataggtggtttagcccatttaaagggtcaatggcaatcagagcactcctgaagtgggaaatatttctcattatcactgtgttggcccacacccattccagtgtattggttattggaattaagatggcaccgagggttgttggtcacttttcacaccatatatgacggttcctgatctcaggatagcaaattttggcatgtgtaatgaagaagaaggtagagtcatgctgggtcaggcataacagaagccaaaagcagaacaagcagaagtgaacaccagggtaaaaatggcttttatgactcttcatacttccttataacactggttttttgtcaaaggcagattttgcttgcatatctggggagtgcctatggtatctcctattgtttggtttcctctgatgtctggcacaggtcaatatttaaatttctcattggcatgccagagggctttcaggtctgcttgctggcatgcgttgtctttcaaattaaccaactgttgcagttggtgggcttgataagaaggaaatcatagcgataagttgctataaaactgtgtttaggtgaaagagtatagtggatagtcaaaggtaaaattcttcagaaactggctaggtgagctgacccaggtgctgcattccaactggttactaattgtgaaatgatggctggaggacaagctggagagtacaatctaaaaccatgatatgttctaggaatagttttttttttcctgataatttaatattaatagagtggcaataagctgataaacagggataagatgttccagtttggcattggagcctgccatgaccaaaatgacatgcccctgagagtgggagaagtctatggcacactctatgacaatggtgttccagggcatttggagctgacagtgatgtggcattggtgtattcagacctgaatttattatgcaagcagctagcttaagggctggtatactgcagattgttgggctcaaaatcatcagaaatgtggaggctttgaaggccttccttagaaattcaagggccaccatggctcaccagtggtgttatggtgcaatgggcgctctgcagtttggactctcctatctagaaggctcagcaggtcattctgccaatacacctgcattccacatccttggggaccatgtctggatggctctgagtaagtatgcatctccttgatggactgttcctggccactacaatgttctttggcagagagtctattggaattatgaggttccaataattctggcttttgcacggtagctgagctgagcattaagtaaaggacatggaagcc

SEQ ID NO: 12755 - DNA, 97221 bp, Human
  misc_feature (1)...(97221): n = A,T,C or G
atttttggtatttgttaaaagaatgggctggatgtattcttcttgttccaagaatcagcaagtgcactttaatatttttatttatgcccgtaagcctcaagatagggatgctgctctgtgaccatttttcatttccacattttgctttctgtgtgggcatctccaaatgagcctgcctttctggttaaatattctgtctttgcttttgctcttttttctctgtgacttcttgtttgtttctttctgcatggctctcctttggtctctgtcactctccattatttattttgtcctcccacattttccctcatcattcatgataaaataggaggaatagtttatagtgtgttattttgctatatttcttaaacatttgggttacatcattgtgtatcttttctgctgctggttcagagtgtggctttcccaggtgttgaccaggacaggtctgacttggttcttattgtgtagctatgctgggctagcatgtaggaataaggtatatggcactagattctgcttcaagagcaggctgtttaacatatccctcatgcctatgacgaacaactgcatttcctccagacgtaactaacggtgaggaagcctctttccccagctctgttggggtgacccttctagcagacagctgctcatcatacccagggtgtagcatgttaagctacaggcctccctttacttttgttttaccagccttcacaatataaatgtcattgtttcattatctgtcaagagaaaaccagttatttgacaacctgtatttttctacatttagcaactggcatttacacattaggttttcccatataacagcacatcccttaaccatggtagttaaaataatcttgaataggtacggttacacttaattatgaattttatgctgtagttgatggaagcttgttacacatttatgtttataagacttgtttgtggctgaatgtcaatgcttaaaagttagcatttttttgtttattttaagaaaaggtctaacatgttttttttttcttgtaataaaattcattttaacattgccaccaccattcaagcagtaataccaagattgactgcttggatgctgtttaattcatgtgtgtgccatgtaggtaaaaagcatgttgtgaatatgcattacctacagaatatgaaaaggatgcatgagatctagctgtgttattttttagaaccacatgtgaatctacagtgacctcaaaataggaatttaattattaaaaacataatgggatgttatatgaatattttgatgaaacactatttcctccccacactttttttttatgtttcttatttttttagtctcatttattactagttcatttgttcattcattcaataaatgattattgagcacttgatacatgcttaatttggtttagctattgaggtcaaatcaattattccaaaaccatcaccagattataattgtttgatatcacataaaggatgtcatcttattttgttatttaggagtaagttttgcagcacaagcgttttccagcttttctatgggtgcatttaagggccttggtaacattagttttaaaatattttaaaaatttcttccagggtaaaattatcatggcgatgcttcatggtgtagaactgatgggccttgattacacattcatccgcgtgtaggaacaggaaacaatttagaatcagggctctgccgtggccactcatctgtgaagagcagagtgaatttctgtgcaggcagatatcctggaggcccctgagttttcccaagaagacagcattctttctcccagttcagttttggactcacttggcaacacagaacatgctctctgaaacttttcagagcatggacctttaagctcaaggcagcctccaagctgggtgtagagaaaccacgagctgcttatggcagacagcctggagagcagtcagtcagtcctgtggttgggtgaaagttggcctctgaattagctggagcattggaggggctcttggttactctctgtcattccagtccccagaatggctttcactgaattgtgctttggcataatattaggggtgtcagcatctaatgaataaaatgtgggggtgtattcagtagctggaagtaaaatctgacattaggactgaagggggggatttggtttttattagtggaaaagttggggatggggccaaggcaataaagccacccctggctttagctgtacttcctctcctttgagcctttctggagaactccttgcagaccttttgattgtgatttgaatagtgaattgaggttgaggaacaagagtaaaacccttttctgtgctttgaactttgtagaacttgattgcatgttccagttagttatattgagtcattgaagggatttttccgtagaagtaatgttataaatgggctaggctcaggcagacttgccagagtttatttaatctagcatgtgtccgaaccatactattctggtaataatagttccttacaaaatgtagctctcactaatttattacattggttctgttggaagatgaatctctggtttctcccggggatgatgtttgttttttctgtttggctgctatggccaaagtggatgcagtagccgcaggttccaaagggtcttgggcaggaggtcagggttctttggtgattctgtgctgatcctgaactttggggaaaaagtccctaatggcagtcagtactatccaggttgctgagaaaggaaagggaatgcctcaggccctggctggagcagcctctcagatacaaaggagaatagtctcgggtggtccgtgtgtggaaatgcgtagaaacaatggtagcatgagactgttaggttgaaaaaggctaatgatatgaaatctggcatacaagtgagtagtgtcatttttgttacgactgttatttctttgtcaatagatcacaaatttagtgttaacatctcatctaatttttgtttcttgtagtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtggtgagtgtcctcaaggagaggaaaagtcatcctgagattcaaagagaaagtgagtgagtgtcctcaaggagtagaaaagtcatcctctatgaataaatcgctattgtgagttttctaggcctttttttttttttaacctgaatgatgttgagacaatgttacgagaagtcaacctttatgtattgcttttgaagttactttgaaaaccacaaagctcgactgcagaagtctcttcaagggaaagggaaactgaaaattattataataatcttacatgttgcaactcagaaaagcaaaacagaaactagatgggggaacttagacatatttagaaaaagaaaaatttcctttaccttatatagtatttttaaatacttaggctaataccttcatactaattgtaaatggaataggttggtataatcaagaacacacacacacacacacacacacacacacacacacacacatttttgagtcggagtctcgctttgctgtccaggctggagtacagcggtgtgatcttggctcactgcaacctccgcctcccaggttcaagcgattctcctgcctcagcctcccaagtgcctgggattacaggcacatgcaaccatgcccccctaattttttgtatttttagtagagacggggtttcaccttgttggctaggctggtctcgaactcctgacctcaagtgatccaccggcttcggcctcggcctcccaaagttctgggattacaggtgtagagccaccgcacctggccatatttttttttttaaaggaaattaattaatgccacattttgtttgttttgacaaagctgtaaaaacttttgtaatctaaattctgttgttgataccaggacttgtccccatatttgaccgaaatgctaaccaacagaccataggctggttgacttttgtttgttttagggaagattcattcaggaagaagatatttgtgtaggtttttcttatcctcttcaggttatggagcagctggaagttttgctagtatatctgatgtcaatcaaattagaaaacagagctagtaataacacttggcaggtacacagatttctctttctattcttgcctcgcagtatctacttaaataacatagaaaggctttgtcaacattttaaagcacaacaaaagagcctcaccattttctggcacagacctaaaagtatgtggtagaggaccactggtgtaagtcgaaaacatttattttcagctttttgctattttatatagctgagctttaaatagaaatttccctctatttaattaaacttaaatgttattttgagagtgaaagaaaatggatttcacaaaactagatattctttttctttttttcctccaggaaaaacatctcatttctaggtattacaaaatcagtttccactggagaaccacatttcagggtagcagggcttgtgtggtctggcctctgttcagagtcaccctttagaaagcaaaagcagttgcagtttacttagggacttagaaactttccattgcaaaacagtgttatttagccatagtttaggttctctgaaattttttctttctttgtggtaacaccaatagtactttcagactggacctgttctgggggaattggcaacaaactgaaatttcccattagttgtgtatggatctattgtaaaactgctgataaggtatcatcatcattattttttttttttgctgagattgttttttatcacattggatcagtgtctggcctttcaaaatggaacctgaaggcagatgtatttataagcatgtatgcatctgtaaatggtgaccaagtagataaaacaccttttcctgcttgctgtgtgcctctaatttaggaaataatacaattcctgtgcaaaagctacacaatcgttgtgttactatcttgtcaaaacgttgcatttttaataggaatgtactcatgagacacaggaaaagagaatttttttcctcctactcccttagtatctcagaaacccaaagaatatgtttgggaggaaatttggccatttgatttaccaaaacagctttcctgtgagaaaactgaaaaactgtgagagtaaaactgaaatcatgcctactttgagatacactggcaatttgcattaactatttgtcttattttaagtcagtttgggttagggaaagctggccattgatgtgaaagtaagaccccaaattttcaaatacgggtgtacctatgaagtgaatttgaaatcatgaccaccttaaaaccactgtttagagagatgtagtataataattttcccactgccattgatacgtaattgtttggtagaacagcagtactcccagtaaatttagtaacttaggagtttacttttagaaggtaaatgtgtacttgatattttaaaatttattgatatcagaaaaagctgattacttgattatttataaaagtttttttttcttttttctgggttttttttttttttttttttttttttttttttttttttttgagatggagtctcgctttgtcgcccaagctggagtgcagtggggcgatctctgctcactgcaacttccgcctccctgattcaagcgtttctcctgcctcagcctcccgagtagctgggattataggcgcgtgctaccacgcctggctgctttttgtgtttttagtagagatggggtttctccatgttggctaggattacctgatctcaggtaatccacccgccttggcctcccaaagtgctgggattacaggtgtgagccaccacgcctggtcagattatttatcaaagttaaataacccagtgtattaaaactattttcattgctgataacagaaatttaccctctactagcttaggcaaaaaagcttgctgtcagaattccctttttctttccccacctctgctctctgcttccacttctgttttctctctaatgtaaaatggccaccaatacctccaggctcacaatctgttaactcatcaatcccagtggagagagagcttcctacagaagtatcagtatttagtctccctgtcaaaggaacggacatatctctgggaccagtttctgtagctgggaaagagatatatttattggcttggataacagcccacctctactccctaaagccacaccagaaatacaggttgagtatcccttatctgaaatgcttgggaccagagcattttggatttcatttttttcattttttggaatatttacactatacttactggttgagcatcccaaatctgaaaatctgacgtctgaagtgctccagtgagcattatctttgagtgtcatgtaaatgctcaagaagtttcagatttttgagcatttttagatttcagatttttggatttgagacactcagcttgtatatgatttgaaacaggatgaatagactcccaaaagacatttgagatattcttacccaaagagtggtaagctagttcaaaagtctagtacatcgactgtttctcagagataccagtttcatttcagcatcttagtcctatattatgttcagcacaattaagccacagtgtaagaagtaagactatatggaaatgaggggttatttttaaaactgttttactagaatttcatacatcaaattagtgtcctttttaaaataatcacgttggtgggaagaatttgttccaacttggtgttctctcaaaatatttttaaaacctttgtgttgttgttgcctgaagagttcacagcatattcttttaagtattgccaatattagcataatttgatgttaggtttaatttttggaaagaccaaactccatttaaagtcacacaaagatgatacgtagtcacattgagaaatgtcatacttgatctctaaaagtaagggctgtgaagtgttaatttttctgagatagtgtatgaatagtttagagtctgaatttgcatgttaaagaagcattcttctattttcccagctacactgtttaaatggatagcctccaaaaatgaaattagttgctcagattgtcccagtttgactgttagtgtatgtccttcaagttgagttcctttgaaatgctcccatcagtttttgaacccttccttcctggtaccagaaggtgttccagaagaagctactttccctgcctcagctctggcattaattattttacgccagttccttttattgaagaatagtatttacgaacaaagatctgcttattaggcgtgctcgtaactcctgaggtatcattgcttctaggcagcccaagctggcagagccaggaaatgggtggatgtgtgcacgtgtacacacacacacacacacacacacacccctgcatctatatatgaaaatcatgagggcacacgggttcctccaattcccatccaccatcgcaggcttctttccccctccttatttataatttttttctctttcaacaggaaacatggttctgattatcgtcagtatatctgcttagttactcaatcctaggaaacacaaaatagtttcagaattgctaactcaaatctctgtgaatgtattaactactgcacaatgtttgtttggagtaacatatcaaatatgtctttagacttataatacaagtcaaaatactgtttccaaggtaaggttagttccattcttcctcacttcagtgtggttatgttattcatacataggaggtttttttgtttgtttttgttttgttttgtttgtttttctttttgagagagtttcgcttttgttgcccaggctggagtgcaatggcgtgatctcggctcactgcaacctccgcctcctgggttcaagcgattctcctgcctcagcctcccgagtagctgggattacaggcgggcgccaccatgcccagccgattttgtatttttggtagaggcggggtttcaccatgttggtcaggttggtctcgaactcttgacctcaggtgacctgcccaccttggtctcccaaagtactgggattacaagcatgagccactgcacccggcccatacataggagttttataacaagcattttgacaaaatatgttgataaggtttggatgtcccctccaagtctcatgttgaaatgtgaactccagtgttagaggtgagcctggtgggaggtgtttggatcatgggggcagatccctcatggatggcttagcaccatccacttggggatgaatgagtttttgctgagttgacaagatccaattgttttaaaagtgtgtggcacctttgtgtggcacccccagtctcttgcacctgctctcactatgtgacgtgtctgcccccacttcgcctttcaccgtgagtaaaggtttcctgagtcctccccagaaaccaagcagatgccaacgccgtgcttgtacagcctgcagaaccatgagccagttaaacctcttttctttataaattgcccagccttgtgtatttctttatagcaaacacaaaaatggcccaacgcatatgtctacctgaatttttttttgacatgatattacttatcccatcgtttcacctggttcttgggaaaatggaaccgccatcatcagtgaccaatcacagcactgattgtcacctgttacttacgtagtgatctgtgggcagaagagctgtcggtgaagttgtacttgatgcagttgctcacagctcacatactgaggttcctgaaacttgtgtgtatctgaaccgtgtgaggtgaggcctgcctgtgccataacttggaaagtgtgcaaatgtttgacaataatatttcccccattttaaatttgaaaaataattttaaaatttttatatgttgtaaaaatagatggtgaaacactttctttcaattcctggttgtccatctctccctctgccagctccatttggcttcttaggggttgggtaggggcaagtagcagtgtttctcagaggctgtagttctaggaacctcaaaactatgctaagtttgacttgagaactcagagttctggtttagtttaacttgaaggaaagactccttgaacattaagtcatactttgtttctcccatagattgatatagaaatcaacggcagtgcagtggatcttcacatgaagttgggtgataacggagaagctttctttgttgaggagactgaagaagaatatgtaagtttgcatgggttacaccctccttacacagtgtgctcaggcctctggtacgtggcccagacggaccgtttagcagttttttatggttgattgtacagaggactgttgttggcaagacaagctttagtttcatgttgaagaactaagctgtcaaaaaggaactgaagggatgaggaatttttctccatacaaagtttcagggtgcagggagcatgctgaatgcacatacttgcactttttctaagggaaggcacatcactttctagctttaatgagctttcttacttagtgttgcttctggttcacatattgacttgaatacattcagttctgcctgagtagggcatttctcttctggctatgtgtttatccacatgtgccctttggactgggactcatgtttaccattttggttgggatattacatccctcaccttgagtagtcaggtgaattaatttattatgatctcaagagagttaaattaattggcctatatccttttataagtgattacatgtttgacttcttctagcaaacgagcatgatttgttaaaatcccccctccccagcacacacattctgtatgtactgatttgaacgctagttaacgacggattcttgatggattcaatgtggatctttttatttatttatttattaataatagattttacattctcactaaagaactcagatcacgtaatgtgaatctttttaaaaattctttcaaaggcatcagtacatcattcttcataaagaataaagtctcaaatagcaaaactgataagcatcaagttattaaggatacaggactacttttttggctttgaagatgaacttacagtttgatacaataaatttacaaagaaaattattaccaaaaaatacgatagcaaaatgagattgtttatcattttttgattgagaaaccaacaacttaggtaccagtaggtaaagcagcattgaaacactatgatttatgaaggggaagcttgatcagactggtgctttttctagtttcttcattacttatctttgtaataccttgtttgcatttacttggcctaagcaacatttttccttatcagagacagaggcaaagagcagaatgaaacataataaatgacatctgtcaaaaaaaaaaaccactttttgtatgtttcttaaaattatttataattcataacactgaacttctagatcagcaggcaccgtaagcgagaggactgggttattgatgttaacctcgttttcatggcttattctgacagttccgctaaaaattatgctcagcaaggacaacttggaaaatgtcaactttccagcctttttctccctattccacatatgactacattgaccagagtttatcttgtgtagtatgcttctccttaaaataaaaaattgttaatttatccaacaaatgttggaattactactctatgccacatgctatgaatacaacatgcctctgttcctctaggggttcgtcatttagagtaggataaaaatgaccaaaaacccagtttgttgccatttatttgctttttttctctcagatttttctcatttaattatatgtcatcaacattcttttcaagtctagttctaaacctaactctgtgcttttaatagctgcacagtattccatagtatggacataccatagtttgtttaaccattttcttgctggtaggcattcaggttatcttcatcctacaaacattgctataatagaactaagaaataccaccagaaacaaaaagagctttcagtaagtaaaataaagatcattgaattaaaaatcctcaaagtcagagaccacgacctctcatctgggtttcttttggacattcagaatatcttattacaatttctctgtaagtgtgtgtttctggtgaacacagatttctcctagctaaatcaaactttagcttcagggtaatatgtttatcaaagctaagttcaaaagcttaataaaaaaataattacagaaacctatacattttcagaactattgtttaaaagcttgagtattttaaattatatgaggttaatttttttgttgtttgttttgagatggagtctcgctctgttgcccaggctggagtgcagtggcatgatctcggctcactacaacctccccctcaggtccaagcaattcttctgcctcagcctcctgagtagctgggattacaggcatgcatcaccaggcccagctaattttgtatttttagtagagacagggtttcaccatgttagccaggctggtctcaaactcctgacctcaggtgatccgcctgcctctgcctcccaaagtgctgggattgcaggcgtgagccaccacgttctgcctgaagttaatttttatctctattatgtaccttccatttcctctgatgatacaaaaaggaatgaaacaaatggctaagacatgaatttactgaacaccagacttgatcgtttatttagtattaggagtttgactgcttctaaatattgggccttattttcttcttttgaattcctacaggaaggaatatttcttatttttaaacataaatgctttatggtttaaaaatttactaatgtcatttgttacacggtattgtctctaattgcctttctccaattaatttggcaaaacataagcattggccgctctgtatcactgcatcctcgcgtcactcacctgtcctgctgccctttgtctgatgtagtgtccttaatctctgccttctgctttttcctgttctgaatgttctgtgtgagttcttgagagagtcctttgtaacacctcctgagatttttgttgctgctttgatctttgctttgtgaagaatttaataggcttagctttaattatggctttggggtgttccatgctgacttggcatgtcagttccttcagatggactcagttacatgtacccaagtgggctggtacttagctgcctcacaggggaaagacctcgtcagagtatagtaggcagtgccttagttcagtgggactttcttgcctttagggaatatgtattttttttttttaccatggtgaaaatttatatattcaaaatattactgctttaattcactgtcgagtttgtcatggataacttttctttctccattctcctcaaggaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacggtaggactctcagcctgggaagggtcttgtgcgggtacctagagttcatgtgaagccaggagctgccagtttttttatggatacacagtgtgaggtttgggcttgttttccccctttacagtttattgtggaatcaagcagcaaaggcagtttctttgttcctttcaactattctataaatatgctactgaaatgtcatttgtagcagactggttgtgtttcttttcataaagaagtttccaggagccaaataagttctaagtcaaaagatctgaattagtgatttgcccctcggtgagcagatccagttggacaccatgtcatctctgggatttccctacccagtggccttaggcttggtatgtttttcctgaggagttgagttttgttttattggaattgaaaaggaatgatttttatttttttacatgagcagtcttgatcgctgcttatttacctgctctgtagaagagctcattatatgccatttttcatgtcagcaccgcttggggttgaaaggtagcagttgggagtagaacacgttttcttattcaagattccgttttcttccacctgttgcactcagtggccaccttggcactaggaccgtggtggggattctctttattggtgacgactggacaagaagctgctgcccatgagtggccctgcatttccagactctttatttgtggcgggagctgctggtccacttgtgtgttttcaccccatctgtcgaaaagaggtcacaccctacttcctggaaaacagtgatgttcaagtgtttttcatcctagaatagagggaaataatttctttcactagctatggaaaccaaatatatatcaagagtaaaccctagctcaatctggtatgtgttttatttgccaatcttttgttttaaatggtcaaaccaggaaaaaaatatgctttgttttgttttgttttttaattgagacaggttctccctgtgttgcccaggctggagtgcagtggtgcaatcatagctcactgtaacattgaactcccgaactcaagcagtcctcccacctcagcctcccaagtagctaggactgtatgtgcttacccctacacccagctagtttttaaaaattttctgtagagttgaggtcttgctatgttgcccaggctggtctcaaattcctggcctcaagcaactctcccgcctcagcctcccaaagtgctaagattacaggcatgaaccactgagcccagcaaaaagtgttaattaatgtagtattagtatattataattatactgcattaatgaataacatagtataatccttttttgtaaaacaattcattttctaaaattttgaaatctagattttaaatcttagaattaaacatctatatttgatagtaattttttacaattcgatattataagtaacatagccatttttaatacatgaaatttttttctactcctcttgttttattgctcactagctgtcatgtctgtggtgttctgtcttactcctcccacgctgaatatgtaacactttgatttcagttctgatagaatgcagaatttctccaatagaactaaacaacaaaagatggaaagcaatagtggaaaagtatgttaagctctacaaaccagagtacactatatttacaaaattttaaaatcctgaatgaatcaataaatttaggtaattttttttgtcagtgtcaaaatactagctgagaagagtttcatcataaatgttctgaactctacttttaaatatcattgattcccaaagaaatttaagctgataaaaagtaccagaatttcttaaaaagagactcttcctgtccttttccttccttcattcagtcttttaaaggttatttgtccttctcttcactaggagaataaagtatgagaatttttacttttctactgcttgacttcaggaatattaaaaacattattaaaaggccgggcacggtagcccatgcctgtaatcccagcactttgggaggccaaggcgggaggatcacctgaggtcaggagttggagaccagcctggccaacatggtgaaactccatctctactaaaaatacagaaattagctgggtgtggtggcaggctaattactcaggaggctgaggcaggagaatcacttgaacctgggaggcggaggttacagtgagccaagatcacaccactgccctccagcccaggtgacagagcaagactctgtctttaaaaaaaaaaaaaaaattataaacaatttcctttaaaagttttgtcttatgcatactaaaatgtgtaggtgggcaagaaacgtattcttttgagaaaaacttgaaatgcttacacatcttaagttttattaggatcagccttgtaatgctcccagaagtgcttcgttcctgaaaatatttttaccaactaaaattcctccaagatctaccaaaaagagcactgaagtaatgcttttgtcttagaattttgttgacctgtgtcctttgtcagacataatagagcaacatttagaattcctgaacaacctacagcttgggaaattaaaacaatttctaaaacatatgccaagttccctactaaattgtacaagaatcattattctaaaggaatttgcaaacgaatgttgtaagccaattgcagaaatattagtacataccttgtttttcctgatggtgtgaaaggctgtatccactgtgtactgatgtgtttgacaggtatgaatggctgccagcctatctctaagccagcagcttgctggcttggtaagcaggcatgtcacaacacacgtaagctagggccttgcagtcgttttcaggaggttggtgttttgctttttctttaggttaccatggaataattgatgctgccacctggaggagctcttccatgaaatttccttaaaatagaatctgcttaaataatatagccaacagaaattaggactttaaaaaaagaaaacaaaatgtaaacatctgtgaaaattcaggttgttttctgaaataagcactgagctaaaaggtagacagactgggcccattatagattgtagaacagtagcctcttcatcgctcagggcgttggtttcttaatctataaagtgagagggtcgaaggggcctttaaaaggcccctttcagctcagcacctagactctgacattatttgagggaagctatttacggtcattaacagcatatgaaacaacgtgttcaaaatctaagagaaaaagaaaaggaaatcaattgcttttgcagttgtgaggactaggaattacgtggcgttgcggaatttgcagctttcctatagcatattctcctcagctcctaccacttagaaaagaaattatttttccagagaagataaatgcataaaataggtttctgttttgttttgacaaatggcatttcgtttaaattctttacttttcaagaattttgttgataatagaattaaggttaattgaggctccttgaaggaggcagatggaagagggaatcattctttaaagcagattgctatagcacagctggaagaaactcatttctggaaatcggagagctttaaactatacacggctttaaaaaactgtacctagtaagtctccctcccttcctaaagatgggcgttgggcttaaatataacatagaagccttgtttgtccttctagaggatggatggatgtctttgtgtgagagagagattaaaaacattgcacctaggcatatgtagcctttggagggaagagactctgcatattggatggtgttctagcataatcttgagtgcaaatatatgaaacatgccaccgatggaaatatttcaaatacccagcaatagcaaaaatggaggctcaatatcacaccatcagaaaggagtctcaacttttaatccactaaagcagacttacttaaaagtgatatctgggagctaaatccagggagcctaagacttttcacagatagcacctactgctctgatgatctgcatacttcatctcctgatcggtaattggcttctagagaaccctccatgttcttctggggtgagtgtagacactcagggtgacatggatcttacagatgctccctgccttttctctccttcgtttctgacacagaacacagagagaagtattgcagggctccatatgtcttacgggaaatgctctgtatccaaatgccagctgagatcattagccacgctgaaattcgttgtctcgtactgtgctaaggttgctgctagacgttgttaacagagttagtggtctttggttatggtggttagcagccccacttatctgttccatactaccagtgaatagtttaaaattcatgttgcacctataatttatcccacataaataattcaggctatttattttggcattcaattgatttttttctcactttaaaaaactgaggtatggagactggtgctagcaacacgggattggctaacgcatcctcttgctgttcccggtgtttgggccttgcctgtgacagtgggaaaaaaaatggccttgctgtgctacaaccggagctgcggtcagcgcttcgatcctgagaccaattccgacgatgcttgcacatatcacccaggcgttccagtctttcacgatgcattaaagggttggtcttgctgtaagagaagaacaactgatttttctgatttcttaagcattgtaggctgtacaaaaggtagacataatagtgagaagccacctgagccagtcaaacctgaggtcaagactactgagaagaaggaactatctgaattaaaaccaaaatttcaggaacacattcaagcccctaagacagtagacgcgataaaaagaccaagcccagatgaaccaatgacaaatttggaattaaaaatatctgcctccctaaaacaagcacttgataaacttaaactgtcatcagggaatgaagaaaataagaaaagaagacaatgatgaaattaagattgggacctcatgtaagaatggagggtgttcaaagacatatcggggtctagagagtctagaagaagtctgtgtatatcattctggagtacctattttccatgaggggacgaaatactggagctgttgtagaagaaaaacttctgattttaatacattcttagaccaagagggctgtacaaaagagaaacatgtggactaaaaaagatgctgggaaaaaagttgttccatgtagacatgactggcatcagactggaggtgaagttaccatttcagtataggctaaaaattcacttccagaacttagtcgagtagaagcaaatagcacattgttagatgcgcatattgtatttgaaggagagaaggaatttgatcaaaatgtgaaattatggggtgtgattgatgtaaagcgaagttattaactatgactgcaacaaagattgaaatcactatgagaaaagctgaaccgatgcagtgggcaagccttgaactgcctgcagctaaaaagcaggaaaaacaaaaagacgacacagcagattgagtgggagatgggaggaaggctattacgtatttcagaatttttaatactgtgtgaagtggtggcttgctgctgtcatcttttgttttgttgttgtgttactgaatgtggcatttcagggttaacattaggttcttaaaagccaaagtcagtttatctttttgtgcctctcatctttctttcgtgttatgtaagattgattattcgtttctccctactggtaggaaccatagttgtgtcctgtacttgaagaggctgaaaaatagcccataaccataattgcagtatttctttgtatttctctgttaagcaaagaaatattaaggaactttttttatgtctttgtattattccataattagtaaagctaattgtgaatgtccaattttaatgaaatgtccaattttaatcagtttttttcatggatttgtgttcttacggtacttgaaaatatttaaggaagagatgaagctctgcagttttttctatgtgggatgattgcttttttaaggaggattaattctgaggtagtatagtaagtaaaggggaatatatgaattgttaacaaattaggatttgtttacaactacttgaatttttaaattatgtcaaaacttacattacttgccaagcagtatgatgtaagagtataggaaacataaataagaatacagaggtatcaatttgattaaaattcaccattttataagactaagcaataatcttaaaaacctctttcctgaatatttaaatgtgtttgtatggtgttatgactaattgttactgatttacagactaagccctcttaaaacctttagttaaatataaaaagaaattatatatatcttgcctccctgatggaaaactatgtaaaattgtagacttaaaaggtttgtggaggccgggcgcggtggctcatgcctgtaatcccagcactttgggaggccgaggcgggcagatcacgaggtcaggagatcgagaccatcctggttaacacggtgaaaccccgtctctactagaaatacaaaaattagctgggcgtagtggtgggtgcctgtagtcccagctactcaggaggctgaggcaggagaatggcgtgaacctaagaggcggagctggcagtgagctgagattgcgccactgcactccagcctgggcgacagagccagactccgactcaaaaaaaaaaaaaaaaaaaaaaaaaaaaaaaaaaagttggggggaaaaatttatgtttttccaaaaaccnnnnnnnnnnnnnnnnnnnngtttgtggaggccgggcgcggtggctcatgcctgtaatcccagcactttgggaggccgaggcgggcagatcacgaggtcaggagatcgagaccatcctggctaacacggtgaaaccccgtctctactagaaatacaaaaattagctgggcgtagtggtgggtgcctgtagtcccagctactcaggaggttgaggcaggagaatggcgtgaacctaaaaggcggagctggcagtgagctgagattgcgcccctgcactccagcctgggcgacagagccagactccgactcaaaaaaaaaaaaaaaaaaaaaaaaaaaaaaaaaaaaagtttgtggaaatacattaggatatcagaaaactaaatatatggagttgctttatgactattacatgttaaataaaatagcttgttttggagtttttttttttaaagtcatgaagagcttcacaattctagtgatacagtgttgattatatattgtgctttatttattttaaatataggtaacacagaattagatcgtttggataggttttgatgcagtgcagagcttaagaagaaaaattaggaaatattctgaaggccagaactctggaagaacttagaaagtttgggaataaattaaacttacatagatttaaaattaaaaggggtttatttcccaaaccccttgagtcttttcttttccttggcatttgcggaattcttacaaagaaaaatttacagaagtactattttcgttaataaagcatatatatcattctactaccattagcaaataacttagttgtagttaatataattgttaaaaggtttagctctgttacaaataaaaacaaaaagatctggcaaccagactcatgatgttacactaccatgacaagaaactctgggcagtgaaagttggacccacatggagtacataaacatctgatactgggagatgtatttaaaatttttcaagttatattccatgatttaggaaccatttagagacatgaagtctttatgggttgggggaaaggttgatacttagtttgattaaaggtaatgattaatatgcctttttgttaatacttctttctgaggctgtcttcccctaaacagtatcttaatctgttaaatgtaattgaaatattatttgaagcagtgagttattgtaacctcagattagttacattgatcaaaacattgatttatacacacacacacacacacacacacacacacgcagcttttatatttagtctggttacattagtgaccatggtatttcctttcttacttcttaaggagcctttgaatttcttgtccagataaaaatctgaataatatttatcttagactcatacataaagggacacagttaccgttaggtagcatatgttttactatcggtttgtcaaaaaagttaataaaaaatgcttattgatttgtttctctaaaaaacaaaacaaaacaaaaaaaaaactgaggtataatttacatacagcaatattcacagaccgtaagtgtgcagttcagtgcattttggcagtcatatacatccatgtaacctccgttagcttttgaattggaaaaatgttaggcttagaaaatgatgcggaatttgaaagatgtgatgttgtagcacatctgtgagggctggagtgccctgttcacactggctgtgaacctcagcctccgagcccccagccctgactgaaagtcaccgtttacatcttttgctcagttctgatgtattagcaaaacagaatcagtgcttgtgctgttttcttcacattctactgtgtacgctccactatagcctcacgtcacgtgcttagtttgttactctgtcatggtttgccttgcaggtccctgttctaaggcatacctgccattttgaaagttcctaaaaggtttctggaatttctattttaataaaggaatcttaggactgaaagggatctcagcataaatcttttctgtcactgtagtgggcctagactaatgggctgtatttttgtcaggatatgaccaaaaaaggccacctcttgtcttcctggggctgtgaattcaggtggtacctgatcgctttttcaatattttactaaatcctgtttgctttgctgaattcttcttggcttaccttttatactgcagtgaaatatgtcccaaaagtaaaatatttgtaatataaaaattccggttagaaatttgtgtgacttttacattgttcttttcagaccactttcacgtatggatagtgatgggtcaagctgatgtgtcctttcagagtgggcaaataaagaccattcacaaacctgattttccctttctcaggggaaaatttgccttttgatattcctttattgagaaatagagtactttttcctagatgtctttctcaggtatatgttttctccccttcaatgagtggtatgccagagtaaggccctagagaaagaagaccagagttaggaaaaccttaaattaaaagattaagctatgtggaaaaactattacatgtcagagttagtggtaaataagagtatgttaagttaagatataaaggaagaagagtaatattaaaaaagaacctggttttctatccctgtgtttagtccagcaaactaagtgatgtggatattctcatttacatttattatctgtcctattagaacattgaattttctataagaagcctttaaacttgtataatatggcgctttatgctttgcagagttttgtttgtttttgggatggagtctctctctgtcacctaggctggagtgcagtggtgcgatctccgctcactgcaacctctgcctcctgggttcaagcagttctctgccttagcctcccaagtagctgggattacaggtgcccgccaccacacccggctaatttttgtatttttagtagagacagggtttcaccatcttggccaggctggtcttgaacccctgacctcgtgatccacccgcctcggccttccgaagtgctgggatgacaggcatgagccactgtacctggccagagtctttctttgtgcttttctttttacttttcagagatttcaacatgctacaccatgtaactctcacattgactctgaagtagacaggacaaatgataaatttccaagtaaagatgaaaacgggggcccacagtgcttctgagggatgttttcaaggttatatggcaaggtagttatagtaactgaaaatctgagaaaccaacaagtaaattgattaaaatcttatcagcagtagtgtaaccccctacccaaggtccttttatgaatcttaaaagcatttgtcatttttggtatcatcttcacatctccacatcttgtagattccaagtaaaggaaaccttctcagataatccttgggccaaacaaagaagaaaattagtcccaaggttttaagaggttagggtattgttaaaattttgagccatagatcttgtttgtcttcagctaatatacattttcaaatgtattcagtagaaaggggagagcagtggaaagaataagggcttacttgttttgaatccaactacttcctatctttttgactttgagcaagttactaaatttctctggatccttgattacttaaaatctacaatgaaatattacctcattttgtaaggattgaatgaaatagacataaagccttagttttcttttagcctttgaatcacccttaagggatggaaaaaagagaaatcacatttctcttttgtcctccccctatttattccatatgtgaatagtgattgtggtgttttatagtgggtggcattggtgtatccccccttctccttcatatattttagagagagttagtaatcatttgcccctcttcattttgattgtttgtagtatcagtaggtttgggggatattttaaagctgacaagaatgtcatcgttcctgcctttctttggtttctccttcacagaggatcttcaaatgcttccttgaaagaagaagaatgtaaagagcctttgctcttccattctggggatcattaccccttatctgatggagattggtcccctttagagacgtaagtatctttgaaatttcttggtttcttgaaagaggaaggagatgtattaattagcttttctgttaatctgtagtaatgatatttcccatttctctcacacagccaaggaactgaatgtttacttgtaacataaatatgaatcttttctctcaataattattttgtttctaaatttgatctgacttactctaacagtgttggccagttgtagatctgtataatcagcatggaatttagccatctacagttattttttttctttttctttttagtagagacaaggtctcgctctgttttcccagcctggagtgcagtggcacactcatagctcactgcagccttaaacccctgggctcgagtgatcctcccacctcagcctcctgagtgactgggactacaggcacgcaccactgtgctcagctaagttttaaattttttgtagagacagagtctcgctattttgcccaggctattcttgaactcctggcctcaggtgatcctctcgccttggcctcccaaagcactgggattacagacatgagacattgtgcccactcatctgcaattcttaaaaattctcatcttttagtgtcaactgttggctgtaaatgaataatatagtgaaaaaaagtatagtcataactgtttattctgcaatcagattctcaggtgttatgttaatttgcctgcttttcctttcctacaaaattatcttctttctcattgatttcttgtgaaaagcaaatgagattatgaatctacagtgtttgtttacaaaggacctggtaagtcctcttaaatactagttggtgtcatttttattattattattaaagaactcaagtggaagaaataattgatgctcccttccatagagtttttatatatgcaggataaagtcaagatattcagatttgtttcttttaatctgtcaggctcagcaagactgaaggtttcccgactttcaagtcatcgtgtgtctttgttctctttgcagcacctatccccagacagcgtgtcctaagagtgattcagagctggaggtgaaacctgcggagagcctgctcagatcagagtctcacatggagtggacgtggggcggattcccagagtccaccaaggtactagggtttacttgcctgtggaaagtgtgttaatgattaaacaagtgacgaattcctctgcccataagtaaaggaggcaatttctgactgagctctcatgaatgtaaatgatagtgccctcatgtcataaaagtaaattcaaagttaacattttttgtaacatttggactatatatttgcaaccgaaggatttcagtagtattttgtgtatatttctatttactgaataataatgattgttaattattataaggacattttaaaaggcatcttaaactgaaattttcacactgaatttttattttttattttttggagacagagttcttgctctgtcacccatgctggagagcagtggtgcagccacaactcactgcagccttaacctcctgtgctcaggtaattctcccacaccagactttcaagtagctgagactgcaggtgtgtgctaccacacccagttaattttttagtttttattttttgtagagacaaggtctcgctatatcagcttggcctgatcgcaaactcctgggctcaagagatcctcctgccttggcctcccagagtgctgggattacaggcgtgagctgccatccccagccaacactgaaattttaaacaagaaattgttaaacctttttttccagctcataatgaaagaagaaagaactgagaagataaatttcttgagagagaaaatgtttagatcttctgttgaatttaggtttttaaaatatacattttgcatatatttgtgatcgaatttagacttgccacttttacactgttttaacagagccttgatgtggtccaaggagggtgaaattttcatttagttttctcccccaaaatgagtattttctacttcttagtaactgaaaattgtcagtttcctcagtcttctccagtataacttcacagtagaacatttaacatacacctttttttttgagataaagtcttgctctgtcacctaggctggaatgcagtggtgccatctcggctcactgcaacctccatctcctgggttcaagaaattatcttgcctcagcctcccgagtagctgagattacaggcgcctgccaccatgcccggctaatttttgtatttttagtagagacagggtttcatcctgttggccaggctaatctcgaactcctgacctcaagtgatctgcccaccttggcctcccaaagtgctgggattataggcgtgagccactgtgcccggccagaacatttataagtatcatgatattgaacaaaaggcaattattagtttttctcactttattatggaatttttacatgtacaaactaagatacttaatgaatgtgttaagttaaaaatagaatgaacacattgccagcttaggaaatagattataacaaatactctgaaagtagtttaatttttaaacaatttaacttttttaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtaatcgtttgtttaatttggctccaggtactctcaaattagatggtaaattatttcagtgttccacataacgtgatggctgcctctgtatttgtattcaccagtcgaaacccgtcgcacttttttttttttttttttttttttttagctggagtttcgctcttgttacccaggctggagtgcaattgtgtgatctcggctaactgcaacttccgcctcccgggttcaagcaattctcctgcctcagccttctgagtagctggggttacaggcacacaccaccatccccggctgattttttgtatttttaatagagatggcatttcaccatgttggccaggctggtctcaaactcctgacctcaggtgatctgcccacctcggcctcccaaagtgctgggattacaggtgtgagccaccgtgcccaggcccgtcactcactttcttacaattgctttccatggcgtccccctggaaagtccagttggagcagggcctgacttgcacactgctgtctcttgactgttgctactcagtgggttcttgagaagcatttactgagaaaacaaataatgagttgtaatcaattgatgagtaaaattaaccactttattgataaggtatgtcagtaaagtgaagtagaatcttaaaaaattagaatagagaaaaaatgttttcacttgaaacatcttagctgaggctaaattaggtaggttttttagcagtaatatcagataaaaatcaatgcatactaattatgattatgagtatgtgctttcttttgctgattatttccctctaaaataggtagaaggctaggtgcagtggctcacacctgtaatcccagtacttaggaagctgaggtggacagatcacttgagctcaggatttcgagatcagcctgggcaacatagtgaaaccctgtctctatcaaacataaaaaactgagcctggcatggtggcgttcatctgtggtcccagctacttgggaggctgaggtgggaagatcgcttgagccctggggcagaggttgcaatgagccaagatgaagccactccattccagcctgggtgatagagtgagaccctgtctcaaaaataataagaaaaaataaaaattaccttaagaagttattctaatcacctgagcccagggaggtcacgactgcagtgagctgtgattgcaccactgcactctaacccatgtgacagagtgagaccctgtctcaaaataagtagagaaaacatccaactcttggttcaacagttcttcctcacttttggaacacaagtttaataaatcagaacatccttactatttgaaaataaaaagccaaccatcgatacttggtacagtgggtcagaacatacatattctgaactctggccttggatcctatttttaggaaagtgtgaaaccttctctaaaattacccaacatcatatatagccaattacctatttcaattaaaaaaaaattctagcaccaaagattaggtaattataaaccaacttaatatatattaggtatggaccttcaagttcactcagaaataatttatctaaaatgaaagaatgtgactgtcgaaggtgttggtggtcagataaaaccatctagcgaatggtggcttaacttggcacctgctcttccaccgaaggcctgtagccacttgttatgctctaagaaatgttaaggggggaaatccagttcttttaggatgaatgctttgtttttggaactaatgactcctgttcttagcacacagtgcaggatctgactagagacaggaaccctgagtggtttttactattcttttggcctcattctttttcccctctactttttattatacatttttgccctccctctctcctcaacccctctctccctacatctctccattcatccacatacagtgttttattaataaaacatttgaaaacaaattgcaggcatgacatttcactcttagatatgccaggatataccttctaagaatgtgaacattctctgcatagccccagtactattgtcatcttgaagaattcatgtttacatttccctaattgtaccaagaatatttttttagctggcctgtttcccaagccaaaattgcatcaggtttcacatgttgcatttgatttttatgtttcttgtaatcttttttattttagaactctctctcctacacccatccacaccctcatgccctctctacacccgtgatagtaaccttttaaagagctcagccagtgtcttctaggctctctcacgttctggatttgtctgattgtttttttgaaggtgacattcctatattttcttaactgggagttagctctagaacttactgtccactagaaatggaatatgaatcacatgtgtaattttgaatcatctcattgccacttttaaggaagtaaaataaggtgaaattaagtttagtgatatatttcatctaagccaataaatccaaaatataattttaatatgtaatcaatataaaattattaaggaagtatcttagtgtgttttacgcatttttaacattttgtgtacctcactttagcaacagtttaaatgctcagtagccacatgtggctggtggtcactagagtgggcagtacaggtctagaggcttagagttattgtttgaattgaagattagtttattgcatgtattgggtactcatattgtatctcatgatgaccactaatagtaatgctgaacgtgattattgtttaagatgttatctgccacatctatccattgtgaagtattttttgtccttttgtagttagaaggtaatgcagggtggatacttgggcaccatgtgaatatcctgtgcccagacaaccttgccttcatggttttagagtaatgccctcgttcccaatgcaggtggttgccttaagtttggtcatgcttgttcttagacctataaatacaaaaaagacttcaccattaaaatataaattatttaggggctagtattactcaattaacagcaaatgagagaatgagtaaaatcaaagtatatgtatggagcactgaacttctcttctattggcatggatggctgggaaccaacctaagtaaaaaggctggttgacacctttaaaattaaaaccctattcaaatcctgcttgtcactcttactgtttgcaaacgtgcgtgtgttttgcagagctgtaaatgaagaataactaaattcttacctctgattttttttttaaacaggtgttcacaaaagaagccaacaccagggacctgatgatatttaccttgatgacttaaagggtctagaacctgaagttgcagctctttatttccctaaaaggtagagtggtccttatttattgaaggacagctctgaaatagtctagttatttctagagtaaaacatttcatctcaggaaaaaggaacaagatgatggtgtcctttagctaaatctgatgatggcttcaggttttggaaaatttagaaatagcgcgtgtcttatttcaatatagtgacttgaaattaataattacttacgaagacattttcaatacaatgaggagagatatactagttaaacctacataagggtatatgacttctgattagcatttcctgtagtggttaatacaaactcaacatgcttgggaaaattttttagcatttattttattatgtgttttaaaagaaacacatctttatttgaaaatgttttccaaagaatgtgttcacttcttgggagtctgagatcctgagccttttctgaaccgggtctgggtctggtggggcactgcccccgcgccccgtgtccccacatcccctgcagctccacagctgccacccagcctccctcactgtcccgcaccattttccctttgaattacttcaaatatgggcctcaaatatgatacacttggactgccttcccaagttcatttctactcttaggggaattctgttaaactgctactctgtggttacaaaaaaacaacttttctccacggaaagtatgacttgaatatactgagccataggcacacataattaaacacttgtaaatgaattactgaaaagtatattttgttttttatttggaatagaaagatgggattgatataaagctatttaaattttttacaggtattttgggaaagttcttaaaactcctttctagctctgtcctaaatttatctcaacatatctacttcatttgaagtaatagttggatttttttaaggtgaaaaaactgaaacggctttattttaacagtaggaaagttcaaatataagctgtcatagaattaccacttttccccccacatttcccaggccttaatcatttatttatattggtattccttcggtatatgtcttagtttctcttttaaaaagtgaggagagtaactaaggtgatgataccttactccactctactgtaatttaactgttcacagtcactgtccatgcactaagtaagcttcttacctcattaactatttcttgaaacatttcataaatatttaaagatagtgagtgagactcttgtaatccatgtaagcattagtcatgtcatgatccttagcatcttcattaccaaatttacagtatttgtaattatcactaaactttaatataaatcacacacttttgtatttggtggcatcctgagtcagacggcatccccatgtgtgtagatgttgttgttactggttggggtaacactagctgctgtagaggtggaactcctgatctcgttggcctaccacgatggaattttgtttcttgcccctgtgaagaatgctctgtgttggtgtttagggggaggccttgcccacagggattcaggaacacaggctcctttcaccttgaggctctcccatccccatagggtctcagagtccagagtttactggcagcagagaaaggaatgagcatcgcataggagagggcccctggggaggggcaccatgtatgccttccgtccatattcacggctcagtcatgtgctcacgtggccccacctgactgcaagggggcctcgccgtgtgccccggagaaagaggagacaggtgtggtgaacacagaagggttggccttgcccctcactcccagtataacaacagttctgctgactttgtgtttccagtgagaacattctgtcagtccagttaatctcaattttgtgggtatgagtgtgcatggctattaagaggaaaaaatatccaaaaacctgaatttttttgttgattcaaatgggaaacaggttttgaaactgttacctagttaaaacataatctgtagtctgctgccacctactgctcaaagatgagatttgtttgaaagagccagtaaacctctgggtcactgtttttttaattcacataaaaatactggctttttgaataaaataagtgaatttgaaaattctcaatatctcaaatgtgacattaaatacctattcaaagggtatagagtagtaagcattggggactgtgagacttaaggtgctgtgccattcatgattattctttctcaaatttacacttcattgcataaggtttcccttgatcaccttctgaaacctggcttctgtgccttatcttgaaaaatgaaaatattcagtaacctcatctttagctcctggaataacagttacatccagtttatttctgaatacatttctttttctaggtgggtcttgcctctagagaatttgctcgtttaatttctccttccttctttgtgaggtaataggcgaacttagaaaagatttggttttaaagaatatagccttggactacagtaattttctacaggatgtataaagtgccacagctttttctaggacgttaggatcaaaggtttccaaacagcagattttcttaattaccctgtcattttcatcatggaaatgtaaataaatacttataactattttactcctttaattaaaaatcagaaaggccacagttgaaatgtttgcattattgtgaatgaccgtggtgattttgtgacgtatttactatattcacagttaatttctcactggtactatattaggttatctttcatgtcatttatgatatgattctaaaccctatctaagaaaagttatgcctgattgtaggtccatccgttctttttagcggatgtgttatttggtttgagcccccagagaaccatgcagtaaactaggaattcaaggagttgtaataaagcacatcttttccccatcccctgtccacagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaaggtacgttgggtgtttgtgccccatcttcatttcagagagcaatctggtcatcacttggttaaaacttaccgtgtagccatttcaggatatttacattctttagggatcttgtgcaggtaacaggtatgttctgtaatgtcagacccttataccctcacttaaggtcttaattgacacctctttatggagtggctttgaggtagtgtgcccttaaaggctctaatttcaaattaagaggttgggagttatcaggccgccctgttttctgagctgccagggtgcgatcatcacactgcaccagttttctcatctgtaaagttacagaaacatttgtggaactggggcccagctgcccttctggaaagcactgggccttagacatgaatatagggccctgaagttgtagaaaattgattgtccactgagtacgtggtctttctggcaaaaattaggaggattactttctgtataaggctggagggttggcccacgagagtaaagcttgctcaggaatcaggagggagtttagcagacatgtcaggatgcctataggctgggctgagtgccatgtgcatccgtcctcaattcatcagcatttttttttaaccttccttttaaaactgaactcttagtatttctcagtttggcctgtggcccctgtatgattttcttctaagggaaaattttctttccgtgactagtgtcatcttttgtcttccctctcccttagaggaactgaaggtgtgatgtggcagactgcatggccagaggctcaggaccatgtgttcctgaagtctttcctttccagggtcacaggaagctcattatgcctcttccctgtctcttcattgtttgtttgctttatattttgcaagaaatttaaagtgtgttatggccaatggttcattctagggactaagttaaataggtcacattctttctgtaatcctcttaaatgttcagtttaaaaaattatatgcgagggaatgcgaaatacaaaatgtaggtaaaatataaaagttacacctttgttttaaatattggtgacttagtctagtagagtttattggaagaggcagaaatgacaagtaaatgtaagtaatacacacattacctggagaaacaatccaagtgagcagtttctctgttagcctagatctaggagaatacaggtttaggaacagggtacaaaaattcatgggaagccctcattcactctgcaagaacttgggatttatttcacagaccttgagccaaattctaggtttttttgttttgccttgttttgtttttttaattctccaagcaattgtaacatgtaatttttgttgttgtttttattatttaagacagagccttgctctgtcacccaggctggagtgcagtggcaccatctcagctcactgcaacctccatctcctgggttcaagtgattgtcacgcctgcctcagcctcccaagtagctggaattacaggttggcaccaccatacccgccttatttttgtatttttagtagagatgggttttcaccgtattggccaggctagtccctaactcctgacctcaagtgatcggcccacatcggcctcccagagtgttggaattataggtgtgagccactgtgcctggcccaaacaattttaagatatgttttgatataatgtagcttgctaaagctgtaagacccctatgaatattccccagttatgccgttgcctgtcagtaaagtttcttcctctgagaatagaacttcgacagttttcgtgtgtgtgtgtctgtctgtctttctgtgtctgtcttccgtccctctctagccacatctgtatgtattttttttgaaagtctctgtcatgtccctttttactagtttgtttgttttcactgggagacagtggaaaaggagaatagaaaagaagtgttctttcttgtcctggggaaaaaaagcgtctgacattttgcttttgatgaatattcaaaaattagtttttttagacagatgattttagccttcaatttctgcaatgcagagagtattataatctcatatagggatttatgtaatctctaaccaaattgattattattttacattgcagaaaaattcatggagcatatcattacttatcacgaatttgcagaaaaccctggacttatagacaatcctaaccttgtaataaggatatataatcggtaaatactcctgcttttataattgttaaatactcttgcagtttttttacaagtgccatttttaactgttacttataaaagtgttccttcttataaaacttgtcatctcatataaattagccagtgggcaatgactttgaagtgaaagtaaagcttcaattttatttttaaaagaagcattgaaatgttactctgtttgatagattttacggcttctctgttcagagaagttgtgcttgaagcgaaggttattcatgtgacaaaaaattcagctgatcatctttattgaaaagaataagcaattttatatgtcacttccctcctccctccctccctgattccctcccctctctcttgctcactttcactgtgtaatggttttgcacaatttttgtttctcacagttactataactgggctttggcagctcccatgatccttagcttgcaagtattccagaagagcttgcctaaggtgaggcgatccaccatctgctgcctttccgaaagcatccgcagtgtctagtacttacacaaatccatatgtgcatatttctgaactgggtactattcaaagttttacttgagcttaatatttaatataaaagatcaaagtcatatgtacccactaaaaatatctcatgcccaaactctgggaaattagcagggctgccacttctttatttcatttttattagacataaatactagtttctgatggtctgtaaaagttgagagattttactaatcataagttaaatatggaatgaatgaaaaaaactttttctcccattaatatgggaagaagcagcaagaagaaggtgatgtagccaagagaagcttgacatcagtgtggttagggcagatggtggctaacatacctgttatatacaaactcacaattggtttttaatctgtcccccaagaagacatcatcagcctagttggtcctcttaactcatgagaaccacattttccaaagatagataaatgagatttgcccacctgtcagcccctaaggtcctacatagcagaccgcctggtctcatgccacagagctgtgctgccatgaaagcaggacggggtctgtctctcagaggtgttaaaaacgctagaggaatctgggaggtgtgaagagagcatcggtcacgttctcacattccatagtaaggccccgtccttcaggctagcatagaaggtaggtgctgtgtggccagtagattgcccagactaacccaggttggttgttttcaggccacagttgagtcctgggtgaaagacaagatgccaaagaaatctggtcgctggtggttttggcgaaagagagaaagcatgaccaaacaggtaacagacctagaggtcattgtttccgtgggctgaaagaaatgaatctttcatttattcaaaaaacctttttgtcaggcacaggaatttggactgtatagggctattttaccatatagcagtttccatttttgagcacttaggacgtgcaggtgttgtcccaagtggtcctttactgtagctcagcactagagatgttcgagttgccatttcacaggtaaggaaacttgggtgcttcacgaagtcacataactggtgagagacggagctggggcaagaccttgagtctgactccagagcctgtgctctttctgcttcactgtattacctatcagataggagcagaaggttatcgtctgcctgcatagttccagatgcaaataaccagaatctgttccaccaggtctccatagaaattcatccagagaaccatactaaacaagcagcagagcaagtctttttttccccaacaccttctgaaaaagagggttcagggagttctcacctgtttttcaaatgtcagaagggaagtcttgcctgaaccaagttcatgtccacgtcagcaagggggctgcctttcagtcccttctgcacgtggtgagttactcccaggaggagaaggaagctggggacctaacaagtttgggtcgcttgtattatgttttgtgacttgaaatggtgctcttaaaatgttttacttctgggtctgtagggacagtgatttgcatagaagcacatgacttctgtcttaggtttctaattctttggctcagaatagagaaagtctggtttttgagcatttttaagttgtgggttcagaaggcagttgtgttctttcctagagagggctgctgatgaacttggcttatctgtagggaaaaaattgcatgttgccattatcatcttgctgttacagctgccagaatccaaggagggaaaatctgaggcaccgccagccagtgacctgccatccagctccaaggagccggccggtgccaggtgggtgccctgtcctctgcccggctcatagcactcaggccctctagcagggccattacttctaagttgattttggcagcttgtttagttcttgggagtatcttctgcagatactacatgctgtgatatatttgtgccactcagcagatgacaactgcttttctaaaaaacatcaccagcttagaaaaataaataccctgcctccttgtggagccgtggcgccagcgtatgggaaggggccgtgaggaacgcttcagccatgttggcccaggtgcctctgctccccctgcatcccatccggagccaaagggagacatacaaaataatctccaggttggcttgggtgggtttcctttcctggaagaaacagcattctttggacagttagggtgagcagccctgagaggagttgctcgcgatacgccgtgttcctgcttctgcctgtccacctcccccggccagtgcatgcttgcttctcccagcccttggctgtctcatttagtgtctaaggctgagggtttattttcttgccccttaccgccccccatcctatatcttttaaggggtgtctaaaatttttcttactagtttttgtttttttctagagtctcactgtgtcactcaggctggggtgcaatggcataatcatagctcctcggctcatacaatcctgcctcggcctcctaagtagctgggactacaggtgtgggacaccatgcctggctaatttttaaatttgtattttgtagagacagggtcttgctgtgttgcccaggctggtctcaaactcctgggctcaagcagtcctcctgcctcagcctcccaagtagttaggaccacagacaagtgtcactacccctggctaatttttaaatgttccgtagaaactgggtctccctatgttgcccaggctggtctcaaactcctgggctcaaggtgtcctcctaactcggcctcccaaagtgttgggattacaggtgtgaggcaccgcacccagccggagtttgttaaatcattgtaagcgattatgttttctttgatttgtgccttgtgaaacatacataccctcttcaacaagagtcagtagaccttctagcattcactgggcatagcagaaaatagcaggtcatagtcagaaagtaagtgcttgccagttatgaaagtggccttatcagttaacaatatgaatatttcaggcgtacagagctgtggatatgggagaatggcagaagggataactctacccattcctagaaaagatttaggatatctttattttcttgatcctaaatgaaaagctctcatcaataaaatgccctgctgcctcttccgtaactgggctaatgttgaacaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgtgagtcttgcatgatctgtgttgtccagtaggacttattttagtaatggtttaatttgatgcacatcctcttctgtccacacgtccccagctgcatacacgccacacggcatggtcgtgtcaatgcctatccacagtggaaccacgaccgccgcccccaagagctatcaggcccacctggggaacctgtggcttgggtcctgccacccaccccagacctccttcctccatctcttgagagtcagtcgtacacagctaacccagcgctgagccaggtactgtctcttaggagccacagcaatagagaaatgacattttagacacaatttctcctcttattttacaccctgcctttgacccattttcggtatgaaaaggtcttgctgggaccagagcaggctgtggctaaagcagtaattctcaggtgtggagtaagagtagtagaccttttgctttgtgggtgttcagagaagtccctggaaccccaaaatactgttcaggcagtggctccctcagcattgtcagctgcgctgggcacagggtgggctgtgtctaagaccccggaaaccatcctgcctcttgttgggattccgagacaccagttgttctgtaaatttttaaatcgtttcaaactatgttttcagctgattttctttattcttatgcttttttaaaaggcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtaagctcaatccttcaggtgggtggcaaggaacagccccgtgctcagggaggggcaggcagtgtgtggtggggagttcctcacctggggctcgaagccctcagccaaggcattttataagccatatgctctgaggcgtccccagtacagtccacatggggtcatttttttgcatggaggagatggtgagggtgcataacaaatgtcaaaaatcacttttggaaagattagttatttggtttcaattctgatatgaaaacaagccccttgacattggggcggaggaaaagagaaagtgtggcagtcagttacctccgaacacacacatctggcgctcgtgagactccgctttcagaagcacctcagtgggtgcgtttgcatgggatggccttgcagttgcttgaagctgtgattaaatcccctttcaagagtgtcccgccaccaattagttattggcagctgatagtcaaccaaataggaaaacgctgtatgtgtttgattcctgatagcttttcctgtttctaccgtcttcttaggtcggatgctttgggacagattctcccacagctgggcaaagactggacccaccagggtatagcaaagctctaccattccatcaatgagtaggtaccctccccacgttaactcgctctggtgagctggaagcttgctttaagaactatagaacaatggtgtaagtcttcagtccacatgagtcatgtgtttatgctgaagcattcccgctcttcctcactcctttcctgttgatggtgtgggagccgtgtgcacctggcattggcatcgaacctgtgtcatctcagttaatcctcacagtgctgtgtttcaggcactacctacatctataactagaatgacagttatttttttagctagaatttaataagatagctgattttcatttttggtttattttctgggtattttaaatttttttttttttttttttttttttttttgagatggagttttgctcgtcgcccaggctgaagtgcaatggcgcgaccttggctcactgcagtctccgcctcccgggttcaagtgattcttctgcctcagtctcccgagtagctgggattaccggcacatgccaccatgcccagctaattttgtatttttagtacagatggggtttcatcatgttggtcaggctggtcttgaactccgaacctcaggtgatctccccgcctcggcctcccaaagtgctgggattacaggcatgagctattgcgcccagccttaaaattgtatttctttgagtagatagtgcacgcatgcatgagggaaatagttcttgcatgggctgctctctcttggggcaccctttgaggggaagatagccgtgccatggcgtttgtgggttcctaatacatatattacattgatctgaagaatctcagtgtcttcagcattagttgagaataccataatatgaaaattacgaatatgtcagttacctgggtataattttgcttcttgtctgatggagtggtttgcatcttgcacattgcctttataaataatatcccctatattttttcttcacagtgggtaatttaaagatagtccaaggttttttctgtcctctaatctggctttcatggactagatgctgaacattttatatcagtacttacaaacttaacataatccttagttgcctgtacctccatttttttcccacgttttccatggaaggtgaaacctctataatcctaagcagtttcctgctaaatttgagaatttggttttcacagtaaatgagaggaagtttatttggatcttttaaaagaaaagtatgggttgagcatggtggctcacacctgtaatcccagcactttgggaggctgaggtgggcaggttgcctgaggttaggagcttaagaccaatctagccaacatggtgaaaccctgtctctactaaaaaatataaaaattaagccgggcatggtgtcccatgcctgtaatcctagctacttgggaggctgaggcaggagaattgcttgaatccaggaggtggaggttgcagtgagccgagatggcgccacagcactccagcctgggtaacagagtgagactcaaaaaaaaaagaaagaaaagtgtggggttttttttttgttttttgttttcttttcccttagccagaacatgtgggctaacagggtgtgttttctttcaggaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacaggtacctctccggcaggcagccctctgcccaccgccccagcatgtgggcggggctgggcccaaggtggggggatgtgtgggaacagaagtcagatgttggagccgccacgcctctcccagttctttggtccctggtggtgtcctaccacatactgctcacttgccatgtggcgggcctggtgaagaaaggcaggttctaggaaccgtcaagttttctccttccctaaacttcatcactcaaattttcttagttatcagactggcaaagaaggagaaggaaagattccagttacaaagggttgaagaaattgggtggttgtgagcactaaaattttaggaccactcactggggaaaacgaccattttgagattggtgattgtatttgtatttttttcttagagaagtgatagaaaagaaaccagagaagttcaaaattgagtgtctaaatgatatcaagaatctgtttgccccgtctaagcagcccttctatgctgcctttggaaaccgtccaaatgtgagtatctcctgggctctgggttctgatgtgggtgaaattcagagggatgtacttcgtggggtgtagccacgtcccaattctcaaagcagttttgtaagcaaaatgaggcatctgttctgcttgttcggttttcacttgatctattccaaatatctatagcaactggggaggtcctgcaggtgcagatctgccccagaatttatacgaaggacgcttttccatcgtttctgtggctgccattccatttcctcaggcagctccggctcctcttctaagcagttctgagctgcgtccttggatcaccccagagccagggtcagtgctggcccttcgctagcacttcccaacctgcctcccttctgcagggccatcgggcctcaggtgtgcagaagatgtggcctctctggcctcttctgcgccagggaccctggcttccccttggtggctgcccaagttttctgactctccaagcaccactctgtagtttaggtttgtctaaagctcagttttggtggcaactgcactgtgccgcctccgcatgttttctgtcgagtctgtctgtgcagtgcttctggctcacaaggagcctgagaagtatctcctgaattctcctccctggaatcacccgcttgctattttcttctgcaggatgtctatgcctacacacaagttggagttccagactgtagaatattcaccgtgaaccccaagggtgaattaatacaagaaagaaccaaaggaaacaagtcatcgtaagtacattctcagctctcagcccggcgccctgcagccaggggtacagttggggacagacagaccctgtccttttccccctgatccttgagatcaggccctgatcaaaggatcagctacatctcctctgtgggtatctctctttcacaatatctgtttgaggggtctctggttatcctagacttgtaagagggagtttgagccctgtgatgggactgaggcctgcctctgaacctgcccacctgagcaatctgagtgacagcttcacagccccccatcttgtgcctttgaccgatcttgaagtaatagcctgtgcctcttccccaacctttctcttaggtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagacctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaattttgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaatgcatttggctcttttcttcaggggacattgaaaccatctttctagattcttgccagaaattggtaatttccataaattagcatcttgatctttgctgacacttaaatttgtctacagcaggagctcctttttgttgcttattcttaaaacctggcttcagaagtgcagctacacccccaggaactaacctcttgctttgtaccttctgccaggaaatgacccatccatatgtgacttctgctgtggtctcacggctgtccaggaggctgtgtttacctcctctccctaagcacttgaattccctgggagtcctgtccagagcccctggacaccccacctttccttaaacccttccttagggtgggtatgatttagcagtcaatcctgatgttttcatcacagagtcagagtgacctttgatcaaaaccacatcgcatatattacttacatggtgatgttttgtcctctcagattgctgggcccttaccagatgcagcatatgctgaaccctgcatcccaaaggccctccacaggagcgtgtgttcaggatggaaatgtttgtttgcatgacgtgatggcaaccatgggtctttgggaatgcaaaagaagagctcagggaaattggttacaaaggaaatggtctttacccagagcagctttgagggcttcaggggagcagtgaactttgcatacctgagctctgaggacgtgcctgcgtgtggcttctctctgttttgccccgcacccattggagttggcatgtgtccttccattttctttcccgtttataggatggcataaggaaaatacacatttatctttagaaaggggctgtggtgtggattggatatgtgcaaagctgggtttccaagcttacaggcatgaacgaagtgactccaatcacaaatactccctgtcaagctgcaaatacataaattgtgagaaaattagtcacctgggaaagctagattaacatgccaaccaggaagtaatttcaaatgcagtttaaggtttgcatttattgacgataccattttgtttttaatcgtgtaaatgaggccatttgttagtgttacatggaggtttggaggggatgtcacagtccttctctacttaagaagtgtcctgaccttttctcagcaacaacttgatatcagaagttgtgaacttggctgggcatggtggctcatacctgtaatcccagcactttgggaggccgaggtgggcggattggctgagctcaggagttcgcgaccagcctgggcaacacggtgaaaccccatctctactaaaatacaaaaaattaaccgggcgtggcggcatgcacctgtagtccccgctactcgggaggctgaggtaggagaattgcttgaacccgggaggcggaggttgcagtgagctgagatcgcgctactgcactccagcctgggcgacagagtaggactgtctccccccaaaaaaaaaaaaagttgtgaacttgtgcctgattctgtctcagggtttggtatgcctctgactgactcgcaggcactacttcaggggtgatgacttcttgaagggctgcttcgaaccccacagccttaagctcagctgaccttgttgttctactacctgtacaaaaagacagcctttccctttctaaagatgtctcctaagtgggccaggatccacctgtcatccagctttatctcaaagtagaggcacgctccagccataatgaggcatattctgttttgcctgtcttgaatacacagagctgagattcaccattgttggtgagtagagatgcactgagaggaggactgggttttacccgatgttccagacccatctacggagtagggaaagcagcaggtagtcatcacccaccttttgcctgggccctgcccctgcagctcttgagcacgtccccttgggcgccgagtgcggtcttttcaaaaggagcgtgagaggagaggagagggcgatggcgcgtgcccactgggttttcctgaaaacactgctgcactggggcgctttccatgagtcattcctaggacagccaaggatactctctgacagctctctttagccagttccccagctgttgtaatggggtgagatgccattctccctcccgctcctggacaaagaggtccacattttaaatagtaaaacggcaaacctttagttcttgctggtcttcctagctgtggcggggggagtaaataggaactctgaagtgtccagtggccaccctgtaaattcatttgcaaacaattcttaaagcattttttttacagcataagagcatcttgtgggccaaggaaactgcagctcttgattctaccgtccaaacctttccccagtgggacttgattaaccagtaggtgttaccaacctgatccacagagactaccttgaactaagggtgctgagaggtctccgtggccactggtgacagattgatactcccgggcctcccctcagtggaggcgtctcgctgtgtgaagatgccgtgttctcagatgggctcagctgtcagcgtgtggccagcgttaggttgagcttcctgctgcttagaaacccaagagctcggcgagctgtgtctgctggagattggtgcagtgaagcagcagggatcaagttagcctgggcagctgctgtgggatctgagtgcagcatccccagaggagccgctccagctgcagatgacatggggccttgacctccgtgcacatctggtccgtcttcacaagccagaaacaaaacccaagtgtatagcttggatgcggaggggtaacagttttgtagctgagattaattttactcaaggttactttctgtagccctttttgaaacaaaacatttcttcagtttgctttttagcaacaactcccgatctgtaagggaccacacttaaattaacaaaagttaactggaaatggctttccatctttattgacactccctgtctttgcacttaaattgtacatgccatttaaggagcccaacaagctttgggaacagtctctaacgcatccctatttgcagctgggcgaaggcccgcctgagcaggttaagtcccaggcggcaatggtgagccaagcgtggaacagcccaaactaaagtcggggtctctgtgcggcggcacgggccacttcggcacttcagtgtttaaacttctgcatgcagtgtaaagacagacagctggccacagtgctgccctgcagtaaagaccagccaccgtgaccggctctcccctgcctccctcctcccagcccacagtcagacggagcctctgtggcaagctcaggcccagtccagggccctcagagtgtagatacaggtggaggcctttccaagtcttccagttgtccagttagagtggcagaaaagtcagtggccatgttcaccgtgtgcctcactccctgcagcctggctggatgcagtaaggcatggtggcctcaacagcgagggaaggcctttatgttggggcctatgtggaaactctagccccgtgcttccattacatacaaaccgaatatattaaagctttagagtttttacaactatctatctttcccctgacatctccccagccaccttagaggtgggaaaggaaaggatataagaaaaccccactaaatgtggagtacatttcatcaaagtctgtgtgagccagcttgcccccagtcaccacgacgttgactgcatctcccgccttcaggtgcacgatgaggtggaatgcccccgggcccccgcaggtatgcaaagctcctggagggcggtggtattccaggaactctctcctgtacccagcggtatgcagctgggccacgctggcgttggagaccgacagcactgcttccacgtaggcgtctctctcgggggtgagggtggccgtgatcaggtagcgcccatcataaggagccgtgaagacccctgcggggagaaaggcaaaccctgtgctcacctgctgtcgtcacagcccttgccatggtagtaagtggccccccagtgattaacctgggcctgggagaccagccatctctgtcttcccatggtagctggctgcctgcctcagctgctttttatgctcatcccctacagcctacccgtgatgcagaggccaccttagcccataccactttttgccatgggcctaagaatgcctcttggaggcattccttattggaagcacctaaaggctaaagtcagcctcaaagcttggctgctgggcagaatacccgggaggcagggccaataaaaacgaagcttgccaccaacccagggagaggcagacatggcaccttgtaaccccaggggccatgccaggctcctcgtggaagaggcccattctccccatgctgggcaatggccagaagtgagcactgatactcagcccatgacccacacgttctgggcccagggtgggaaaggaagtggtggccaaaggtgaggaaggtggaaagatctgtacatgtcacaattcgctaagcagaagcagctgtaggtggccccacagctaggagagtcagtgccaacaccaaatgccggcaggaatggccatcactcacgggctccgcagcagacatcggaccttgccgctgacaacaagccaagagtggacataaagcggagggcccaggagctaaaaagggtggtcctggccatgcgtggtggctcacgcctgtaatcccagcactttgggaggccaaggtgggcagatcacctgaggtcaggagtttgagaccagcctggccaacacggataaccccatctctactaaaaatacaaaaaaaattagatgggcgtggtggcgtgcacctgtagtcgcaactactcaggaggctgaggcacgagaatcccttaaacccatgtggcggaggttgcagtgagcagagatgacaccactgcactccagcctgggtgacagaacaagactgtctcagaaaaaaaaaaaaaaaaaaaaaaagtggttgtcaggagcccaagccttcaatctgctctggaaaacagaagaggtctggctacccagtccccttcccaactttgaacagcaagtaactgagggctttccagatgcttcctaaggtacctggccctgaggccagcaccagccctggcgttttgagtgtggccttcacctttgttcagagtcgcctgtggtgaagcctcactcagttcacccagaattttctttctgcacctgctccatgcaagacaagagatagctctgggaatgcgagactataggtcacagtccctgcctgcaagcaccacccaacctgtccaagcagacgaaccatccctatggccaaggcagtgcagagtgacctggggagcatggccttgttacagtcaggcagatgggagcagggcaggagagcccctaccccaactaggaatgtcaggcaaccatcagatgatggtcctgcagttgttaactgtctctctaaattaatgattggttgcagccagcaccacagaaaggcagtcgcccaatagtcagacaaaacctgaagctgatgatcagctgcttccagataagatctccggagttgggcgatgaagctcatgcatgtgcattaagaggcaaaaatgatgtttcaaatggtgtttaactggtgtgtgacctcctgggaacacttgactggtacaggaagaacacctcacgtgggcacatgcacaactccaggaaacactgcgcacgcccccctcttaggcactggtaggcccctgtgcatgcggacggccccccaagggaagaatcaggaaagggacgcaaccctggaagcatgccaatgtataagaccccaagtcacctgtcagaccgcacttgaatctctcaagtcgcccacttggccgtcttccgagtgtactttccttcctgctctaaaacttgcctcagtctcactctgcctcatgccccttggtcaaattctttcttctgaggaggcaagcattgaggcctgtatggattccccttccctgatgtactgaccccaaaggccactgccactctgagcagaggcctggaggtctgtggggcccaggaggaagctacatggcggtggaaagtaagtggcgttccctctcgccctgaccttagatgccaagctccagcttaatcagcctggggcactgagaattcatttctctgagttctgcaggtaacttaggcttgctaacataacagttaagagccactgactaaggacagatgggatttagccagacagtgactagacagggcaaacgtgaggctgggggtggctaaaaactaccaagaaggaaaccaagtccccctccctcccagtggcttatgggtggcaaggcctccctgaaatccactgccccacccccctccaggaggccctgttcacagtgcgtgagcagaacagtgactgctgagggcagagagagacgtcaggaaagaccccgggctgtggggacctccccacacctgcctgggagctctgtcctgatgggcccaggcacccctggaccctgtttccttggagctgccctccgtccgggcagagcagcccagcccaggtggacactgatgggacacagggaactcggaggtaaactccacacccatgatccttgggacctccagcaacaacccggggcagggggacacgccaggcgctgcagaaagactcaggctcccagctgaagggattctgttgcagagcatgaggccctctggggagcgcagtccctcttgtggctctgttcatcataaactaggagaccctgagggagcctcccgcttgtcctggcccaggttgtcaggatgactgtcggagcctgagagagaggggtgcaatggtggctatcagaggtggccagggcatggcgggctgtgccggcacagccctcataactgctgtaaaaaatgaatagcaaccccagtggtgaatgctgaggactagcgtgttgacctcacgactagaaaatgttacacacccatgcagcctgcagccctcgagctgggacacgttctacgtgaaagcccacagagtcgggcagaggagtgcaggcccactcgggcatctgctccagggtggcgtcctccctgagcccacgggacgctgggaaccagccagccatggtgggaggggtcccacctgcgttggggtaggaggaggacacagtaccagttcccttcaaacactcaccggtgctggggttgtaaacatccccgtcgttcaccagcactttgttaaagaggacaacgcccccatcactggggaaaggcttctgggtgagccccgcagaaaaagacaccagagaaggcaccggagctcctggagcagagaaaggatggaatggattgacccgggtgcttctgtcctccagggggagggcctggaaaactgaggcctacgtgccaggcccaggtgccaggcccattttatttcacccaaagtggtgaagcaaactcctcatgcccaacagccagagggttccctgtctgaggatcagcaggcaggacagctgaggaatctgagaaaccggacagactcttgttaggagggtgtgtgtgaggctgggcatgtaagcatatgagatgagcatgtgtatgtgcgtgtgagtgtgtgcacacacttgtgagcacacatattaggaggccaggccaggcagtgggtgcatcatcatctagggagctgcttccttactaataaatcagtaaaacctggagccccaggaagctcatcaggaccacacaagggcagaggcccacccagtgatccccttgggaaactcaatgagctgggatgatggaggagggaagattccttgtcttgggcctgactctgaccctctctggggagcaaaccttggggaatttggtccactatagtcagcagagggctgtcccagtgctggtgggtggggaagggctgggcccaggcttgatttgtgctaatagcctggagggaggaggcaggagatgcagaggaggggcagaggccaccaaggagaccgctcctcctgctcctggtctctcagcagacatacctggggaagctacaggaggtgacttcgggtatcctgaaaaacagaaaggaaatggcatgtcaaacaagaccctaagcaccagctccttgttctgagccccctttttcctctgctcctcacaagttcaaatcgagtcttcactactatagaaacagacatagaacaagggcacccactgtcactgccctccttcaagcagaggcacatttgtaccagcccgtccctgcttcctcactagcccatttatccctggcggggaagagggcactgagggcaagctggctgcaggaaagaaagagatgggcactggagccttggagacttctctgtgactgagagagtcacacaagccaactaacatttgccctctagcagtgttatctgttcaagagctctaccttcaactagactgaatgcagtacttattaaatggaggcatggatgggtgggtgcagaagtggagggacaaatagatggatgagtggatgcacgcagggaagagtgcacggcttgatgtgtggaaggatgtgcacatgcataggtgggtggacagatatgtgcatggatacatgggtgggtgggtccctggggtgccccagcctctgcatatgaggatgcatatgtgggtggatggatgtatcgatgggtggatacacggatacatgtgtgggtgggtggctggatggaaggatggatggaagggatacacggatagatgcatgggtgagtgctgcatgcacggaagggtgcgtggatggacaaatgagggaacaaatagcccaagagagcctaagcatccatgatacatggaactaacagaagataagtgttatcttagaaaatgcaggacatctgcttaagagctgtgatcaccgcagctcaggtgtctaagaaggaatagaaaaaagaaagctggtgagagaaaatgtctccttgtcttctcagcagtgacccagccttccagacagccgtgggcatcaggggccatgggggcaccaggctatcaccgatggggaacaaccccagccctgccagtgtctgcatgtccctgatggtcagcctggtctgactcagaggggactgactggtttgcattgttctatgcatgtatctatggcagatgacatgacctgccccattcagggtcatctgtttatctgttatagccacaaatctcagtttcctcatctgtaaaacaacactggcttcacagtgccattgggagggctgcaggagatccagatagggttcagtccctggcacgtggtgggtatcccacaaatgctcacttccttctcctgtctctactctgacaccacccccactgtcaccacgacagtaatggtgcagacattcacaactcatggggagcacttcccagtggggcactgaactgggcttttctccatcctcacagtaagcctctgaggtcctgcactctcctcattttgtggttgaaggaactgcagctcagagagctcaggaagctgccccaagtcccgaagcccgtggtagacagccctcctgcctagccacgctgctgtgccacctgctttgctgctacccaagctcccaatacccttctggcttccaagatccttcctgctgggaatcaatgagctgcccgtgtggcactcgtactccaaccggcggggccactcagtatgtctaagtacagacgactgcactgtccctgaggtgccccggcctccgtgtgctggactagcatgagcggtccctcgggcctcggcatccttccaaagctgcatttcggaacttgcccccccgaaggctggaccccgaaccgccacgcccctcagcagaccccgaggctcaggcggaagttccgggagagccccgcgctcctccccgcgcagccccgggcctcacctggtgcgcccgcgaagccttctgcgccggggacggtgccgctcccggtctggccgtccacgccccgcggcagaccccgcccagacacgcctgcgcctgcggggggcccggcctggcccgtctccgcgatgaccccggtggagcctggcggctggggcggcctctcctcggggggccgctggggcaggacgggccgtcgcccagggtcctctgcggttgcggggccgctgggcctcggcggggcgggctcgggctgcagcggctccttcggggcctctgcgggcggcgggggcgagggcgcctctgccgggcgtcggggagaaagaaacacacgggattaggaaacctcagccctgactgccccgtcagggtcccctccatgagtcccggcgagcggggtccccgtgaggactctgcggccacccctgcgacgtcaggccagcgggacacacgggcgtccgcccgcatcttccgaggacgccgcgggccacccggacgccgccggggacccctgcccggggccggggcgtttccagcctctccggcgcagacggctgcactttccaaaccggcctcactcttggctccggcatccaacaattcccgatttcacagcacgcggaaaccgcgggtgcgtcgcaagtgactgaaagggacctgaggccaccgacccccgcaccgtctctgaaccacactcctgccggggccccacggcctctcccgcgggctgccgagggaccctgccggggggccccagggctgcgcggaggccgtgaggagggctcaggctccacgagggccgcggccacagcgcccacgtcgccagcggaagggacttccaacggaggaagctcctggcgtgcgtctcccggccctctggggaaggcgccggaagctgccgccctttcctcctttgaactcgttcccggaacgagccctccaggaagcccctcccgaccgtccacgggacgcctgacaatacccgggcctggctgagggacccgctcgccaagaaacgccatccccgccgcccccgtcagcctggtgcccacgatgcccagagttccaaagcgcaacacatttgatttttgtttaggacccgacaaaaatcggcggctgcctcccgacctgccgtctagttttgttttaaaactccctaagcgggccgggcgcggtggctcacgcccgtaatcccagcactttgggaggccgaggcggccggatcacttgagcccccaaattcgagaccagcctgaccaagatggcgaaacctcatctcttccaaatatccaaaaaaaaaaaaaaaaaacaaaaattagcccggggtagtggagcgcacctgtaatcccagctactcgggaggctgaggcaggagaatcacttgaacccaggaggtggaggttgcagggagccgagatcgcccgctgcactccagcctcactaagctggggagaagggcagtggaggtggttgatgggttcaaaaatatagttagacagagttaataagatctagtatctgatagcacaacagggtgactgcagtcagcaattatcttttgcacatttttaaataaaagagtagaattggaatgtctgtaaagaaatgacacatgctttcggtaatagataccctattaccccgattattatacactgcatgcctgtatcaaaatacctcatgtaccccatatatatatatatctactctgtacacataacaactaaaaattaaaaaaataaaactaagataaatatggcagatcaaatacatgccccccccccgccccacccacagaggcaggttgccagaacaccctgagagaggcagtttctccaacagcctttcctgaccaatgttccatgagagaagcccaagagaaaacaatttgagtgattactctctcagttttccctgaggatgatacagagctaattccattctagatacagagaagttagttcacgccatacaatagaatggcatcaggatttacatctctttagaaccctggttgagaaaggctgggttagacagagaaactgaggcagagggattgaaaaacatgcagataccagctacagtggaagataggagtaagataccagtctaaaaacactaagcgaaagtctgctccctgaataaggaggctcacagtccccatcctctgctaagctcccagccacttgcttatacctctagctggatataggaggattcttcaaattgaccctatgatgcccacagtcgtgaaactctatctagtgtctccccattaaatgtgaaccaaagtcaaaatcacctgacatatgaggaaagccgcctgtgtgaacgacagggaccaaagcaagccacaccaactaaagaaaaggaactctaaagagacagacacagtgcaagaaaataaacacatcctaccctcagagaagtagaagatactgcatccaagatgcaagaattgattgctatacaaaagggatagtgagaggataagggtgagcctttgctgattaaaaaggcacttgccaaaaccagagatttccatgaaagggttggtagataaaaatcaaggaaatctttcagaaggtagaacatgatgacgaaatgatgatcaataggaaggaaatcataagaaaattaaagggtcaacctaggaagtccttccagaaaaaaagaaatcagaaaaactggtatgtaggggtaatgggatggtaaggagagaattatcaaataaacacacaacttcccagaactgaagaaaatgaaagatgccagcacaattactgaataagaggaataaaccaagccacattcagaacactgaagataaaaaggagatattacaaactttcaagggaaaaaatataaaaagtgactgcaaatcaggaaggcatcaccaggcttctcaacagtattggaaactagaagagaagggaacaatgtcatcaaacaatgctagaatgtaattgtcaaccttgaaatctgtacccagcaaaaatacccatcaattacaagagtagaataaagatatttttagacaggcaatatttaaaaaattataaaatgccatctctcacgcaccctttcttaaaaaggtattgggaaatgtgcactactgaaacaagggagtaaaccatgaaaaagcaacagagagtaaaagaaaggggagagaggctaaagacttttctaggatagtagtgaaggcaggctcagattgaaagccttattgcaaaagtctagaaaataaccagtccaggttagatcagaaagagcaagaattccaggagggaggtcaatttttaaaaaaaatggaactgacaaatgatctgatactttttatgatgtagaaaattgtattaagaggctgttgaagggtaggaagactccaaaatagatacataggatataagcaacactactaccaattaagagaaaagtaaaaaggaaagcaacacaaccttagagagctattgagctcagcatagcatagatgttgcatattgactgtaggataactctgttgggaattgggaggaagggggggtcaatatacaatgtctaaagctgataaatcaatttagaaatacggaggtaagtaccaaagaaaagaaacagctggaagatttacatgtggctgcctctggggcgtgggaagaaggatggggaagggaacaggggagctggttttcattatgagcttcttagtgttattttacttatttttataaaatataattgtagaagacactgacggcctgtttctgccctttcccctctaatccaagcacacttgagttgactcctcatctttcttttctttcctcctctctggacaccgtctccctggctcagaagctggcctgcctcccagggcacacgcctctgcctgagccccagccccaccctccctcctcttcttggatcagctccatctgacatcactcctctctcttctcaacctctctttccttcctccccactagtttcttccttttagcccaagcgtatgtctctctatctaaaactcaggggaaaacagaattttcctctgtccttcaaccctcgataagttagtcagcaaagcatcttaaaatggcaaagcacaggccacccaaactggcccttattttctcccctgtcctcaccaacccgtcaaatcacccttttcctctgaaatccgcccttgttctccctcatccaggcacagagtcctgtttcactcttccttctcctttggtctccccctcctgctccttcacacacaaatttgttgctaagcccagctgattctaatttggaaatattgcttggatccttcattcacaccttttccagaatgctcttagaaagcattctaatcatattattttttgctcaaaaatcttccattgttctccacttctcgtaaaaatcaaactgactctcttcggcctgacgttctgagtcccccgcctcctttggctgccatcagtatgctcactggtacccagctctcatgtgacttccctggcttcgtgcctttaccatgtgcacccctgaaatggcctcttccagcaccctcactgagacaaacggcacccactcctgaagtcgcagttcaaaaccacctcttccatgaagccttcttggattggcccagcaggcttgaacagtcctgcctctgcaccaggaaacaacatgaacctctgggggctctttctgtggttcagacctttcctctctggctgactgatgagtacttgagcatcttaattctctgccatccccagggcctagcacaaggcctggtaactgacattgaacaatttaagtattgggtgaataaaagaaggctcaacctatctatgacaggcgctatgggccatgcaccctaattcctgccagccattaagttgggaaccctaattttgccaaaaataattgccattctggggtcctaacaaggcagttctgatacctataggacagtgatcattctgtcttttactataatccattttaatatatccattacaccctcaacacccagacttgttacactagtggaaggcagaggaaaaagaatgaactaagatattccttgagccagatatcctcagtggatctccttggggagtccgtgcatgagtgccgtggatggctgaaggctccaaagcagcccgccacatcatagcagagacagtcatgaaaaagcgacgtctcactgggatgggtgcccccagccctggcctctcctagctctggcttagtccacagcatcacgtggggtgccgaacgcacacatttatgaccaagtcctaacaaaggctggatagcactctgctcattctggaaagagacctctccagcagccgactgctttctgaactgaacatgtgtttctaattcaagaacagaccatttgaaatgaattcttcataagagccaaggttgctcctcatgtgttttaactcctgaggaatgatagggacagaccagccacactgcaccaggcctgcctgacactccgcacgggtcgggtagggtcacagcctcaccatgggtgaacctgacgtgtagggattaaaggccattccctctcctcgaaagctcctattaaaagtcaatttcaaaaccaaacatcaatttcaacttttattaaaacaaagactttcctaagaaaatccccaataattcatggggctgatgtgctaaaaacgagtgtcttccccctgaactaacaccctcgctcattacaggagtcaggggttgcctgctgtctccaggaagccctgctttctgcaagagccctgagcagctgggctgcaggaggagacctggggaaagggttggccctgttcttggcaactaaggggtgtcttgtcacagagaagaggctgttggagaaagcctggccttagctgttagagcctgtggttgagactcggctgtgggaaagccactgaaaccttgtccatgcaacgggctcaacctgcagtgccctcctgtcatccaggcagaaattgatgccaatcagaccaagcaatggatgtgggtgtgcccttttaatgccccgctatttgtaaaacactgtgcgaatgttaagtgtaattcatcagaagtccagtgaaggtgaaatctgatctccctgccatccagaaggtatacctgctgaccaaatgctgaaactggagaagtattttaaagatgctgatcaagacttcagacttttttttaaaaaaagcatcaaagtgctgacatacagaatgctaggcggatggatggaagatgctttcacagatgactgctctgctgagtggcaaagctctagttcctgggaaataaccccataccatcacggactgaagcatgagaaatgctggactcatcagaaaattcagagaaactgtcgcttgtggtgctaaaatgggcccggggtgagcttagataaaggggctttttcgaggaaacagttggtctcccctgcgggacaggagggcaggccaccaaggtggctgacaagtaggcatgtaaaagtatccctggggctgagaaggcaaacatgcattccctggaatagttctactccaagtcgatgtccatctcaacactgcttttgagctgggcactgtggctcatgcctgcaatcccagtacattaggaggctgcagtgggaggattgcttgaggccaagagttcaagaccagcctttcaacatagccagactctgtctcgacaaaaaattttaaaaagtagctgggcatggtaatgtgtgcttgtagttctggctattcaggaggctgacgcaggaggatagcatgagcccaggagttcaaggctgtagtgagatataatcacaccactgtactccagcctgggcaacagagcaagaccctgtctcaaaaataaatgagtaaataaataaatgaatgaatgaatgctgtttttgaatttggtttgaatgaaaaaaaaaaccctcaagcttataagagggagcactgtgttggttgttaaggcagaagggaccatattgacaccaaaataataagaatccagacataagaatggtgaaactcgtgggatagggctaaatatagaaaatgcgtctaaatttctgcaaagtacaaactcgtggatgttgaaatataaatacagctttagtcatgtgtgctaaaatctgtggcaatacatttgagctggaaagtaatttgctatcacagaaccccgacagagaaggcactcactcagctgagcatcagcagctcttggaatttttaaattttttttagaaattcacaagctgggccgcgcgcggtggctcacgcctgtaatcccagcactttgggaggctgaggtggatggatcacctgaggtcaggagtttgaaaccagcctggccaacatggtgaaaccctgtctctactaaaaatacaaaattagtgggtcgtggtggtgggcgcctgtaatcccagctattcgggtggctgaggcaggagaattgcttgaacccaggaggcagaggttgcagtgagccgagattgtgccactgcactccagcctgggtgacagagcaagactccgctgaaaaaaaataaaatagcaagaaagaaattcacaagctgtttctaaaatttatatggaagcgcataggaggatctatactgcttgattttaagactcactataaagctaaatgagtaagccaccaggagagacctcaaaaactggaacagaatcgagtccgtaagtgggctcacacaaagctgacttctattggtggcgcagtgtcagtcagtggttcattctgtgtcctccctcccccccacctcctctttctttttgggcacagcttacctggggtgggtagatccctctgcctctggggtagccttcaatttccaggactagagctagcggttttttttagttataaatttaattacaaattcctggccctcacctcatccctgctgctgagcagcgatctcctgagtgagccgaggagttttttgtttttgtttttttttaaagatcccagaggcatttatgcatgcagctctgggaaagctccattctccgaacactgcagctctaagttcaaggctaagatgcagtagagcagctgcggtttacacgaaccaaagggcatcgtagaaacctggtgcctacaggataaagggggcgagttgtcaggagttccctatggcctgaatataagcaatttattgagcctttatatgtttataaaactctaagtccatcatgctaccttgggcctaaactctccccaaactcagctgattttgagttggggcaaaggggtcagaatgttggcatcaggcagtgccctggccaggctttctggttaaatagttatttgacaaggctgtgctttttcattcttatagcttaactcaataaaaatagtatgcttaaacctgcagcactcctaaaagaaacgctatgatgaaaattactcagagacatgagcagaaaggggtgggagagcagaaaaaggaagtgatgccattatctctagtgtgctgagatctaagagacatctgtctctacttggaagcgtgacatctggaaagagaagtcccctgcacacagctacgtccctctgccttcccttcctgctcgccaccagcaccccttccttcctctaccgggagaggaacagtgggaaggcagggtccagctgaggctcaacctgtgtgtggggccaggggaagctaaagccagctggggagggcgggctgccccattctccacatgctgctgccactgggctgcaggccgggccagtcctgggtcccaggcagggagtcagcctctgctggtcacccagtgcctgggaggcagaccctgtggccaggacacacccccacttgtggggatacctgtgagtaattccctatgaatcactcatgggtcactcagactcgagtgggggtaaggctgggcaacttggggaaaaggaacaaaagaggatgcctgctgagagagtgtgaaggcctgatgctccccgcacctgtgaaaatgggagcgagtccatctgggaaggagggctcaactccgtggctacactgcatagggaataaagggcctcgagcctcctttccatttataacctaatttgttcataagtgatgagattctgctcaaaaaaactatcgatacacgagatacatgaagctgtgaatgctgaaaagggagatctctaggctttttttttttttttaaagagacaggattatgctgtactgctcaggctggagtgcagtggtgtgatcatagctcactgcagcctcagactcctgggctcaaggggtcctcctgcctcagcctctcaagtaggtggaatcacaggtgcacatcaccacacccagctaatgtttaatttgtacagacaggatctcactgtgttgcccaggctggtcttgaacgcctgtgctcaagtgatcctgctgccttggcctcccaaagtgttgggattacaggcatgagccaccgcgcccagccatttctaaggctttttatactgtctatttgaacgctaattttaaaaacaagaaaaagggaaagcaagaaaaacaaaaaaacctgtggccacctacagcatcaccggagccaccagggcccttcaccctgtgtctgctgtgtttacaggccctctctcttccaaggctggaggcctgggggtttataggtagagaaagggagaaaagttcagtcatgaatagattaaacatccattctagggtatggagggtttaagtaataggtaattttcctgagtgattactaagtccaggacattagttaatcctccactgtttacaagcatggatgagcagggatttcaacggaagtaatcactccccagctcaaaatccttcaatagtttctcacggtacttaaaatccaactcctttatcacagcctagaaagcctgcctgatctcattcctaccctcgctttgacctcattgctgatgaccttctgccttgcttatacgcttggccataccactattctgggtttttcaaaagaacttcctcatagcctttgagaatgctgttccctctgcctggaccattttctcaaaagtatatatttttttgtattttttgtagggacagggactccctgtgttgcccaggctggtctcgaactcttgggctcaagcgatacacccgtctgagcctcgcaaagtgctgggattacaggcgtaagccactgtgcccagacttgtggaccttttgtctcccgacccccatctccaaaaaaaaaattgtccaggtgcactggctcatgcccgtaattcccagcacatgtaattacagcacatgcctgaatcccaggctgaggcaggcgaatcactggagtccaagagtttgagaccagcctgggcaacatggtgaaacccatctctaaaaaaataaataaataaataacaaaaaattagctgggtgcgatggcacgtgccagtagtactagctacctgggtggctgaggtgggaggatcacctgaacctaggaaagttgaggctgcagttagctgtgattgcaccactgtactctagcctgggtgacagagcaagatcctgtctcaaatatatatatatctgaccgggtgcaatgtctcatgcttgtaatcccagcactttgggaggctgagatgggtggatcacctgaggtcaggagttcgagaccagcctgactaacatggtgaaaccttgtctctactaaaaatacaaaaattagctggatgtggtggcaggcacctgtaatcccagctacttgggaggctgaagcaggagaatcgcttgaacccgggaggcggaggttgcagtgagccaagatcacgccactgcactccagccccagcaacaaagggagactccatctcaaaaacaattatatatatttatttattcattatatatatgcaatatatacatatgctatatatatatatgcccttaacagaaggatataaaagagacttagatctatttaagcatcagctgaaggcccttcttctcccctgttggctgcttcttggataattcagcctcacctcagtgatgcttccaaaggaaacaggatctgtgaagagggcaacaggctgagtagaaacagcacagtgtgtgttcccggtctggcgatctgcttactggtccaaaaccatcacacatcttcacctctggatctgtgctcactgtggtagatatcatgaccaccattaatcccccttccctccccaaacataccagccacatcacccttcaagagcagacctgctttgacaatagaatgtggcagtgatgccactccagctctgggctagcctgtgggaggcccagcagcttccactttcccttgacagtcgccatagtctgactacttgacaccgccatgctgtgaggaagcccaggttggccacatggagagaggggccaggtggaggagcaccgaggcaccagacatatgactgagtcttcacagaccttccagtcaaccgcaagctgaatgcagctgagtgggcgactcaagctgatgccacatagagcagaagaaccgctgagccaagccctgccggggttcctgacctacagaataatggaaactaatacatctttgttgttttaagccagcaagatttggaatgggttgttataaagcaataaatagctaatccacaatgtcctcccctcctgctttctgaatcccacccatccctcaatcagatccagtaacacctcctcctggaagcttctctcatctcaccttattcctcaccccatcagcctctgtactctgctcggtaaatacctacactgagggctcagctcagggctctctcctgagaatccctccctgacttccactgtgggtgcttctctgaacactcaaggtggctcatgcacaccacaccccattcctgtgaccatctgtctgcttgtttccccatcagacttttatccacatactcccccacacagccattacctaccacataataggggctcagtaagagcttatgaactaaagggataaactgctatgccacaaacaatctcattcatctctctgcagacctgtgagtctctttcccactgtgattgcaaatgctttagaataaggattatgcctacttatctccaggtcccccaagagccttgcacatcgtaggcactcaataaacattctgttgacttttaactgattgacatgtcactttcattgtgaccttagctccagattctcccatgcacctctgatactcaggttccaggtctcctagacctggatgctagacaagggcagaggaggctctgcttgtttatttctggctcttttccaatcaatgaaattctcaaaactccatgcagtctacactcaccacaatgagttcagtccaaagggataatgttttgtatggcacattctcttttaaaagaattcaccccccaactcctactgcaacagacaaatgcgaaaatgttaacacagcttcccacgccaccagggagttccaaatcaactggaaatatctgattcaacctgttatcgtaagacacagaccagacagcgttgtcaccacaagggacaatcattctatgaacacatacatggtcttgtgacctctactcaacattccagagatagaggagctgagtggccctggagtgggggaagggctgggttataaatagtgaggtgcagtgggctggacactcgggtggcggccagattcctggtcctcctgggcctaggtgactcgtcatctgcaagataagcacagtgctctggggacatccagggcattttcccacctacctcggaccctctccaccctcctgagctgccaggacctggccctggctctccctgaccaagccagagctcgcctgcttcccacgttctagcctacgctgccttgggttttatgtctcatctgggacttgatcataaaatcccaaggttcacagaggccatgaaatctcagttccttgtgcaagggcctgtgtcacccagagcggaaccaggtcagggaggtaaaagtcccaaaggcaaggatgggagaaaagaaaacagggagggggaggtcaggaataggttccttctagcacaaagcaggcccctcaacaagtccccatggaccaagtaagtctgcactcagttctgggagacacacagtcatcatggctggactgcaagaaaacaattcttggacgcagcctggcctggtttccatcctggctcccccactgaacagccacatgactttgggcacattttccctgttggaaaacagcctttctgtgaggccatgataggattcagtccccctgaagtgaccaagccagtgctgtacatagaaagtgttcaaaaacgcgagctccctcttccttcctttcacgcccagactccgactagagagggctagcttatgtctgaggctgtctcagagtacaaacccaggtacaagagaagctctgtcctttgagaaggctgcgtttagcacccacaagtaacaaaaaaatcttattacatatattattcattcattcacattcattcattcaacaaacatttgttgagtgcctaaggtgtagccagcattgctctcagcactactgctgagcttcctggatgcaggcactatggagctttagatactacctgtccctaaactgctctcatccacggtcctgtctgtgtctggaaacaaatatgacagcatcctatctgccatcagctaagccctgaagatgataacgacacagataaaaagtgatgcttgaagagaggtacgtaggagactccctaggtagaagagaggacaacacccactgccccaagctgttatgccaaaaatctgaccccaactctgagctcaccagcctgattctacagataatattttgctatccatctgtgggaagaaccagttttccttttttattttcaatgtgttgtgaactgatatttttgtaaattacgtagatcatgtgcttaaatactgcaatgttgtttgtttatttatttgagatggagcctcactctgttgcccaggctggagtgcagtgatgcaatctcggctcaccttaacctctgcctcccaggttcaagcaattctcccacctcagcctcccgactagctgggactacaggcgcgtgccaccacacccagctaatttttgtatttttagtagggacggattttcgccatgttggccaggttgatctcgaatgcctgacctcaggtgatccaccctcctttgactcccagagtgctgggattacaggcatgagccactgcaaccagtctgtcaaattattttagaagttcctaaatattaacactgagaatatatatttatcttattgctactcagcaccagataattcaggcaccaatctatgaaccacatttgggtaggactgatggcatttagttcattccgtgaactgtccaaaatctagcataatactgtcacatttttacctcatgaagtttcaacaatatcaaaaatgaacaaaaaattatttttaaaatgttgttgcgtgctgcaaagaaatacaagaaatagaattgtaatattcaacttacttgctgatggctgaaatttgaccagatcttgcaaatcagtagaaatctggaagacgtggctgtagaactgctggactgaattcttcaggccagaaatgtctctggaatgcgacctgagcgttccgttcatctgcctgacacagttccacaggctgctgacatgcttgttgagcccctccttgatcctctgaagatttcctgagatagagtccagcttgctgcaagttttctccatatgagacaccctgccctccaccatggagacctccctctggaccccctgcgtgcattccttacaagcatccagctccgagatgacctggctctgcaacctctgccacctctcctccagctgactgcagcaatgagccacggggtgctggggggacggcagggtgtccactgtcctttcttgctcacccaccttagtgaacctacccatgccagcgttttcacctgctctacaattgctcatttccttttgaagatgagtcacatcattttctgtgtggtttaattgagaataaagaaaactaaaatcctgttgaagtttctggatggtttgttcggtttcttgaaacttcctgtgcatcgtgtcgttgagagatttcaaaaggtgcaggctgtcgcgtactgcgcggtcttccctgtttggcaaggcaccttccatcccatgaggctttccctggatgttcagcaggcaaatgtcttcaacaacttgaactttgtccttcaggtggtttaattccatcatgacccgttcatctcctgaccctgacactcctggcagggctgctgcccctgggggactgagctctgcaccagtgttattggtcatctgtaggagaacgctccccagacggtcttccagagactgtattttctgatcaacaagctgcttcaagtcacccacctctccattaatggcgccccgaagggtttcctcaatgtaaaagcaatgttcttcagcgttcttctccgtcacattgatccttgcatcgagttcattccattttgcatcaaaatccacatctggctctggaactataaggcggtcaaactcattgtccagtcttccattcagcattctggtggcttcagcaactctctcgattttctggtccaatgtcttgatctgttgaccaatgtcaccattcttttcactgtcgcagcaatttgcctgggctgaaggctcctgtagccgggctcggaggttatttatttcttttctcaggcttgtttccttctcccctatgagctctatcactcccaggtagctgctcccatagtcatcacactgctgctggaggccagtgagcttgtactcacatgagtttttcaggtcagccagctttctgtccatgccctccatgagctcctctctcagggcgtcgatcttactgtccacataggcttggtagagttcgttggttgtcatggtcaccgtcgggccctgagctgcttcctggagctgtctgagctgcccttcgtagcccttcacttttccatccagctcttccagcttgtcacttttgttctttagagtatctttgacttcagccaattcagacttgatgtccttcatgccagattccttagtgttgaagacaccaggactctggcccgtttctgtgtctccactaacagtggtgtcaggcttggggtgctggctgctgagccctggtgcccgtgttctactggcatcatcctgagtggcatgtttgagattttcactcactccagcaagggaagactggaggtcaagaaccgtccttgtgagtcgaagaaccttctcctctagcacctgtatcttcttttcctgaagttcctgaggcccctcttttggatctaccccccagcttggttgtgctgtaccagttggggacaaagtcttcctgggctctgagaattggctgggttcattatctgttacaaagataaagttggacatgaatgaacattttctacctttagccagattctgccaagacaataaacaaggtacctacaaaatacatgtacatcttcacttacaggtcactacacaattgtaggtaagtactgtggtacagtagaaaagagtatgggctttgtagtcaaatagacctctacttgcattctggctctgctatttactgtttgtccttgagcaagttaactaacttctgtgaactataatcctctcatctataaagaagaacagcttctagagctgttaaaataatatgtacatgacacctattagataatcaatggtctctttcaccctgaggggaaatattcattatccgctttatcatatgaacacttcattcccatattagtgaactgcagccacaccccaagagttgactgcatacagtaaaaccacaagaaaccactttagcaagatccacccattagctgttggatggtgatatcatatgatatcatattttctgatgttatcctcaaagcagtgcctgaatgttttgtcctttactttcattaacatctctgtgctcaaagagtctcacagacattgtttagccctgcttgcagtttgggagacaaaaagcaacagagataaagcaactattcatcagtgtctcctagcaacagcaccgtctgaccatatatagtaagattcactacgtcaaagaatgcaaatattgaaagctggtcagggaggtggtgtgtgcctgtagtctcagttactagggaggcaggaagatggcgtgagcccaggagttcaagggcatccttggcaatatagcaagaccctgtatctttaaaaaaaaaaaaaaaaaaaaagaaaagaaaaaaagaagaagaatgcaaacattgaattttgggtaatcttattttgagaaaacaccaaggaaaaaatccaaaagaaagaaacaattattaatttttaataaggggggaatgatagtgatgagtcataaaatgaagataaattgatagacatagaggtaaataaaaaggagactattgaaacctgcagcaataggacaataagaaacaaactatgccctgaatacagcaggatacaagaaatactgcatccggccatgatggctcatgcctgtagtcccagcactttggaaggctgaggtgggtggattgcttgaggataggagttcaagaccagcctggccaacatggcgtaaccccatctctactaaaaatacaaaaatcagccaggtgtggtggctggtgcctgtaatcccagctactagggaggctgagacagaaaaatcgcttgaacccaggaggcggaggttgcagtgagccgacatagtgccgctgtactccagtctgggcaacagagagagaccctgtctcaaaaaaaaaaaaaaaaaaaaagaaaagaaagaaatgaaaaggaaagaaaaagaaaaagaaagaaagaaatactgaaagaggttaacactgacaaacctggcaactatagtgagacatataaagtggaaaaaatcaaacacaacataggttgcaattaaataaaatgcattaatatattacactggaaaacattggaaattaattcagaatgttgtagatatttgaattcaacgatcattgttttttcctcctctgaacttttgcacaagctcataatagcagctattatttattaaaatcaagttagtggtaaaaccaaatctgaaattcagatatccaaatcccccaagaatcattctttttgcagagagctacaaataacaccttgttttccttactgaaatatttattctctctctctctctttttttttttttttttttgagacagaatctccctctgttgcccaggctggagtgcagtggtgctatctcggctcactgcaagctctgcctctcgggttcacgccattctcctgcctcagcctcccgagtagctgggactacaggtgcccaccaccatgcccggctaattttttgtatttttggtagagatggggtttcactgtgttagccaggatggtctccatctcctgaccttgtgatccacccgcctcggcctcccaaagtgctgggattacagacgtgagccaccgcgcccggccgttattctctcttaagacactaaagaaaaaaacaagttactgaatcatgtgcaagtggaatgctattctaagcaaaggaaataaaaacaaagggcggcaaaggggggaagattgaggatgtaaggaaatgctttgctcatataccacggtgactgtgcaaattgcatttttttcaaaggataatttggcaacatgtatcaaaatactcagaatcttttgaccctacaattacacttcaagaaatttattctagtgaataatcagaaatgagtgcaaaaatttaacaggaaaagatgcatattcatatattatctataatagtgaaaaattacaaacaacctaagtgaccaacagtagaggatggtgttcaataactcacattctctcaagccattaagtagtattgtagaatatttcatgacatggaaggttgtccattataggttattcaataaaaaataagttccaggtcgagtgcagtggttctgcctgtaaccccagcactttgggatgctgaggtgggaggatcacttgagtccaggagttcaaggttgtgagcagtaatcatgccactacactccagcctgggttacagagcaagaccctgtctctaaaatagaaaaagttgtaaaaatagtattttttttataatgacagtgaattcagggtatgtttgtccattctgtattgaaataaaggaatatctgagactgggtaatttgtgaagaaaagaggtttatttggctcacagttttgtaggctgtacaagaaacatggtgtcagcaactgcttctggtcaggacctcaggaagcttctactcatgacggaaggtgaaaagagggccagtgtgtcacatggtaagagagggagcgagagggagcaagagggaagggagaaggtgccaggctcttccaaccaaccagctctcatgtgtactaacagagcaagaactcatttattaccgcaaggagggtaccaagccattcatgaaggatcaacctccatgacccaaacacctcccatgataccccatctcccacattgaagatcacattgcaacatgagatttggaggggacaaacattcaaactatatcagaggaaaagcatttctttttactccttcctaaaatcccactaaaaggacaaaataaaaggaggagggagacaaaaaaacctactcaagtcacacacaaaaaactgggagtcagaaaagttttggtgtttttttagcagcaatattggaagctagagaaaaactgagcactattgtcaaaattctgaaggaaagtgatttctgacctagatttctgaagctagaataaaaaatagtgttcatactataaagtggtaaaaagtttgcttcccatgtaattgtctcatgaagctactaaaggacatgctcaagcaaagcaaggggctaagccaagaaagagggagcaggggacacaggaaacagggaattcaacaggagaggggcaagttaagatcctcgggtgatgacaggaaaagaggatgtcccgtccaggtagggcaagtgagaaggctcaagggagacttcttcaagaagatgaaaatgctgtgtctgaacatatggaggggacatttagagagccagagaagagttgggttgaaatagcaataaaaagagagaaaactaagcaaaggaaaaacataagacaatgatttaactgtaaggaatcaaaaagctgtgtaggaaagaaaatctattcatagtacaccacatggctcagctgtaaacattatctacatagttactacaatgtaaacactgaatactgagtaaataaagaatatggtctaactgtatggaagggatggggggataggagccatgtgttgaggagtggatgaaagggagttaaattctcaccttccataatgaaaaaccaatagatatggaggtaaattccaaaagattcatctgaagagtttaaagtactacccatgggaagggaaaatgagaaaaagggtttcagggtggtcattgtttttcctattagtccttataaagctattcaacttattaaactacaatatgcttaaacttctgtcaaacaaaaactaaaatgaaacaaaacaaaaataaatgattacaatccaccagcccccatgtcatgttccctccatcccagtatctgtcatgaattattgtaattactctctaatgtctgccttccatgaagtcagggactctgtctgccttttttctcacttattccaagtacccagtatagagcctgacagatatagaagttcaataaatatttgtgagataaatgaatttttctttaacaaaatcaatgtacagacataggaaagagagtaaggttctataacaaaatgtcaacagtagttctcatttagtcatgagattatgtatccttaaatatttttcaaacattctttaattgatgtgcattacttttgtagttaaaaagtcattttaaaatctatttttacagacaatgttgggaagaactacgagtttcaaacctgagaacacctcatggcaaaatataatcatttaagcatctaatttcataagaaaacctaggctgcatttattgtgactgaacttaaaaagatgaagtgatggccaggcacagtggctcacgcctgtaatcccagcactttgggaggccgaggtgggcagatcacttgaggtcaggagttggagaccagcctggccaacatggtgaaaccccatctctaccaaaagtacaaaaatcagccgggcatggtggcaggcgcctgtaatcccagctactcggaggccaaggcaggagaattgcttgaaccaggtaggcagaggttgcagtgaaccgagattgcgccactgcactccagcctgggcgacagagcgagactccatctcaaaaaaataaaaaataaaaaacaattttaacccccctaaattcagatgtatgggcccaagtaaaaacaaacagtacatcattacatctgaatctctttacagctgtgcctccaggtgacacaagtctgaacccactggcatttcctaccctgatgtttaaggcattggctttcacaacaagctggccctagcaaagcaatttacttgcaaggaagtttgtcttacaattgctactgctcctgagaataaatttgtcacatgtggctactgcaggtatctatgtgtgttattcgaaggccattcaaagctcaccattgtaaagcacaaatcctgttgtttgaaggagcaccggaaatattaaaggtggccatacataatagcacaaataagaagttacctgtggctttcttcaagctgtttcgaggccgagccggcgtggggcggagggtcttcacggggtctttgggaccttcttggcaatctccccctctaaagccaggacagcacctccattccaactgtgtcactgtcttatacctagtgacatatctaggtctgaagttcactcgatacctgtggacagaagggatggcatctctctttactggctgccgttacaagcaacttccggcgctagacccaaataaagaggactcagggcatgcaggaccctgcctgctctccaggctggcccagaggggatgttggtctcctcagtccagatctgactggggggttcagcctaactcagatcagcctcaggaaggcaggggctccccaatcctccacctgccctgagcacccgtttcccagcaaggggaacacacagcttagaaaatctccaccaagactcccatttgagaaggatacttttcagcccccaaactgagcttttgtttcaccaaacttctgttctacaattcagtttgtggggatttgtttcaggtgtcactagagattgttttgttttgtgttttaaagaaatattcctggccgggcacagtggctcatgcctgtaatcccagcactttgggaggctgaggccagcagatcacttgaggccaggagttcgagactagcctggctaacatggtgaaatctagtctctacaaaaatacgaaacttagccaggtgttgtggcgcatgcctgtagtcccagctaccgctgaggcacgagaattgtttgaatccagaaggcggaggttgcagtgagctgagatcacgccattgcactccagcctgggagacacagcgagactgtctcaaaaaaaagaaaaagaggctgggcgcggtggctcacgcctgtaatctgagcactttgggaggccgaggcaggcggatcacgaggtcaggagatcgagaccatcctggctaacacggtgaaaccccgtctctactaaaaatacaaaaacattagccgggcgtgatggcgtgcgcctgtagtcccagctccttgggaggctgaggcaggagaatggcgtgaacccgggaggtggagcttgcagtgagccgagatcgcgccactgcactccagcctgggtgacagagcaagactccaactcaaaaaaaataaaaagaaagaaagaaacatccctggcaccctgctctccatcatgtctgtgtgtttaccgctgcacctccctttcctgatgctagcaaaggtagccaccagcttttgcagatggcagctcacactatttgtgtccactttttacaaagatgccctggttcatactgtcaatgacagaaatcaggaagcagaattggaagcactcaaaaagtcctgttgacagtgcacatcccctcatgccctggaatatcacacagagagctttgcagtgagctggaaagtcctccagactcaaggccgggcctgggcccacaacagactttgacagccctgcagtcccgggctcaccagggaaggagccaggagttcagcccccgcagcggcccctgctcacagcacaggcaaaagccacagccacacaggatggggcctccctacttcagcccaattgtgatttcctgccttgcaaatcatctctcttgaagctcttcagctcctcttcatttcttacaccagcaccagcagctggccttcttcttgagccaattcccagaaagcaataggctgagtgtcactttttcagggttgctgagagctgcccatggggggaggcgggacaatagcagcagcggggttacccagcaaagcaactccctcccaagcaccagccctgtggcaggtggacttcaaagttacctccctgaggaaagcacaaatcatgtgctggacctttgacatgtgagggacctttgacatcctccccgagggtcacacactgacaattacactctgggtataggatccaccccgctgggactggctaggcaccctgcagaatcccaagagggccctgccgacagctaggacccgccaagcccattagacctcctagcaccttccactgtccctgtttcctttggtttttgttgtgttttttgttttgtagagataagtatcacttggtcgcccaggctggagtgcagtggtacaatcatggtacactgcaacctcaaactcctgggctcaagtgatcctccacctcggcctcccaaaatgctgagattacaggcaccatgcctgggtcatattttttttttttgagatgatgtttcactctcgttgcccaggctggagtacaatggcgcgatctcggctcactgcaacctctgcctcccgggttcaagcgattcgcctgcctcagcctcccaagtagctgggattacaggcacccaccaccatgcctggttattttttgtatttttagtagagacatagtttcaccatgttggctgggctggtcttgaactcctgacctcaggtgatctacccaccctttagcccccaaagtgctgggattacaggtgtgagccactgtgcccagccaatttaaaaaaatttttttaagagatagggtctcactatgttgcccaggctggtctcgagcccatggcctcaagtgatcccccaacctcaaagtgctgggattacaggcatgagccaccacacccggcctgtttgccttgatctttagggcagtggttcttagcctgagccatcagaatcacccaggaaactgtgaaaaaatacccacgcctgggtctcaccctcagaggttttgatttaaggggtctggggtggcagccaggcatgcagatgttagaaagctccagagagccttttccaaggaaaactgaagaggaagcctggtagtaaaatggaaaaacaagggctgctcgggcagttgggaggatgaggagaggaaagaccttccaggctcttccttctctcattgctgtccacctccaccaaggccctactatacattttccccttttcacaagtgaggaaacagaggctcatggggttaagcgacttatccaagttcaaacagcccggaaggggcagggccgttaaacccaagcctcctccctgcaccccacacagccgttctctcaggcgatgccttacattggaggaagcggccccacctggagatgttccagaaggccctaagggctgggtaagaaggtaggcaacccccacttcggccaacccattcctgagcatcccacccgtggccaggtacacaccagccctcggtccccaccaccacctagcaggagtcctctgtgtggtccttggaaatgtaaaaagggaagaaagcatcattgcgctggattgttttgcgttctcaagtagagcataatgctggaagaatgtgtaatctcagaaaaacgtggttcctctgagcattcagactgaatgtgaaatgtgtttgctctcgggttttgttcatcggccaggagatgacggcccaggcctgcatgaagctgtctcagaggaggctgagccaggccaggcagagcacactcctgtgcccattgaagaggaacggcccccactccagcccagcagcgggctgtgacctctgtcatgccccagagcggaagaaaggccttgctgtgccaacacactttgttcttttctttcaaggcaattttattttggggccagctccccagctcctaatgtaggaaagttccctggagcctggagcccccacccctcccactctacacatgttccccactcctgctccgcgtctaatctgcctgctgttgagtttctggccaagggagttcaggttgaggcgctcctgacaagttttcaagtctagcatggggaagaggacttcctggctggcatcaacagttggaatccatcagcagccacctcctgcggtgagaaagctccctagggatgtcgcatgacgatgacaaagctggatctcagaggtggccttgggccctgctagtcagccctcgggctcagttgggagctcagggggaggtggagatgaaagggttgtccaatcccaaatccctactgggattttcccagcagaaaggggttcccactaagacagtagccagctagaagctttcctagaggatggggagcaacaaaggaggattctgggtcaccctcttcatcacccaaggcactgcaggaaaatagctagtgagctttagaaaatgccaaggaattttcagcaaaattataccttaattggtggagggtgctcgtacctttctaaaagtccccaagtcgttgtcaagtgcagccaaagtggaaaagccccagacccaggacccacttcctcccttcagggaatcggccaccctcctaagaggaccaggcaggggacatgaaacagagacaggcggcccaagcatccccaggggccccgggctgtgagcacacgggagatgctcactcgatacagaatcagtcaactaactgcagtgtgggggtggccaagccgagggacccgcagccagaggaaaagttaaggcggcggggctgcgcagcgctggaggggcggactcggctgcagccctggctcccttcccagcctcggctgtgactgtgatggtgccccagccctctggagagccccgtccacagctgccttgggtatgggcgggggcggcccttggggctgtaaccctgggcctgtcgccctgccgcctcgcccctgtgaactctcccccattccagccaagtctcctttgcccgcctcttcctctaaaacccttttcggaggtgaaaacaagggtttcccattttaatgggttcagcaaccgtgtcaagacactagactggcccaggagattctaatgagaaggaaggtgtcaaaaaaaaaagtcctggaaaagttgtgtcagcgtccagggaccatatgactggaagtgtccctgttaaaacaaaatgacagtacctccacttgatgtcacccccacaaagactccttctactgactcaagttgagacctccttcataacacgcctcagttcacacttgtgtttgcttactccgtgtttgtcctccctgccagactgtaagccccatgaggatagaattcctgttggttttgttcactataacatcccatttttaaaaattaatatactaggctgggcacagtggctcatgcctgcaatcctagcactctgggaggccaaggactgaggattgctgagctcaggagttcgagaacagcctgggcaacatagcaaaacctcatctctactaaaaatctttaaaagttagccacgcatggtgatgcacacctcttatcccagctacttgggaggctgacgcaggaggatcatatgagcccttgaatttgagactgcagtgagccatgatcacacccattgcactccagcctgggcgacagagaccatacctcaaaaaataaatcaatcaaattaatatacttaactttctttttttggggggggtgttgggggcagggaggacggagtctctctctgtcgctcaggctggagtgcagtggtgcgatcttggctcactgcaacctctgcctcctgggctcaagcgattctcctgcctcagcctccctagtagctgggattacaggcatgtgccaccacgcctggctaatttttttgtatttttcttagagaccgggtttctccatgttggtcaggctggtctcgaactcccaacctcaggtgatccgcccgccttggcctcccaaagggctgggattacaagcatgagctactgcgcctggcatggctgttaacatttaaaccaattaagattgaacattttgttcctcagtcaaactagtgtatttcacagacttaacagcacaaatgccagtggccgcacttgcagtgttgggcagcgtgaacatctccatcatcgcagaatattctacctgacagggctgcgctggggattcatgagactgttgagtaatcagcagcaggcgcgcatctgttcacgtcttgatccctaacccccatcaacccatcttctctctcccccgacatccattccagacctacgaatggaatcttccctgaaaatacccacatgtcccagagggaatcatcccaggggaccatctcgccagctgctccacaaggcaaggctccttgccttgtgtttacagcactgacctgggttttattttgacacaggctactaaaactgcacagaaccaaaacccgttgcccccttggggacactcgcttaatgggatttctctggagagccgacttttagtaaatccctctccttccagtcattggttgcccccagaggcctggagccagctcttcttgctccattcatgtgtgtgggaacacagtattgactggaacggagccgggaggatggaggaagaaaccagaaaggaggtgtttccccagggatggtaggaagtaccctagccaggcaggggggaagaactgcctgccccaaagaaggaaaatgagcattgccagaagactccaattctcacacagggcagactgggttgggttacccggaatccgctactgcactaagtttccacagagcagttcattccagccacagtaattcattcttttcaagttttggtaaaatacacataacatgaaatttagcctcttttttttttttccttccttgagacagagtctcactctgttgcccaggctggagtgcagtggcgtgatctcggctcactgcaacctccacctccagggttcaagtgattctcctgcctcaatctcgcaaatagctaagattacaggcacctgccaccacacctggctaaattttgtatttttagtagagacagggtcttgccatgttggccaagctggtctcgaactcctgacctcaggtggtctgccggcctccgcctcccaaaatgctgggattacaggtgtgagccaccacacccggccacctgaaatttagcatcttaaccacttttaagcatacaattgtgcggtgttaagcacacttacgttgttatgtaatcatcaccactaaccacctccagaactgtttcaccttcccaaactgaaagtctgttcccattaaacaccatctccccattcccctctgcccccagtccctggaaaccaccactgtacattctccatgaatttgatgactcttatacctcatttgagtgcaatcatagagtatttgtctctttgcgactggcttatttcacttagcgtaatgtccttaaggctcatccaggtcacagtgtgtcagaatttccttcctttttacacagcaattcacttttacaaagttgacttcagtgttctaatttagaaattcgcaagacagtggactggttttctttctttttttttttttttgagatggaatgtcagtctgtcacccaggcaggagtgcagaggtgcgatctcagctcactgcaacctccacctcctgggttcaagtgattctcctgcctcagcctcctgagtagctgggattacaggtgcaggccaccacgcctggctaattttttgtatttttagtagagatggggttttgccatgttggtcaggctggtctcaactactgacctcaggtggtccgcccacctcagcctcccaaagtgttgggataacaggccaccgcgcccagccagtagactgattttctagaaactacttatgacaaatgttttgtttgtaaaaaaaaaaaaaaaaactgtcagtcaatgaataaaaaataagcttttgtcttagacgatgtggtatgagaaaaaaaaagagggctttttatatttattgacactttgctaaacatgttgggcagtagaggctataaagtctgaaataggaagtgatttcaaaactaggtcgaaggaaaagtagttctgtccagtggaagaaacatttcccatttgaatctactttgtcctactgacagtcaaaaattggccatttgaaaccatgtgcatctataaagccaatctctgcatgttaggaggtgcactctgaccccggagatcccttccaatgcaaacattccacagtctgaaacagtctcccactccagataaagtcaaggaaccaaaggaccttcttgcagcttaaagcacatcaaatgccaaaatcagaattttcatcttatctctttctgctacatcacatattttaatcagatctctacatggagaaattaataacatgaaagcaaagaaatgtgaaatatttcacttggccttttaggaaaattcatctaaattctaaaagccagaatgctcgggcaaatatatttctgaaacacaaaatgtatccagtgaatctaaaaggttgaagagccctgataaaaatcagattacaatgtagctttgtacatatatctatatattttttgagacagagtctcactctgtctcccaggctggagtgcagtggcactatcttggctcactgcaagctccgcctcccgggttcacgccattctcctgcctcagcctcccgagtagctgggactacaggcgcccgccaccacacccggctaattttttgtatttttagtagagacggggtttcaccgtgttagccaggatggtctcgatctcctgaccttgtgatccacccacctcggcctcccaaagtgctgggattacaggcgtgagccaccgcgcctggtgctttgtacgtatttttaaaataacagatctaagaccaatgcagtgtgttcaaaatgaaaatattctacaggagactgtttcccagtacaaaagatatatctgctggagaaatcacaattgtaagctgcttatttttccatttcctcttgaattaatttccttatcacatagagtaacaagctagcttttaaaatctaaaaccctggccgggcgcgttggctcatgtctgtaatcccagcactttgggaggccgaggcgggtggatcacgaggtcaagagatcgagaccatcctggctaacattgtgaaaccccgtctctactaaaaatacaaaaaattagctgggtgtggtggcacgtgcctgttgtctcagcttctcaggaggctgaggcaggagaatcgcttgaacccaggaggcagaggttgcagtgagctaagatcgcgccactgcactccagcctgggtgacagagcgagactccatctcaaaaaaaaaaaaaaaaatctaaaatccttttcacttctcagtatttttgccctgatcatatagggtaatgaatagaagttttccccacaatttatcaccccccatatcccaaaagacagaactattctacagtccaaaagaaaggtgatgaaagaaaaccacagcagctctgctgcgaggcttggtcccaacttggctgcagcagacagtgaagttgttattcttagatttgctaggagagccgtaccttccttctgagcaaactcacatggctaaaaatgacatcatctccaactgcaggctgcgcccaaccccttgaaatatagctcatgcatgccttccactgtgggagacgcatcacaaaactcaaggcactgccctaagcgtggggaggtggggagtgagtgtggggcatcccacgagccttagctaactggcatggctgaaccatcgaagacttgatggaggcccacaccctcctaaagaattattttggggagggccattgctgctgcaggctgtttcagccaaatacattctatactatcccattctgaaacagacatcatgtttcctcattcctggaggcagaatcacagaacactggtctcacgatccctccctcatcagctccccgagtgttcccacggcacggccatgagaacatctgctggcctgagccatgagcgtggtgctcaccatgaagcgaccctccctccgtggacttgtgatccaaccctttctattcagagctgctgaacaactctattttgattacttcctttcttttttaatggcccaagttctcctacaaaagtcacaagaatgactgacatcctttctcctgctcttcccttgacctgggctttcactggtttgcagcaccggcacccctccctcttcaaggactttggtcaccctgtgctttctcttcccaggtgccacatcctccagccacacttcagcatgtagctgcccatccactgttctcagtgttgcttttagatcctgtacatcaagagaagtggccgtgacatcccacttggaatcaatttcagacctttgggtgaaggccacagatgctgacaagctcttaaacaggccacgcctgtaaacggtgccagtcactcagaagcatcgaaaatctggagacattaagagtttctttgcagatttaaacatagtttcttcctttcggaaaatttcttctcgtttttaaaaaatctagatttgaaaacacaggaacacttatatttctgttctaatttatgaccatatggaaggaaaaggacccaaacattataacctagtttcaaatttcttccatagtccaggctaacacagtattactatgtttttgaaattcacacttcacatagtgaggtgcagatgttttcattcgcctgtactctgctcagaaggggcatggtgtttctggaaaaaagtgccagagcccaacccacctccaggcctggagggatggacagcaccaaggaggggagggggctgcttagcgagataaagagaagaactgatgcaaagttattttccccattctgtatgtcaccgcatgtcttcagcaaacgatggtacacacacacacacaggaatctatccaacaacaaaaagtaatcaactacagctgggtgcagtggtgcacacctggagtcctagccactcaggaggctaaggaggaaggattacttaagcccaggagtttgagaccagcctgggcaatataatgagacactgtctcttaaaaaaaacaacaacaagaagtaatcaactactaatacatactattatacaacatgaatgtgtttatttgctcttaaatgggagcggtgatggaggaggtggccatgaggggtaagaaggaaagaggagcttttctccaggacaaatcagggtggccaacggacttttaaggttggtgacaactatgatgtcctttaagtcatttgtgttttgacagtcatcagtaaagtcctcacagcttatgcaggcttgtgggactgtacttctattggagaacttgagggtataaggtttgataccacggccaacccagagtggttcagagagctagcggagaacttaggaggccgcaggacactaagccttgggaattgcccgtctacagggaagatttggggctgctacaactcctgtacttcaagaggaatgagacacatatatagacttttggggtgaagaggaacccaactgacatctgttcacgattttttccattttttaaatttttatttatttatttatttattttgagatggagtcttgctctgtcgcccaggctggagtgcagtgacgcgatcttggctcactgcaagctccgcctcctgggttcacgccattctcctgcctcagcctcccgagtagctgggactacaggcgcccgccaccacgcccggctaattttttgtatttttagtagagatggggtttcaccgtgttagccaggatggtctcgatctcctgacctcgtgatccacccgcctcggcctcccaaagtgctgggattacaggcgtgagctaccgcgcccagctatttatttattttgttgagacggaatcttactctgtcacccaggctggagtgcagtggtacaatcttggctcactgcaatctctgcctcctgggttcaagtgattctcctacctcaacctcctgagtagccgggattacaggcatgtgccaccatgtctgggtaattttgtatttttagtagagatggggtttcgccatgttggccaggctggtcttgaactcctgacctcaggtgatccacctgcctcggcctcccaaagtgctagcattataggcatgagccaccatgcccggccccggcctgtaagtgttaaatataggtggcttgcttcccatttctttaaaattaagtttttggtttttttttttttttttaaatcacataatctgcattattttgttgttttatttaaataaaacacttaagatctgtgggttaagcagtgtttcttgtcctcttaataataaacatgggcataagctagcccacgactcaaaaagacttcactttgcctcaatcaatttttgcaaataaaatataaaaccagacatggtattctcaaagaagccacacaattaatattaaaataattccctatgtgtttagtattcacctttttcaaacaacagttatatctttggtcactgtatcctcttggtaacaccaaactcttctctatagtggcgtgacatgaaccctcgcaatttgaaagctgtgtcatagatcagagagtcacttacagcttagcaaaaaacatgtaaaggtcacactgagattgccaagtaagtaatctacattacaatttacatcattactttggttgatttaactagaatctactgtatcacatcattttagctgcaagctactgctttttcatcgagtattaaaaaccattttcagtccaggcatggtggctcatggctgtaatcccagcactgtgggaggccgaggcaggaggctcgcttgagcttaagggttcgaggccagcctgggcaacatggtgagaccccatatgaattttttattttaaaaaaaccaatttcaaagactatatctctcacaattccatttaaaaaatacaagccatggacagttgttcaaatttatagtctccatgactgaaaattgaaaacccaacccagatcacgtgattcttagtagaaggaaagacaagctaaaaacacatgctttttcatccattcattgagcaacagcagcatcctttggatgcctaccaggtggtacccaggcaccacggcctttcttgagccgtcagtattcaatatgaagcaattatactgatatggaaactatatgaacaataaacatatctctatcatccataacaactgaggtgcactagtcccagcttggccaaagatcagttacatcagacaagacccaaccctgctctaatcctcagttacctcaaatatcaactaagatttataacatttgctcctcttttgccccccagacattgaaaggataaaaaaggaaaaagctttgaaacaataaagctttacagaaatgaaaattatatacaatgtatttatttaccataaggcaaacatttgcaataaaactaaaaacttggattacctccgtaataatggactccattgcccacatgaagggttatagttaatttccgacaatcaggtgatgaataatgaggtcctgaatgtctctcagataaaagcaatcctgccataacctccaaatgacaggccatgaactaattcaacttcttttgcaacacgtggtcctttctagcaataccctcaacagaggagcacacagatccccgctcagtgccaaatctccacgtcctcagaacctgtggagcaggaggaactgcggtcccaggcccaatgctcacaccctccactgccagctgggcatccccctccattctggcacggactgccagtctcctgagtgagtccctcctgtgcccctcaccccacatggtcccccaacccaagtacgttttgcacacacagctgggtagcatttgaaagcacagctctgatgatgtccctgccaggtgtggtggctcacgcctgtaatcacaatacttagggaggcagaggcaggaggatcacttgagcccaggagttcgaggccaggctgggcaacatagcaagaccccatcctccacaaaaaggggggaaaagcccaaatttgatgatgtccccaatgaaagcattcatgaccctcctctgcatggataagaaagcccacactcccaaccacagtgttctggactgaattgtgtgccccccagaaagatattttggagtcccaacccccagtaccggaaaatgtgactttatttggagatagggtctttacagaggtgatcaagttaaaacaagttaaaacaaagtcattagagtgggtactgatccaataggtctagtgtccttagaaaccagggaaaatttagttaacaggtagctaaagaaaaaaagggtggtgggggaatttggagacagagacagacacacacagaagggaagattatgtgaagagacacagggagaagacggacatctacaagccatggagagaggcctggaacagatccttccctcgaagccctcaggagaaccaaccctgctgatgtcttgatctacgaccccctgtggacacccacctccaggtccctgctcgtgtgtcttggcttacgctgaccttggccttctctcacatctgcatatattcaactagaagcttccttcaaagccataagacgtcaccacttgcaaacaagttctcggattcctcctggctggaaataactttcttctacctctgaacaccccagcacgttgtgtttctcttactacaattctcattcccaccttttatgtcgtaattatttatgtttatctttcaattcacttgctagatgtgcactcccagaagccaacagaaagatccttactgtatcactgtagaaactagttctgggccacatgtaggctttgaacaaaaatatttgtttaatgaaacaaatagtcttcaaataataagtcttctttcaagcctgttgagctttctgacaattcaaaatggcttatgctaattatgaatccttaatccaacattttccagggctataaatgtgaaatgttttttacttcattatgtttttatttttatttacttatttcttttgagacagggtctgtcacgtaggctggagtgcagtggcacaatcatagttcactgtagcctcaacctccccagcccaagcgatcctcccacctcagcctcctgagtagctgggaccacaggcgtgcaccaccacgcccagctaatttttgtatttttggtagagactgggttttgccatgttgcccaggctggtctctaacacctgagcccaagtgatccacctgcctcagcctcccaaagtgtcgtgttacaggtgtgagccaccatgcctagtccattattatctagtgttctatatctgtaatgtatttcccatctcagttgttcttcagaaactccgagaagtatccttactatcagtaaaagttattttgcccactctgtatttcaccatatgtcttcagcaactatacaaatgatgctacacacacacacacacacacaacacaaacacacacacacacacagaggaatctatccaacaacaaaaagtaatcaactacagccaggtgcagtggcacacacctggagtcctagccactcaggaggctgaggtgggaggatcgcttaagcccaggagttcaaaaaccagtctgggcaatatagtgagatcccatctcaaaaaaaaaaatcagctactgatacatactacaacatgaatgaatctcaaaatctttctgttcaatgaaagaagccagtcaaaagagagtacaacctgtatgactctatttacataaaactttaaaatatgcaaacttatccctagtgagggaaagtggatcagcagttcccagggagggggtacgtggagagaaactggagggagagattagcaagggatatgttgattgtgatgttggtttcacgggtatatatgtcaaaatattaaactgtacaacttcaaatatgtggcttactcatgtaaattatacttcaattaagcttttttttttaactatgtaatttctgcattaaggtatttttaaatctcttcaaatctgtgaaagggaagtaccagagaagtcttttcttgactatgcaataacatatttcaattacatagaaactaaaatcagcatcattaagtctttgtcaaagtttcagaatgtaggtttaactagagttggttttttaaaaatgtatcagattactcttcagacacataaccaattgtttctgcctatagagaactcaggtctaatatttacttttgttcttttaaaggtattggatcaatgattaaggaagaaagccaaacaggattaaaaaaaaaaaaactcccttcaaactgacatattgtgtaaaataacacaaaacatcacagatgtatgttagcattttgaaaatacaacaagaaaaatgtccaggaccagatggattcacagctaaatcctaacagacatttaaagaagaattggtctccctctccctctccctctcctctttccacggtctccctctgatgctgagccgaagctggactgtgctgctgccatctcggctcactgcagcctccctgcctgattctcctgcctcagcctgccgagtgcctgcgattgcaggcgcgcgcccccacgcctgactggttttcgtatttttttggtggagacggggtttcgctgtgttggccgggctggtctccagctcctaaccgcgagtgatccgccagcctcggcctcccgaggtgccgggattgcagagggagcctcgttcactcagtgctcaatggtgcccaggctggagtgcagtggtgtgatcttggctggctgcaaccacctcccagccgcctgccttggcctcccaaagagccgagattgcagtctctgcccagccgccaccctgtcggggaagtgaggagtgtctctgcgtggccgcccatcgtctgggatgtgaggagcccctctgcctggctgcccagtctggaaagtgaggagcgcctcttccccgccgccatcccatctaggaagtgaggagcgtctctgcctggccgcccatcgtctgagatgtggggagcgcctctgccccgccgccccatctgggatgtgaggagcgtctctgcccagccaccccgtctgagaagtgaggagaccctctgcctggcaaccgccccatctgagaagtcaggagtccctccacccggcagccgctccatctgagaagtgaggagccccgtccagcagccaccccgtctgggaagtgaggagcatctccgcccggcagccaccccgtccgggagggaggtgggggggtcagccccctgcccggccagccgccccgtccgggaggtgaggggcgcctctgcccggccgcccctactgggaagtgaggagcccctctgcccggccaccacccactctgggaggtgtacccaacagctcattgagaacgggccatgatgacaatggcggttttgtggaatagagaggagggaaaggtggggaaaagactgagaaatcggatggttgccgtgtctgtgtagaaagaagtagacatgggagactttttgttttgttctgtactaagaaaagttattctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttgagagtcatcaccactccctaatcttaagtacccagggacacaaacactgcggaaggccgcagggtcctctgcctaggaaagccagagacctttgttcacttgtttatctgctgaccttccctccactattgtcctatgaccctgccaaatccccctctgcgagaaacacccaagaatgatcaataaataaataaataaataaataaagacctacaaacaaaataaataactactattgtcttaaaaaaataaaaaataaaaataaaataaagaagaattggtaccaatcctattgacactattccacaagacagagaaagagagaatcctccctaaatcattctataaagccagtatcctcctaataccaaaaccaggaaacgacctaacaaaaaaagaaaactacagaccaatatccctgatgaacatagatgcaaaaatccttaacaaaatactagctaaccaaaccaacagcatatcgaaaagataagccaccatatcaagtgggtttcataccagggatgcagggatggtttcacatatgcaa

SEQ ID NO: 12756 - DNA, 136264 bp, Human
  misc_feature (1)...(136264): n = A,T,C or G
tcgtgctaggtagctattaaccacccccaccccactccccccccccgcaaaaaaaaatacaaaatacaaagacgtatacctctgggagtgtggatgtggcaacccatgtggtggcttgtccctcctttgagtgcaattgccagtgactcttgcattcaaagtcttgctttaggcacacattcaaagcacagttcaaagcagtttatcttaatatagtgttggatcagggtattatttgtttcagatttcatcagactggaaacaggagggtgtaacatatttaacaatattaaagcttaaaaattggtgtgaggcagctctctggtcctcttaacacctccacctttacctttccgaagaatcctaaatgctgtgaggctagaagtttatttgtgctctgaggttctcaagcactttcactctttaggaaaaaaaaaaaagtctcacagttatttaagaaattgagcctgaaccatccgaggataggagatttcttccttttccgataaatgcctgtgctcagcatcctcaaatttggctgtctttatttacttctatattagttccaattatgtgcagtgtaaaccagctttttgattaacaaaacagcagagcattggttaagaacacttaaacttcaaaaaaattcccctgggaagtgggctctgaattggttaataatgtgcagtacttgctaaattgctgacttccagatgtggaaaatatctttcttgtttaggacctatgtaacctgattggattacgacagaagcgtcacgttggaagcttttgagtgattatttaattaaccatacagtagaaagctgtattctccaggaaatcccttccatatttgcataaccaatcccttcagagcaaaggtggagtcttttctttttaatcttactttaattgtaatatcaaaaaatatatactccaaaacttagaccccatgccgtttaatatcatgctctcccttccctgctaagtttctctatggcctttctcgtttctcctcctgcctccctacacactctcccttactttgtagtgaggtctccccgaggtgtagagagattcagagatcggccaaccgagtgttctattttaatttacttagagaccctttattaaaatgccaaactactttttaatattgggatccagtccagaaattcatcatgcacacaccctaatacacatgccctaagatgcagctcccatgcagcatttttttttctggctctggtacctaaaaagaaaaaaataacaataagagaaagggcagagaactttgttccagaagctgtactgagatacctacacaatttgatgtgcatctcaaatctggtcattagagatatctgtataagaagagactatctggattgaggacccgggatctttccctttaactttcgccccttggagttctccagttctgtgaatggtgtgcaccgttttccgccctgtactctgtaggatttagtgatgaggataatgatgccaaaggcttgacgggctgcccattcattagggcatctgattaacatagtaaggaatgtttattttcagtacataaaattgtagaactttgggagcatcgtctgaattgtcagagctgaacagcgaggagcttagtgagacatgagaatatagagaggtagctaatgtgtgggaagctgagctagttgatattctatgagaagttcgtcgtgtccatctcatgctgtaggtgtagggaaagttgttcaggtgctgctcactagtcctttgagatgcaggtgccagtggtctgatctctagttgatgatgagagagcatctactttcacatactgagtgtcttgaagtgatnnnnnnnnnnnnnnnnnnnngaggcgaaggcgaaagggagggagaggaggaagggagggaggtggaatttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcaggtaggttttttttcctccccttttctctctttttatccctttttggtgtgctcgtcctccatcctccttttctaattttctcattttgagtggggatgtgagtctgaagtgagaaggggtgtccgtgggtaggaatttcaggtgggtttagctcctttatggcaagcttttctcaagagtggcttcttcgctttctcttacactcacactctctctccttgcttttctctcctttttccctcccccaaataatttcccctgtacctgttcattcaggtaaccaaaggtgtcctttgctatccagcccaggaaaagttttattgagaattatatggctggaataaaaactcatcaaggggagaggtcctgctctattttcgcatctagttccaattcattatattcagcaattaggacttggcaaatacctgttaataattacaaaacttggtcagttacagacctacaaattcgggggcaagtctttctcttagacatggcagttcatcctctcccaccgagaaggctgttttctaagcagaaagttgtctgtttttgtctgcttagcgagtttcatttctttatttcattctttgtgtgtgtatgtgtgtgaagtaacacctcacttctgtgattataaataaagaagtgaaagtcctcatggaacttgagtcgtttaccaaagtggaggggggggcactacagctgggaagaaaactgctgtcaggatatcagggttttaaattaggataacttttaaaattgtatttttagtggcaaagtaatatagacatggatttaatagaagacacatacacacatatatcccattccatactttggcactgaaaagtcgagagagagatagcaggagttcccaggaacagtgatgagcccggctaacatgaatgtgtttatctcccacctactgatatattttacatgctccccctgtaatgatgaaggcaagattactaactccagacttaggagtaacaggcaaagataaagtttacagcacaaatgccctgtctctctctctcacacacacacatgcccataaaactagcaacttactttattaaacatgtatttatatgcagtcgtgtgtctcaggatgaatatagacaggccagctgtttcatcccagacacttgtgtgaccatttctttatttcaggatttcccctaacaatttcaaatcaataggacaaggaaagaaatgataaaatatgtcaaacttaaaagtctcctactatgtatgcctaggtaaatttaaggtgctttctaaaatatccacttccccttctctctgcccccctcccttcacccctctcagcaaatgtgtggaaactgatactcactttccaggttttctgcaaagcttctagcacaggagacaataggtgtggggcgtggggactgagtgtgcccggcagagaaagggttaatggcccttgtgttacagtttgcatctgttacatcttttatagccccctgtttaaactaatcctcgaggcacagcatcttcccaacctccaccgagttttcaggattctcctcctctcctgcctgcctccgaggtcccccttctccaagttttgacagtttcaactgaaaaaatgcagcgcctctctcgatttttaggtacaaaagtttcgaagccagaaaggatacgatcatttagtagagcttaaaagtattgccgtagtggttggactttctctttcctttcttaagggaaaaaaaaaattctactggaactatttaagggaaccagtgtgggggagcatgtgtgtgagtgaggtggggggaaatacttaagtaaatattgtcaaagtggcgagggggggtggggtaaaggacagtgtccaaagaggcttataattatatttatcattgcggcgtaaaacgggaaatcttaatttgggggcgagggtggggggaggaagagacagtgcctcgataaactccaaaaggggaggggagggggcgctgggcgagtgggcttcctataattactattatcaatttgcccgagtgtgcttcatccaggggctgtttcgcgttgtttgtttgtttgtttcctctgggaattggggggtggggggatgagaaaagatgagaacgaaaagaaaacctcgcctcaccccaagttcccgagccgggggctgaggacttttcgaaggaaagggtccgcctagccctgagtcaagcggtcttactgtaccgccgtgtgcattccctcatacggtcaggagttatgactcattttgaagatgtaattcttgtctctctgatcccctcgcgggtgcaacacaccaaacagtaacaaacacaaagcgcctcggggccaaggctgggggtggggggcgggaagagcggcggccgaagtttcgctttggggttggggggcgcggagaggtgctcgccggggcggtggcgtgggccctgggcggcccgcgcgcgtttcaatgggcgcgcgatgcccacattgtcgctgtgtttggttgctagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacggtaagaagcagcccgaaccaaacttttccgggccactacgcggctcgagacccagggagaaggagggggaaagggaaaaggaaccgaggcggcggcggcggcggcgcccagggctctagggcgagcctccctccgcggccggcgccggagcccggcgcgcgcggcggctggaccggggggtgttggggaagtgccgggcaaagtgagcgtcaggcacccgggggtccgagcgcgggggtccggccggggccccgcgcccccagccccgctgcccccctcgagcccctgcctccgccctccctccgcctccgcctcccgctccgctcgcgcccggcccgccgggtctccggccgggcttcgggagcgtccgcctggggcagggcgggggcccaggcgctggatcgcgcaggatcccggggcgggggcgggggtggcagagagactgcgaaggcaggagaggggaaccgggtctgcgcctcagcgaggcttaaagtttcttgccggagtcgcccggccgcttctcggtgcgccaagtaacggtccgcgggcagcggggcccggcccatcgcgcccagaccccggggtgggagggagtcggccggccccgcgcggggtccggtggggtcgatgatggctcggggacggatgactcctctccagcaggctctggcccccaggccggggactgaaggagtcgcagggcgcagcgagacttttcccggcagtttctacatggtctggaggagcccgttatccaggctgagtcaggaaggaggaaggagaaaggagatgggggttcgaggggcacacgcagatcagaggtgggatattaaagggggggggtgagagtttggtaggtccgttttggagacagccagagaagggacgcggggggacagagagaaacagagagagaggaagagagtgagagagagaccccctaggtattaccccaaacaaaatcgtgggaataaaagagaaaagtgattggcaagagcgcggaaggcgcctgggggaggggagagggctggggactagcgagggtgccgggggggggtgggggagctgacggaggataactgagtttaaaaagaaagaaaccaacccccgaaaacaaacaagcgaacgagcgccagcccagactcggaaaggaaacttctcgctcccctcgctctcagcccgatcacccggcgcggggccgcgtagacgctcccgaggcaggcgctgggacgcagcgcccacccggcctcccggcctccgcagccccagcccgcgcctcgcggggaccgcccgggcccacttggagcaactttcctctagagaagacaattgtgcgcgcccccggcctgccccagagctgcgcggcgcggggagggggcggctgggggcgcagtgtgaggtgctggaaggagcaaaacacaaagacgagagaattttgattagagacaaatgatgcttttctctctctctctctctctctctctaggttttgtgtgtgtgtacgcgtgtgtgtgcgtgtgtgtgtcttttgcttgttgtggtggaggtgtcgagccatatgggggagtgatagaggaattttagtcagaaactgttcgttacgttatcctgcctttcccctttgtgctgtctttgatctatttgcttggcttagtattacagaaaaacaagtacaataatatattccgagctgcttccccaagattcagttcaggctgcttctttttaagtctctccctctctctttctccctctctctctctcttaatttaatttttttttcactctggtgtctggcattatttaaggtggtccttacacaggagacctccccttccccatctctgagtaatttagtagacactaaaattacacctaatgtccccctctcctctcttgtgtttcctctgttccttttattaaatgttggttattgattttctaaaatcaatgtctgttgtggggcttttttccccctcttacaagtatctaaagcacgttgctgatcaactggataacaaaagctttgtgtcaaggaggcttttttccctcttctgttaaacagtcattttttttttttgagagaaaaagagaatgagatttaaaacaaggctcccagaagtgttcttttgcagggaagactatttaaagtgtgcatttcttcttgccttcctccttccacctccttcgggattttgccaccgttgaccagcctggccctagcagtgaggtcaggccagagcccaggtctaaggaaatagagggatcctggcttcctgggaacccctaggagacctggcagagagggaggcccgttgggcgcttcgcaggtggaatggagtgccagagatgtccgcagtcatggacactgcaagtatttcccctccacccagccactaacttgggagaagcctccacattcagaagtggaaagttgaattgcacattttaaggcatttagcccagatcctgcacacttaatatcaagcctgtccattgcttacagcttctctaactttgactgttacctgtctttttttccaaataagctgtgggaaaacatgctgtatactggttattgtaagtgtttttcactgggtttaatctgaccgagcaatgttctggttttgagaagcaggtagaagagtactaccaccccacccctttttcattttctttctcatcaaacacatatccaatgcctttccctttgggaattgctaggatttatctgaactgagtggatttttcttctttcctggattcatggaaaagatgtcacttttgagcttgtgtctttgctgataacactaaatatgatgatgcttatcaaaatcatatagaaattcctggaaagaaataatggcaataataatcgtataagtagaagctggaagggaaaaaaagatggtcatccaggaacctagaatggcactttatataattttaatgaagtcaacagtgtatatatagactaaggcgacaaggagataaaacgtgtaaagcagtgtgtgtgttttaaaggctggtcaagaacgtgagttagaagacaatgctatgtacatttaataaaaagcaaaggagaaggaggcagttgaagaaaaataaatgtacaaagagagaaacaagtatctgaaatacaaccttccagattctcaggctagcaagatgcctggcagaggcagtgccagggccaagttaacccatagcgggcagtcagtctcctttcccccacatggaaaggatgaaatctcttcccagaaaataagatgtgcaggaggaaagagggagtggggtgagggggaaggaggcaaaaagcgagttgcccgcagacaagaatgtgtgtcggtttcaagaaagttcagtcagatgatcctcagtcgcctgactcactttgtaacactttcactgacgctggagaggagggggaaaacccagcccccctttttctttcccctgattataccccactatctccacacagccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaaggtgttctgtagtgtttttatgctgtgtatgtgcatgtgtgtgttttgtcttgtgtttcctctgaggaggtaagaagaaaagccatccatgcgtgtatcttttggcttttctcttctttccgttctctcctacatattatgcatatatgtagcccacatgaatacacctgtttaaaagaaaatcacagttcagatggtgccttgctggttcatttaggaaacaacagttattagaagttggtctgatttcgcgtgtggtccatgaagacagaaaataccaactcttgtgtcatctggtgggaggcaaatgggggaaaaacttttataattttgtagtaaattagagaggggaaaaaaactgccagtctgtgaaaagatttttgcctctccgggaagacacacacacacccagtagctgcaccgttagctgaacccctgacacggcggtcttttgaatgccttaggtatgatttcactttcgctcacatcaatgctgacctgaatgcctttcatatctgatccgctgtgtctctcccagtaaacatcccctgaggggagaacaaagaaaggagctcttcttcttcttaatcacaattcagccctttcaccgccggcaggctccatttgcattctgccacagaaagccaagatgaaaagaaagagagagagaaagagagagagagagagagagagagagaggcacagggtagtagctgagtaaaataacttaggtgtttgtggctgtttgttgggcttcccctagttaccagccttatatagctgatgctccaccaggccctgtccctcctgacaggcatatagtgttacaagatggcatgtctgtactattcatggccacccgctcaacacttgaggtaaaaagtgtcaggaggggatcgaattctcccccagaagcctgttagatttggggtcaggtgtgtggacttcccgcccttaagtgctgcctacgatttggctttaataagtctgattgtttaccagcggaccagagaggtgagggccctgggggtgggagggacgggcgagctggagactgggcccctggtctggtttcagtgacgggtcctcacacccagcctgaacacactgataaatcctcaggaaaactggaaaagactttcccatttttccccctgactttttatgataattcatattttcaaatgaaaggggaaaaaagccaagaagaaactctcaaatgagccaaaaaggaaaaaaaaaattctctgaaaagaattttagggggaaaagttgtgctattttaaaaagctttgagggctgtaaagtgccacgtttttcacaccttctccatacttttttttcagatttttttagtatgtttaacatttgtgagatgacagcctttttgtatctcaaactggatgcttcaggatttgtaggggaggggttggtggtattcacgttctcttgtgagagaaagtttgtgcctaaaggcctccttcctgggaactgtttaaaccctcgcaggcagacctgtcaggttttactgtgttatttgccaccattttcaacatgcaaaagtaacatgcagttaatggtattggaatgagaccacagcaagagcagaaacctctcgtgacaacttttcagcgacattatcttgctcctagactgtcttgtctttttcttcccctttctgaaaccacttttgagataccaataattttctcccaacaattagattaaggatacaatgcgctcacacacatgcaccacacacacacacattcacacacacaaacacacacacaaactttggaagtgcaatctcttccaacagcagagtgaatgatttgaaacgggggcttttccaataacccttgtggaagatttcacttataagagcaaaactaacggatatattagaagttgtgcgaacatgtgacacagattcctgatttttttttctttttcccagaagatttacagaatttacaaaaagagattatccctacaccttccacccctcctatccacccccatgacccaagcaatgaaggatttaggcagatttacttcagtaaacacctttggacacttgcggggaaagtgggagtctgtttgcaaaaggaggcttttgttaagtgaggtacggggataatgctttaccaggcagctgtgatattaacctacccagcaatgcgggaacactctttaactctttgagtgcctggccccttgcgctcagcagataaaatcctggctctccaaagacactcagaattctggctctagcagtttattattcagacaagtcttataggcatgaaaactgttcaagcttttaaaacaatgtggtttaattagatgaggtggacttacattgctcataagccctccaaatggtggtttataattggcaagggaaaaaaaaaagatagaaaaaaggaatcaaggcagcacattaaaaattccaggaaatatctttagaaaagctattttcatttctagcttttaaaatattagactacggtagctagagggaatgaagcagctggggcctctctccttcctataaaagacaccagaagtttgtgatgaagaaaggggcttcaacttgaaaagctatgagaggccagttcggacagtgatatgatctcagccttcgcatcttttcaagggggaagtactgcctatctgtccaaacctgggaggtcatgtgaacctcagagtcagggcctcaggctggccgttaccaacttgagactttccaaagcaagcagagaggcatttatgaggaaggagttaatggttattttttgctgggcacaagaataactttacaggtgttgcatttgggcttaaataagattgccttatttagtttcgaaaaagagtgtaggtgtcaacattcgagcagccacaaatgtgtgagaaagtaaagggtatgagacatgacggaattaaaggtgtttgctatgttgttacaccgtgtgtcaggctgcaagctccctttgtcacagcctcctggtgatttgacagcgcagatctacttcccttctaggtgagacagcatttttaaacttgagttataaatatggtacacccttcgagttgcaccctgcctcccagatccgtgaatcctatttgaaagcatcttgccctgagacacaatgaacaaacgcccgtatacaaggaggctgtgggctcgggggcccgggcagcgccagcatcacagtagctggcattgactgttgtttggcaagaaggtcctctgccaaatcatccaataattaagttttatgttatttgtatgaacgaccaagcatgcagtattccttttcaaatcaaagggaggcttaaaattactttttgaacactttcagaccatggtcaggtcacagtttgggggctgaattaaaatgatctcattcatgatctaattgaggttggcaaaaccttagcagtagcaggagtacataaatataaatcaaagaccaaaatttagcaaatcatatcatttgctagaaatctgctcatgaattattctccgattgccaacccagaagttaaactttgtctcccctcagcaacagtaactgcgcatattttttcaggcttctgacaggaaagttagaggatctgaaaagagaaaggagaaggaagatgatcactgtgtcatcagatatggtacatttgtgacccaagaaactatgagagctgataaagccatgtacgtttacagtggctgctgcagccttggttagaaattaatatgggtttctaaaaaccagactttggaagagcaggcagcacagacacattaagagtgtaaggggagcaaacgtttcaagaagggtctgattgtactttgctttcattttttcaattgaggaatgtaatcatcataatgattcatgattatttacaaatttagttctatcactgagctgggtccagggattgagatttgaagtagtggttagaactagaagacgatacggagctgttagtgtgcatattcaggttacctttcattctttctttctttttaacgctgctataaaattaagactccaaataacttttcctataatctgtgggattaaatgtcatactctattgtatctaatccatttttaagttgtaaatttttcttgtttgctgtgtatgatttcatcttaaacccacacaacactttactataaactagaagaggtctaattctacagttgaatcttttgaagttaaaattttaaatcctgtgtaaaagaagatgttcttttaatcaaacagtaaacacagaactggtcagttggccacctttatatatcacaaatatatgaaggtatacttttaaatcttcaggataaactaaggtgggaacatttaaaaataatctcaggtgagagaggtagatgaccacattcctgggaataggtaactgtcattaatgatttcctaaaatgtattctacattaaaaaaactgtaatggatttctctttaatagttacgttgcccatagacaacatagtgatttttgttctttatatactgtttcttatttttttataataactcaaggaaaggtactcctgacaagatgatagccaccccctcctcccaaatatgaaataatcagtaatagatgaacagattaaaatattgtgctatataaaatctgaggtttttttctttctctcaaatggatgagtaaatttcaaggaattcagtgcccaagtgatctataaatgtaatatattgctttcaatgtttcttagtttaagaaagtatttattgtcttgtatatccaagtaactgtaatcaaggaaattgcaattgcctattcttggaagtacctaagtttctattttagacaccatgcacatcaatggaagtgtttcacatcatgagaattctcagttttaagaggtgaggtttatatataaggaactcagtaagctgtgttttcataataaatagacccattaagagggaaatatctctgagcaaaatggttgtcctctaaagatttcccatcacctttgctctgctgatgggaatttgaaaactaaatacagcccatgtgcacacattcccacatgcacacaaacacaaatgcaccctaggatccaaactctgagaattttcctctttaactttcactacagtcatctagcttgtgaatgaaatacacttaaacaaaaatagtagaggcgaagaattaatgtagattcttgtttagtaggatttattgtaggggggaaatgtgttccctatgccacatgattcttacgaaacttacacctattaatctaagctttaagtgtattatttaggataaattactagctttctgcttttgtactgttttctcccattttccttcagtattaccaatcttaacacagattatcctaaactgattgcaaattattatggtttttaaaacagcattctggagtcctgaataaagatggtattttaaactagtgtttacaatatacagaataaaaaagggtgggggagatttaaaaccataccgaacacttagaaatgtgtggagttttatacttgtgcagataagtgtgaggtagccttgccctgtgaaaccaagaccacaaatgatacgtgtcagtaggttctttgatagggcttctggccacagtgtttttgtgctgtcaaactgctatgttgaacaaacacctcctctgggacagagtgataaatgcagagacaggctggcttcaaccagtctcagcaacctcctcaaccacaccccccactcccagcccacctcctacctcctacaatccagccacctcccactccactttgcccctttacctgaaattgacatttatatagaggtgcccaggattttttaaggtgtcagtggtgagtaattgttgatactccccaaatcttatgaatcagtactctgaaactgcaggcaaagtcctttttctggcaggctttatctagtctttttaaatggaactggactgagcttctaaacttttgccaacttgaactttttccacctttgcttaatcacttgaaaaccacttgctttccttgtctttcccccagtcgctttttattttctaatgttcaagctattacattgtgcaacacagacaaaattttgccttaaaaaatccaaacactattacctcttacttttcactttctagcattcttttagggctaacatttcaaatgtatagtcaactggtctttttttttttttcttctctctcttggagccattattctctgactaaaacctgtttactggtgcctttgtgtgtgcgttttttccccctgacattaaatgaatttccatcttctacttctgcaatctctaagaaatagataaaccattatattttttccctgctcgtattttaaagtggtgatcctgacagcaggacgattattgcactttatgttttagtggatgtttgctgttgctagttacagcaacacttatcataagacagcaagaaaagagtagtccctggtaattaaagtaatgaaatattcatttactctaccttttctgtagtctcacaaattaggctgctacatttaatgcctgcactgcctctgtttttattataatggcagctttcgcatctgcaattaggactaattctgacagttacaatttctgagggatggtaaacagtgaacgagatgtgcagcagaggtattacacgtgaaaagcccttgtctctttaaccttgttgttttttttctcgcagaggttaccttttcccgatggtgcaaaatcgacttgacataactgttcatcagtttcagggttttccctggaggtatttgcatcaaatcagcccagtcaagcttcaagttgaaattggcaggccagaaactcacagggtagagactggaaaagagacagccaaagtacaggcagcaaactgacagcagcagagtgaaagacagaggggtggggggaggttgagagcgagagcttttcaactttagtgtgcgggaaatctcagctcctcctgtactgatctcagcagcaccatatcctgaaggagcttgaaaggttgagattcagaacaccttcagctaattcttaccactagggctcaccagccttgctccgggggtttgctctcacttaatctgattggatgcctaaagaggagtgggcacacttaattaaacggaaggaaagttctgaggcacctccccagcacttattaaagcttgaaagccaaatctcatgatcagtgttataggaggaaattaaggtggtttgtttttttttttttttctaattgttaacttgtaggaaagtgaacaatccctctctttaccaggtttgttttcttgggggttctcttctgagtagattaaatgttcacagagactagagctcaggggactgtccattcaaaagctaatgcattttggctaacaaaaagccagtacaagtagcaaaaattatatttgaagagatactcctttgaatgacatgggtttgcaagttctctgtcaaataatgccctactatcctggtaatatgagaacacgtattaagttgtttaaaaggtcaaaaaacatggcaaaaccttaagatgtctaagatactcaacttttactctcaacaaggtcactttaagaaaaattctatgattgcaaaacttgtataattgcttttacaaagaaaacaaatatgaaaagtgtttcctttgcctgagaacattttttctccttgatgtcttaaaaaaaaaaattgtcatccttccccgtctcttctaactttggagtgggagggggctggtgtttttactagatgatttaaaatcctccttactttccaactagacttgggggtcgaataagcccttgctttcaaaccgttttctagctctgtgtatgacaggcattggctgatctgctgatgcccattcgacaggcactgttgaactaaagtggtgtgacggcacagttttgttaagctgtgaacaaagggctgaagatgccttgctggcatcatccatgtgcatattggccttgtcacagttttgcttgatttaatgctctgtttattcctagatattaaaacttaaattctgaacaatatgttttcaaatactacataccaactttattttaaaagctttaactttgaggaccctagggtccatttgctcatccagtttctgtgtagccaacattaaaacacagctttggaaataaatagattgccagtagcctcttagctgttatccatttaaaaatgggattccagtctttaaaagtcttattaggataaaagatttatttttctttgatcattggttgaaagtcattatttatttccaacactggattgtcacataaattcctaaggaagagttaccttgtgtgtactcagtgcagtcagagtagactttttaaaatgacaaattattaaagagatattcagtaataaaagaaagcctataagaatacctataagggtaggcacatcaccactgagagaaaaaaaaaaatcaagggagtttatgttaaagtgagccctatttaagagatagcagaagaattaagattgagacttaaaaacaaaataattgttatgaaaatccctgttccagaggcaacagctcgcctatctaaagaaatcttaagtttggtactaaatttagattccagcgtcccgttgaatgtgtcttgagctttatctacgctgggtttttgttccccctctgcctctctttccactcttcaggttttcttcaagtgtttgctaagagattagttagcaagtttatattgaggaggtagccatgggaggcagctctctgcttgaaggaacgcgcagtgggtcagagtgagaagatacagggagctaagactgactaaggcctgggatcaggtactttattttctctcaaagacaaaccgcccatagaaaggttggtgggatggcatctgccagcaggagcacagatgttaccacttttagaaacttccaaacaagcattattgctggaataactttatgaaaaaaaaaatctgctgccagaatactcctttttcattatgtaaagaggctataatttgagatattcaaggttatttttacctccattcataaaacagcatctttcttgagagctgttacgagttaggtgaggaaggtggcaaaggagagaaaaatactcagcagcctaaaagtattgctgctgctaataaccggtgagactgcactaagaatctgaaatggaatctccggggtaaaacacatccacatttctacctgccctaagcgtgctttcttagcagtgactgagatgaattgtccatttcttttcagtggtagtttttctccatgttcacttatgccaaataattcccacagccagaaagagtgatacaggtcggggtggctaggaaagaataagcctttattgctagtttttgtataacatcaggcatgagaaagacacttgctaacagcatagattgcaagacactctgtggcctgttctcttagtttcatgagaaaattttgtccaatcccataggtgtgaacaagatttagacatgtaatctccaacctggaaaagaagagagcttttaatatattaatagggcagattcttacttaatatataaagtgaattttggcatcagtttggggtttcctattaatactttgttagcaactgtttatggaagagacaaacagcagttcatccaaatagtcctccttccccaacccccaacccctatcttggtattaactgctttgtcctgtcagcttataacattctatctttaaattactctaaatgaagtcataattctagttatgttttgtaacaagtccatggctaggaccaacatgacttctcaccttttaatgaactgttctactttaggatcttctaaggaatagagtgtaaaaagaagcaaagcaggagatgaagaggtctcgtaaatagtttcctttgaacatccacaattgcttacatggccttttccccttttttccaggctggcagaaatggcctagcccaggactcattcaagtgagcacatttcagaatgactcattggatgattggagggagacacaagccctacgataccaatgcagtgtattaatggagaaagttcctgagattgggagtgggtgtgacattaggctagggtattcctgaagggctctaattcatgtgagaatattaagtgtagatcttctagctatcagttagcgtaaggtttcataaacaggtaatgatggctctttccccccgctacccccccatccaatttctagctgagtgaggaacaggctctgcttcatataaatacgatctttgaatttatctgcaatgaggtacagctttaatgatctgtatctgcaagccaggagcatgaatgtgatcttattgtatcatagtgtagagatgagataggctagcgctacagcacaccagtgcattgtgcctgggtgtcgggagcaatccttccatttccaaagcagcaactctttatttttcatcattgtttctttacctcacttgtatgctccttgtgatacagatctgagtgagttgtgcaagcttcagacttgccagcccccagctcccaggcctagtacagagtaattcataaacttaccatattagactatcagattgaaaccaagggtttctactgtggtggaattggaaagcccattgttttgattatcatttcatcagccccaactgatactagtatgctcaaggaaaacatacttcagttacagttgattttcagattccaaaatggtgctgcaaagcctgtgcatctctaattatattttatgctaggctgtgcaataccaaaatatacgccgcagcaatcagtgagtgaacagtatcaatcaatttgtaaacagatgaagtcactcattcccaaactggttttccaaaaacaattactaaattacaatagaaaaaaattgtacagttactgtatttgtgtgctgtgttacaatcaacataccagggaaacaaaacaatttaatgcagaaaaatcatcattcatctacattataattgcttctttttcacatctacagggcggttaattaaaattgtgattaaatgcggtcgcgctgcctaagatgtcttgcccaaaacaggtggtacagaatttaaaagtaaaaaaaatgtaattagcattggaaattgagaaattgcctgtaagaatcagtgttaatttcagtcagtgatgaggtaatttataaatgaatgcagtggaggctgtgcaaatgcacaattgccttccttgccattcttagcattctcagcatgcaggtgaaaatgttttcaaaatattgaggtaatttgaaaatcaatccatgcattctgtatcttttttctcccatttgtaccaaatgctgaacaaatgctgccatagatggcacaatccatcagttttttactttctaaaagtaatgctgcacatattttagacctagattaagaaatataacaacacaaattgcaagcctaaaattgttacacgggtcaaaattgtacacctgaacttctgactaatggagatttggttggctgtgaaatgctcccatcaataaaatagagacatggggggaaatctgtccatggtataggtggtacaaacagaatgactattaaccaatccaataaatacttgagattaaatttttaaagtttaagaaagaaacagaaaatttataataaggctgatatttttcttagaatcttgaaccgtaactttgttattccatctagaaacatctaaaaccagttaataaagttatcactagaaaaagcgtttacagaaattaactgtttttcaatgtcatctttcctttcaacaaagatgcaactttctacaaaacattatgctatcaacttactatatttcaagcgttctattggcaaatgagtggattctatagattagatactggttaaaaattatttctatttacgctgtatttttactattaaaccgctagacttttaaaatcttttaatggaagaaatttaactttcatgtgcttattctgaccctctgaacaatatgaatttaaaatattttaataatgaattgagaatatggggtttgagtatctggcttgataccactggagttaagagactttgtggggctttttaagcatcctcttctgtgtttggcattctgcaaaatgatctctccatataaagctcatcctaagaatatgcttatttaattgtggcagatcaatctgatgatcaaattctctcatgtaaaatattctacgtgttttttgctgtttcaggcagaaatcaataatttcacttcactctgaagttatgttttgtggtaatacggacattttcaggagaaaggtgaaaaataagaaatactgtatctctgggagtgtcatctttattcattcattcattcatttttagagacagggtctcactctgtggttcagactagagtgcagtggcaccatcctagctcacagcagctgagattcctgggctcaagggatctctgggagtatctttctatcctctgatttcaggcctagtttcgggccttccctcatgacccttcctgatcatttttaggacacaaatgaaaagtgcaatttagaggtgacagctcagctggttgttccaagtggcatgccatcgtttctctcatatttaaatctgtttcccatttaatattacaagtagaaataaaatgagacctctaaatggaggaaactgaaaggtcaccagttaactccatgatccctctcctttcaccagctcttgcctcccactaactgtgatgatgacgatttcatattccagcagtcagttcactttcagcgagggtgggtgcagacttcatcaaagaatggcttcctggatttccttcaggacctgtgaacataagatccgcaaccacatggggcttggctcaaatttcagcagagtggtgggatggaggaggtattatgacgtgctccaggctgcactggttctgagtttacaaggggtcacaagggttagagaatcacagatgtcaatagagcgcgaggaccttcctaccccttgaaatatttgcagtagaaatcttacctctttacgtttggttcgtagtgccccatgagcttagcacggcaatgtggagttacttgtgagatgccaccaatgtttcatatatatatatagtatattatataatatataatattaatatatattatataatatataatattaatatatattatataatatataatattaatatatattatataatatataatattaatatatattatataatatatattattaatatatattatataatatataatattaatatatattatataatatataatattaatatatattatataatatataatattaatatatattatataatatataatataatatgtatgataatgacatatatatatatatgttgagaatgacagtgtctttttatacaagctccctccaccaagtatcatctctgtactcttacagggtcatcaagattgtcagaaaaggcctggactacatgcctgtcccagcactagattggtattttttaagtccttttttgtttcaaagtttgccatgtgagcttaactcagttcattctgctgttattacaagcatcacctctttgaagctgttatcagattcatgaaagaaaaatgcgcattttctttttctactgagggcttctttcacctttattcctgagagtgatcagagctttgaattgtaaaaaaagaaaaattttctcattgtacaataattgaaaagtatgtcatcaggtcctttctaggtcttcctgtggtatgtcagcagaaaactacagtgtttgttcattttgcattaattacacacctactatgtgcaggctctggctgaggtctgtggatcaaaaaatggatgctagagcctgggcccctgaggagcttgctgtctagtgggaaatgggggtgcatttaagatatgatgaaaatgtggcaagtgccacaaagaactttctacccaatacagagagagtacagaggatggcacaactagatctgggagaaggtggtgaggggtcacttcatggcagaggtgacttttgaggagactgttgtcatataacatggatttcaccagcaagtgagggcacagcacgctgggctgagaggatggcatgtacaagccaggagaaagggtgaacagcgcaggcattgtcagccaactgagatgtctgaaacacagggcatgagcaaagaggatgggcttgatttgagtctgcaaaggtggtcagggagcagaagaatgtcctatcccatatttttggcttgtatccagtaaataggtgatggtgagcttgcgaaccatgttttatagaagagtgacataattatatttgcgtttcagtgacacgtctctggcaactgtacgaaagatattatcatctaacatttgttgagtacttaacaatgtgctgggacccgtgctaagaattttgcctatgtcatctgatctcgccccaacaataatgctgtgaaatgggtactattattttcatactatttttactgatgaggaaattaaggtttagaaagggcatgagcctggagtcaggaagaaagtctacggttacatgttactgtaatcatggaatttctagaattacaagcaacacaggcaataatgatcattgactagaaggacatttggaaaagaaaacccagcgtttgaaaaagagtgaggcagtttgattctgtttctctgagtgaatagtgagactaagtggggtgtaaggatgtttcatcctcaaaatttattttttctttcattactatgtcagtttgaaaaagaaaataaaaaatggttgttgatcctgaagaaactaatcctagaatgtgctacatctttgagagtttggaaagagacagttaacatacaacccttcaaaacagtggaatttggtaaaccctggaacactgttcttgctgatctaattcatgacattaaggccttcctcggccttatgaggaagcagatgaaaataatccttttgcgatgactattttcccccttttctgatttaactcttccattgcctaagactcaccaattctcaaacttctaaattctccacactgccttatctctgccatcccatggcaagtcctaaagctgctaacattttgtaacaactatgtgacaaattgttgtgcttttattcaggtcggacatctttgccaggcttgcttgttgtgttttctgtttggctgtgtcatgggaccaaaggtgcctgcctttgtacagcatgtcaaatctggttaacatgcagccatttatctttaaaaccactcctgcacaatggcagaggtgggccaagccacagggctctaagcacaacccaatttttcagaccatcttttctgcatatagggagcacgttggacagcagacaagacattttgtgatttggggaatctcttagagacaaattgtagagtgcaagtgcagtgtaactggactgctgggtgcccagtgaagtgaggaaaatcagatacagcacaggctgaaagaatgaagcaagaattcatatctctgtgcagaacatgcacagtactttgctcacacagagagttcacacatagacaaaagcatgtttgcttgtgggttattttcaggggattctatagccacagtctaggcgtatatatttgcacgtaagctttctttctgcattttgtactggtaggtgtgtctacatgtgaacatgtaaacatgcttatatgagaagacaatttgctgttgctgatttaagacacgggaaaggcctcctagttcactgaggcgtttccctcctaatgtagtagaagcagaatctttttgttttctacaattgttttaataaaggactctgtgtgtgtttaaggaagactcagagccagagtgtcaagtgctgcagtgaaaaatactgaagatttttctttccataagacagctgcaaactttataacccagttcactctgggttttcatttctcaattgtttcaaggtgtcttgggaatgatttgcccttaaataactagttatcaacaaaggagaaaaaatagcaataaaaaatgtgataaacctgcatagactagtttaactaaaatgaagaatttccttgcttggagcagttcaaggaccgaacatagcaaaactgtgtgatttaaatgaaatattcagagtggtcaacataaatacacatgtagacaagagatagtatatgtgtgtgtgtatacactgaggttacttcttgaagaaataggcattttttcctttctttttgctttttctttcttttctttttctgagtaaaggaccccagagattgtctttcactttgaaaacaatctctaatatcaggaaaatgcgctgtttgtttatgcgtacataatgcaagtttgtccgcctgggaactgcagcaaatgggagaagtatgcatggatttcacaggtaacaggattacgtgggcacataattgatccatttggagaaaaaaaatgacagtgctctaaagatgcctaggctttggagatggagtttatgaaacaggcatttgtaaattcaaaggaatcaatatgtcaattttattacatctcagaaccagctgggcattaaaggaacagtagccttaaaaaaaattacagctgcatattcctacgttgtctacctttcttaaaggccctagaatttaaggaaatgaacttagagatgtgtaccttttcagaaatgaatttacattgtccaaagagaacaacaatttaacattatgtcagttatcaacctaaaaatttgattgaaatgtctgccttatcattacaattgaagtctattaatagatacagataataagcagaatagtgattttcacataggttgcactgtcaaggattcattggaattcatatttgcattgtgcttttcaacagtctagattttacctcttcactgatgataggacatagtttaagagctagcctttgggtgtcccacagaattgggtctgtgcatgtgtgaaatattcctgttttattagagtttttgacaatctatttttttttttttttttttttttttttgagacggagtctcgctctgtcgcccaggctggagtggagtggcgcgatctcggctcactgcaagctccgcctcccgggttcaggccattctcctgcctcagcctcccgagtagctgggactacaggtgcctgcaaccacgcccggctaattttttgtatttttagtagagacagggtttcactgtgttagccaggacggtctcgatctcctgacctcgtgatccgcccgcctcggcctcccaaagtgctgggattacaggcgtgagccactgcgcctggccgtttttgacaatctaaaaagaccaagctattttaaattattaagttcctaaataataggatttggacagcagccataagagaggtgaatgggatgggaatttaagatactattttaatatcacaaagaggttacacaactaaggatgaaagttagaagctatgaattggtccacatactctgcatgtgctgtctgctagaggctgcaaggcgagctgcttcactgtttcatgttccaatctccaccacccagactcctgctccaataacatctctagatctattcacttgtaacaaatggagcccagttctcctccctccccaaggaggccagacactcgatacaatgaaaagaacacaggattcagacccaaacaaatttgtgtccacattctgattctgccatttactctccatgccatgtgcccctgggtgcgtttcttaaccactctgaacttcggttcttaatgcttaaaaatggggagcagtatttgttttatagaatctttgggagtattacacaaaattctaaagacagtgtctggagcctagaaaacgctcactaaattctgattatgactgtttcaaggtgtgactaatcaggatgccaggaaccctacgatggaggcacttcagtttctgggccttgctgaaacattcttgaaaagaggaaacaataaccgtagcctgagatattcgttccttttttttttactctttggagagtacttaaaaaaagaagaaaaaagaaatagtcatagtgattggcatgctattctacctctacatttccaggaaatatacatggtactttttcttatagaaacagcatctcctccaaaaagaatacattctgagatgacttttgtcacagcacttaaaatatctgattcctatttgtctccccacaaatgtgtaaatggcttgagggcagtcttgcccatctcagctcaggccatgacatacaaaaattgtttcgttaaagcaaaggtataatgaatacagcgggtatattaaagattcagtatacattatcatatgtagaaaaaagctttgggtaactttatgtcagattccctaccaccatattaataactttttgaaattcactttgtgacagctatgttattttgaatacttgagtgggtttgctttttgtttttgtttttgtttttagtttgtatttaaatcaactggctctctgcctttctcaatgacacctttgagacttgggagtcagggaggcagagaggcagtgtgggtgctcggaagagtgtaggctttggacatctgggctcaaatttggtttctactttcatacaagccataagacctgtagcaagttgttcagtctaactgcatctctgcttctcataataatactcatgttatagggcagttgggaagaaatactggtaacaggtaaagtgccaagcacatagtaggtgattaatgttctgtccccttcctccactcttctttgtcacttgagcattcactttgggttggcatttagtgagctccttctgcccgtcaacaagtcaatcaacatttaatacataccatgggtagatatcttacccctgttccaaatttcattatgaaaattgggctattttctactcaaggaaatgagcatgcagaagtaccttctgtacttagaatcacaatcattttagctattttccgcttaatctgacggtttctttgttcccatcatcttttttagtgaagcactttggtgtttctgcaatcctttgctatcattctgtgcttgggtatctcagatctctcttctcccccgatcctttgaagacatcagaaaagaagaagcacaaggtctcttgactatacgtttgccacacaactgtgtggattggttagttaatagagttgattaaaacactttgtttgattctgcttaagcataccagaaatacattcaaaatctacagctacaaaatgtaaagaaggtagtccaaatatagtactacataatgaggctccctgttggtagtatataaagcagtttagagtatagcttcaaattctaatgaagatcattttaaatcttgcactgaattgtgaatttaaaattcccatgttctccataagtatctgaagaggggcatgtaaataccataagtgaattaattactgccttaagttggtaaagcatgtgtgaatccaaactttattcttgaacttgcacttctcttcccaaggttttttgaaccatttcctatatgctgagttctgagtacctatttaactactgaggacatatgaagaaggtagttttctttgcatggattaaatgtttcaatctctgaaaatcaccaccaccacaacaaaaagtctgcccggcaccatctacatgtacatgatgaaattcctaaagcagaaaagatatatttataatctgaaacttataaaaacatgacaaactgttaccttcacttttgtgcccccttttttcattaacagtattaggtcgtttttttttttttttttctcttgagaagaaacgaaagacgaagtggcaagaatatctttcacttttgctcacgttttggtggtgtaatattgggaccactgaagtaattggacaacttttccgagctgactcttctgaagtaaacccaaggcaaagggaaaatggagctgctgctaggctcaactgatggcgcccacatggcgcccaccccagctccttcagagactccatcatttccacagaagggccagaggccctgccaatatccgcacatcactggcatgatagaccataacagcttcttctgagctgttccggtctatcgtgtcaatgcgtactcggggagtcctcaacgcacggatcactgacacggcactacataacggctccttagcagccattattgggtatcaagtcaatgcctactcagggaggctttatcgcagaggcctgcacgagcagacacattccgaatactaaaattccttaggaaaattagtcattgcccatgtgtgatagctgttttccattttgaattttaaccattttgggaaaaggaagagaatgggaaataccagtatagtccgaaaagcccttaaaaaatgagtgcgaaaagtggaagggtggagtggacataggaagatgatgaacttgtcattttttcctttccatagcttcattttattgtgtcaaagttgcagaaagcacttcactttcatcgaggctctttttaggcagggtacagccaagaaaacttttttatggctcagatgtaaatcctagaaaacgtagtagaaatgatggcaggatctctaactgtaaaataacagtagtgttagtagtaagtgtcattataataacgttatagaactctgcacatcaaaaataccacattttatcatgatctctgcaagagatttctgttggtagtcattctagacttctaataaataatacgttgagtaggaaaggttctgtgaggatccaaataataatgaaaatgacagtggtgatattaataataatagtacagctcccatttattgtatcattattatgtggcaggcatttgtatacattatctcatttaattttctcagcagatgtgacaaatcaggaaactgtggcttagcaaagttaaataacttgactgatgtcatgcaaccactaagtgacagtggtgggatttgaactatatctggggagagtcatgctcttaccattgcattgcctctaatgatcatcactttcagggaactaggtgtttaattagaatatcccaacccattgtctgcttactgatcaggaaactgaggcagggtaattttagtaattcccccaaataataaagagagtcagaatgaataccagaaagcaacaagaggcaaaaacagcctttctctctgacaacatgttaaccacaaacaagacatgggaatttcagagcctccgtttgtgtttcagaaggaatgtccactgttgccatcagtcctgaaaagatttccttgcaccaaatcaaaatggttcgagtttgctgttgttgatattttttttccttttgtgttctgcttactgactgacatctgctatcatgctaagcaggtgttcctatgtaaacgaacgtgccctgtttgtgtttcgccatcctcgctgctgcgcacccaaatgagcagcgtgattaagaatcctgtaaatttttgaaaggaaacggatggctaccctactagaacataattacaccgttccaacatccgcagctcactgctgcagcagagttggagaacagcagaaattaataatatataatagcatcattctagtaatttataaatgaaataaagtagagaggagattctgctgatatgcattttctccttaattctaaaagacaaagtatagattagaattttagtggggtgaaacctggccagcagtctcccactagttgcctgattcatgataggagtgtttttgcttagggaaaagagctaatatgttttattaggccagaggaaaaaaagaaaaagaaacatgaataaacaaggccctctaaaggcaacactaaataaagggggtctgaaaaaatctctgtggattgtgtgcccactgtatttaaaaagatattattactttaagacttcaacatgtgctgcattttttctttcattgtaataacataccaccataggtcaccccttctgagaaaagagggactgatcagttaaagatgtggcccaacataaactttatgttaaatagcactcgtgtaaattctagagatctgctgaacaacaatacacccatagttagcaataatagagtagatttcatcttgtatgttttatcacaataaaaaagaacattcatgcctttttaaaaacattattttgagtacccagtatgtgcaaaggagcctcttattacaaatcatcgttagattaagggagttgatgcttttagtcaaccatgctggagaaagaacaacactttctaaagaggcaaataaactatatgttaaaagtaaccagtccatttctctgtctcatagggttgtggcaggcactttagaaactttaatgtttttctaacttcatttaccgtaggtaagatgcctaacaaatggatgagctcagttgtttcaagagtttgtctcccatgagccaatgcccatcacacacacacacacacacacacacacacacacacactcacacacgagcaattatccttaagaaaaataatatttatagcacttaaagtgttatttaagcaacttttcctgcttaattccaaagaatgacaatacatccaaaaaaaaaagtcatggattttcttcctttaattaaacttagagaacatgaaaatactgtttgcctttcaagagaagcatgtccatttaagatgcttattcatttaagcagtattcatttaaaggtccccttgagtattactctatgtgttttgatttggttcagagaaaataaattcatttaatagatttatttcattaacaggtatttatttaagtgggttccactgtatttaaatctccaaacagtttccattacttccttagctcacttgctccatgttgactaattttaataagcctaaggtgcctagggtcttattgagtgttcagtttgatcaatatggttaaattaaaattgtgcaaaatataagcaaatgtactctaacaacacagtgaaaaatgtgctgtgcactaagcattgattggtatgctgtggacacagatatatgaagctgggtgggcctctgaactacctggaaactgccactctcctccaaagctcccctggctttagatacatccatgtgatctcccacccgttcatggagacagcagctcagatacccccattgaattagaaggggaaggagattcatgtcaggtgttttgctttttgatttaatggaaaacagcatgtaaggctcacagtgaaatcctatataaagaaaaaaagctaagattttataaaagttcaactttgagtattgctgaaatgctttaggtaataaagaatgcaggccctagttctttttcacagaataactttttaccgtaattatccttaaattttaatcatttggtagcttgaattctttttcagagatcttacttgtcaagtttgttttagcaaattacaaaaaaacaaaaacaaaagccaacctgatttttaaagtataccaaaatcagctttgccattggtactgcatttgaaaacctagtaagctttctaacaaattcattgctttctatataattgtaaagttaaatagataactgaatatttttagtggattccttttagtatgaataagtttgtatcttctattcctaaatcaatttctttacctttccctttttctcttctttttttctccttttttgcctgttttatggcaagcatacttaatattcagtgtcaatctttttaagcttttcaaaaatctaccacaatcacttaccaatcataagtatatatcattcaaaattgttcctgatatgtgctggctgttggggcagtttctttttcctacctgttgtgtgcctttgtacctatctttaatctcttcttgctaagtgatagctaccatcacaacactggctttccttgatagcatatcttcctgcatgtccaaaacttaagttcacatgagcagaagttgttcttatcaaaggtaaatcagaagttaaaaaaaaaagcagagagataaaaacatcaaaaatgtacatcttgcaagcaatgatgttgaatttgggagaagtgtgttctattgaaatgaaaatcattttctagtttaaactgatcacggaagtttatatgcataataaggatttgaagtttcctatcaaattaagtacagtgtttgagcttcctaacatttaataataccatcaccaatacacctgcaaaataaaataatgtttgagccccaaaatcatcagaaatatgtagaccaataccagttcagaagaattgactttatttttgtaatggggccaagaaaaattcttaggtttttgtttagttttgtgcttgttaatcttgatttttcccagtgttttgcatgttttgagtttttaatatcaaaggtactgctctttgtaaacaagtgtaagtttacccaggcagcttcacttacacccttcccttgtaatcagatgtgaaaattacaccctcccttttggatacatgataattacacatttcaacatgcaaagaattgtctctgtttcagttgttggaatgaaaaagctgagacatttcagtaaaatatattattatattaaagatcatttccataattgttttcgggatttgtaatcaaaaccatgatcaaggtagtcttagttttaaaaagaatacacatggaaataaggagaggataaaattaattgccgagttccacttgaatgaccattcttttattttatgaaaatacagttaagtacattatattctttctttaaaaaaaaaaaaaccttctagtaccttatttgacattttctttctccatgttcgttgaattacctattttttcaggtcgaccaaaaaaatgtagaaatacacatttttgtgatcaaggtgaaaaatttagtcagaagagagatataaatacaatgaaggaatcttttcaagaaaagatgtgtttgtttttgtttgcaagagtgcttttcagccaaatataaaattttgtaaactcaggtaaggcacctcacacttcacaatcagacttctggattcatctagagtatcactcatatcataggtaaaaatatatgtcactattggtataaaatacactgaagccttaaaaatgcagaggttttggcaaataacactaactcaaaaatatcttgtatatccaaggagagggtttaaaatcaccgattcctttttactttcttaagctaagaagaaaaggaagagagaggccaggcgcagtggctcacacctgtaatcccagcactttgggaggccgagacaggtggattgcctgaggtcaggagttggagactagtctggccaacatggtgaaaccccgtatctactaaaaatacaaaaattagccgggcgtggtggcgagtgcctgtaatcctagctacttgggaggctgaggcaggagaacagcttgaacccagaggcgaaggttgcagtgagccgagatcatgccgttgcaccccagctcaggtgacagcgtgagactctgatgcaaaaataaataaagaaataaaagaaaaggaagagagaaggcagcattagatggctgatgttatggcttcgtgaaacagtttatggcataaagaaataactccccaactccttagttttccaagtatgtaaatgtttctgctcatccaaacactagcataggtaagtgaggacacatatttcatctagcccaaatatattttttaaaagaatccctgcagattttttgcttctataaaaaatatcccaacccaaatttctaaaaattttgatttttggaattaaatgataatactaattagcatttacctatacatccttttctattttaaaatcattgcataatctggcatttatatttaattttctaaatcattttccctagagagcattcatgtaattttagaacttggaaggaaccaggatttcaactatactcatccacagacttttcccattgggtagaaattgaaacagaactgacagaaccaggatttgaataccagccttttgactccaaatcagggacaagatgcagttttgtatgttaattatttttattggttttgatattgtggccccaagatccatagtcttattttcatgctaagtgactctttactctgaagggccaggttataattgccatgtatgccaagagtgaagggacccaggaccagaaaattcagtatgcccgggtggtgagtttttagacttatggagctgcatgttctgaactccacgttctttggttttactgctcctgtgttttttgacagttgcttttttttttcttcataatttctgtacaggctgggcagagagttcaggaaatgttccaccgtgtactgacattcccctggcaataagtgggttcccacttcagtcgcattccactaagcctattttggcaccatagagagggtgatgagagggaagagtcagtggaggagaagacaggaaggttgccaggaaggaattgaaaggcatatgctcctggccccattgcctgtgtctgccttcaccacctttagcttcacaagcagtggccatggcaaataggaaaaggtttgggtgggagaaacacagaagaagccattcctgattaggccatgtgtcttccactagtttccatcagagtgggctgaccgatctgtgaagatctgggatcatgactcagtataacaagaagagtcctacacatttgattcaggaaatttgggctcctggcccacccagccctgccttccaatctcagcatggccttggacacatccttaacctctctgggcctcacattcctaatgataaaatgcagggactggacagagattgcaaactggtggctgacagatgtttgatttgtcccacacagtattttaaacacatttgaattggttgccaatatttaaaaattgggctatttcacacacacacacacacacacacacacacacacacacacacacacacacaaatccagatttccagctcccctggagaactcagatgatctggtgtttcgggcccacatagctgcatggaaagaccatgtgggaacaactttgagttccgtaagaaaaatcaatcaacttccctcacctgcttggcctgtgtagacatttgagtgtgggaccccaattctctccaagactcctttgaagctctagttttagaattccaaatatgatttgcttgaccataagaaatatacttaatccatagtggtttctatattcacggcagaatgctaaggtatttgtttatacaatcagcatcaggtaaaagttggaactatcttaggccaaataaatcagccccatttagaacaaatgctgactttgaaatttgataatgggaggcaggaatagttcagcaaagatagcctttgaggtagttacaagaaagatggtttggctcctgactcactattacctacacagcgaactgtgtattttgcaaattatccaaaagtagattctttaaaacccaaatcaaataatacaaggcccttcagttaacattttttcacatctcccactctaaactaacatcttcataaatattgagatcatgaactttttctgttcatgtaattgcaaacaaattatattggcctgggaactgtttgatcttcttcaaaagtaaaggaactacattgattttaaaagttatatttttgtaaatcatgtttccaaatgtatccactttaaacacaaaaggtaacatttgcgactcatggttatagagtgtttaatattgtacaaggtgcattgacaaaaatatctcatttgatctttacaacaattgtaggagctagacagagaagacatttaatacaaatgaggagtctgagacccagaaaagttggatgactattggaaaattggcctattacttgcttaatgtgaaaaagagccgggattcaaatctacagcttttggctccatatttaatgttttccatgccatcagtatgcttccagtgtcttagggtatgtgtgtgtgtgtgtgtgtgtgtgtgtgtgtgtgtgtgtgtgtgtgtcttacctaaacactgactttttctctctctctgtcatgaacaagaattgagaggttaaatgggaattgtctcatgaattgtctcaatgttttctaagttgaatgaagaatcttttttggtagctattcttaagtgaatgctggatttttattaagggaagctaacagatatttaaaagcaccctccatatataaaagcacaatccatggaagcatagtgcaaggaataatgatatagacaaatggaggaggggcaataaaaagtcataaaacaggcaggtagaggtttctggaaaaataaggtggtgagggaagagtctaactgtaaaagtaaaaaggtagaagatagaaccgttgaaaaaaaaaaagaaatatcagaaatataaagagaaataaacagcaagaagactccgtagtaatttaagaagtgaaaacttttaggacagaggtaggagagaaatgggaaacactggagaggaagtaacaactaggaagtgtggaagaaaaacctgcaggccagaaatctgagcaaagacttgagagaggatgatggtaaatgtgaaacattgaaagggatgttttaagggattcagacattgagaggaaagtaaattttcatcacaacaccccatgacgacaggctcaacacatttggattatgagaaaggaaattaacatggttagaacgaaagaataaaaattagtaagagaaatctttggatgtcaatggagaggaggagaaatgatattaaaaggaaagaaggcatgggtggaaagtagaatgagatgagaacctatggtaggtggaggtgaaaaatgaaatgcgtcagggaagatcatgactgggaccgccgcacactgcagtgatgaagacggagaagctattcttcagggaacctgcaaataaaaagaaaccttaagatgtatttggagggaacccaccccagcaaggtgagaaagcaagaggttacattctgcaaaaagagaaaatgaacggggagaagggggaaaactaggggaaagagaaaacagcaaatcaaagttatggagcgtacagcattgaaaggaatgaggcattctgttggaattattcatttaagcatatgggtattggcgtcccttttctaaaaccggatcctctcccttatttctcatttttctataacactattataataaattcacatggaaaagtacaaggatgagcaattttttactttagaaatgtttcaaaaggggaggtaaacttgatggttatctgtctgaagggtgacgcactatagtggcatgtgagaatgaggccagaggtaatcatcagttttgaaattgttctttcaacaaattcataatgcatataaagtaactcgtgcacacatttatggcaaaacatactctagatattaatttatattgcttatactgaagatctcttgagttttcaaaaagtttgatttacagatttttcacatcaaaaattttttgtagattctattttgtaattaagatgtgtagactcctcaataattctttaccttgatgctgtgtatactcatttatctagattaaaatacttccttgccctgaatgttctaaaagtgtaccccttggggctctagaatttagaagtctcccttccccaactatttctagtctaccttttcaattgagttaatataatggctttagaaatacaatttccatgttgctataaaaatggggttaaaagtcataacaggcacaagaaacaggaggaaatgagaattgtgtactttcagtcacacccgggccatgtgctcgggccacatacagcatgcagccctccggagtgggctgtgtaacccggggcacacttgaggtcagggcacatagaggattaatttactgaaggtggtagacaatccctctgccacaaatgcaaacattttttcataagcgcctgaagcaattagttctcttcaataataaatttaatcttttcctccttcctttctttcctcttcgtttctcctctttcttctcttttcctctataaatgctggcctttgtctaagatcttcaactcaaaggtgtagatgccaggaaagaaaaacaaaatcaatgtattgtggtactaacaaataatgctataattattagaaaaaaacagattgaagcaagatacaaaaattctcaaaagcagctatctgtatgaaaatcttttctacttctagagagtatgtgaatgactgtatctttcatatcgtgaaagcagatgcttacatgcaatcacctttaaaaaaagaaacaaactatcacagtagtgacattgcctattttatatgagtagggaaactagccaaatagctttgggaacatttattagccttgtcctttttttttttttttaacttttagtatagagagaaaatagagatgacaggtaggtggctaagtaaggtgacaggatggcagacagcattcctatcagggcagaaagaatttataagggagctgccacttatagcgtaatagagctaagttaagaattgcaaacagagtagggccaagcaacattttaagaacaattgtccttaaacattcttgtaatgctaagtcactcatctttgtttcccacttgcttcctagagttaagaaaagttctttcctaacttgggttgctatgcagagatgtgaaatttcattggctccaaatgcttttctgtctagtagggactactgggaaccctgctaatgtgcatattgatgtaccctgtagcttcacagatgatgaaagagcatattacttatttccacaacaacaaagctaagagaaatttgaaaggagccagttattttacctggggaatttctcccaggtgatggggctatggaaccatggaatttaaatatgggggccgtcctattttctaaaaagtttttatggggagccataatatcactcccaagcagaaatcaaatcaaataaaagactattgctttcatttgcatttatttagtcaactatgcctaaaatacggaaaagatattatcatgctcattcagagtgtattttattcgttgtttactagactggactgacatgatatgatttgtgctttgcggggtcacaacaagctactagcaggacaatttgctgaatcaagaggatgattgtgtctggtgccagtcagtcgcaattaggaccaggatcagggaggcccggggcttgtgcatcgtcttgggcaagctgcatagaaatcagctcacctgaaactaattgtcacaacagagaccttatgcaaatgagccctggggttagcgtgggaaaagaaaaactgtcgcaaagataggtgacctgctgagcagggggtctgttgctggggaaatctttgttcaatgagtttaaaaatgttttcattgttcaaagtccaccccccgccccccccccccccaaaaaaagtagcatacacactcactaagagtatggcaaacacactcatctaaaattccaataaagcagaagcctgctttggagcatgccataaattgggagtctttataagggctacagcaggagaataatttccctttgcaagggcctttaaagtttaggtgctgcggattgcagtgtggcctaccttgaaaattcacttgcaaggtcaagcctattgctagcctggcaggacccgcacagccttttctccctgcattccagcaggccacctccacacagccgtgaggggtgcctgtgaactagacaagaaaggcctagtttctaattgagctttactggtatctcaggtagaagagaagggccaggagcactctcttaacacatggcaaaagaatccggggaaacaatggcagtttcttgaattgtggtttctcaaatactcacaagttcaaatgaaatgcaagcattgtgaaattccaggaatggtaatgcagcccaagtggtaatagatcataaaaatttagcaaaagaaaagtaaaaattatttttaaactatgatttactttgtttttcaatccctgacaaaaacacgtataagttggaaatgacgtttgattttattgtagcactcatttggaataatctttaatatgttttactttagaaaaccagatgaagaaaagttattcaaaggtaatgataaacatttttatacgttactgtagcaaagttgcctttgggttcttcaattgatttttagcttttcaatcttgttttcataaaaacatgggctaacatattgatacttcttagctttacactaaagatttcccagtgacatagtagataatgtatattcacacaggagtataaatataatatcaaggaaatgaaatagagtgttctaagctttagcagtaacagagagcatagatattttgcatctaatgatttcaaagaaagaataatttgaatttaaaaatgtaggtgagagaaaaagaaagtttcattgcattggcgttgaatacaaatgctattttgtttggcaaattactggacctaagaaagtgttttcattgtgtttcctaaagggctggattgaaatttggacttgtacctgataagcaagctcaggaattaacttggtagccaccacaaaacctaaagaaagttaggcttagaagtgcaacttaatcacaatttagattaaaacacacacgcatacacacacatatacaactcttttgtcccttcaccactgtctgaaataatttccacataagagacatttcacagtgggtacgaagtgctcagctttcactcatcaaactttaatcggaactgcattttagtttttgaataaagaacacttaaaaaatttagatgcaaattattttgcattattcatgctctaagtgtccttgtagatttaaacacttctgaggccaccttgattcaagtaattacctaggccctcactgctccgtcatgaataaggtattttgtacaagtaaagtatgcacccgatgagcttttaaagtggctttacactgaacttgtgtattgcttcttgtgcatgagtgagccgaacatgtgtcgcaatctgtctcaggtgggaaaccctggctgggcatccatgggtgacgggatgaaacccgagcgtctccttcacacacatgctcttcctttgtctctacctaagaatgttcctgcctgattctagtagttgttttaagcattaaaaaaaagcaatagattctaggaaaagagacagggaaagtgacagtgattccgcttaaccccttcatcaccagagattattggaaatgcccacttttcaggcctcctcatctccatcagcaaaggcttccttgtaaggtaataagtctctctcattttacatggttctgtacatctgtctccccatctgtcagcccagcatcctgagctattagagctaggtgctacctccaccacggtattcacacgaaatggagcaggcttcaaactcaaaagtagctgaagaatacttacaatggaaatgaaagtgaccatagagcatcaatctgtaagtttatccacacacacaaaaagagggtttgtaagagttaaatgtaactggctgaagcttatagctggcgtttgttacaaagtacccaagcttttcctttccaacttcgtggctttgaagaattataggaattttatgatgtgctgttggagttatactggcagagattacagtaaaggggttaaagttggtttatggtagaaaaaaaattatgcagaaaccaataaaaataaacacactcaagtagactaaacttgctgggcttttagttttacttttaacaaaggaagtttagatgaaagtaaatgttgcagcttttagaaaattagttgacactcatacttgatcatctttactatacagtggtataattaatatttaaacattctaataatgcagcttgctttgcatgcacttttcagcctcacaacattatattttatctggaattgtgctagcattttcttgggtagtgcccattttcatagagttaaatttaaaatagggtagggcctcagctcttattgccagtaaaacatcaataggagagtgaacaggtttcatacatctaccagacagtttattattaagaacaatatttatttgagataatagataatatataaattttgtttcattgccccatgaatgtttttaaatgatcagaatagattaagtttgaaagttgcatttggctgttgtccactcactgttcaaaacaggaggattttgatgatgtcaaggcagtgcgaaatcagcaagtgatacatgaaacatggaacccccatgcctgcccattcattagggcatctgattaacatagtaaggaatgtttattttcagtacataaaattgtagaactttgggagcatcttctgaattgcaaaagctgaacacccaggaacttagtgaaacaataaaaatatagagaagtaagctaatttgtgagaagcctgagctagtttattttcctatgagaagtttcttcctgttccaatctcatggctgtaggtggtagggaaaagttgtttcaggtgctgccctcagctagtccctttgaagagtgcaaggtgcccagtgttcctgatcttctagtttgaatgatgagaaagagcattctacctttccaccatcacttaagtgtcctttgaaattgaatttgcatgcacatatttactgctcattctttttaagtgagtaggtgtgctgagcttcaagtctattttgagactcagcccatgttaaccccttgaggcccacttcatgataggtactgccctgtgggaatcctgtcatttagtgaagcatgaagccataatagatccacagccataccaccattggggcatctcatttcgattaattccctgaagcctttggtgctgtggtttgcagaaatcaaatggcgcaaatgagaactacaaaattaggcaggttaaatttcgcaagaaaaaaaaaagataagtagtagaaaaaatagccagtgtaaaatattagtacacaggagcagtaagtaaactaagttccacactgaaagaaccaccagatctcgagaagtagatatcaagaaacagtttgcactggctgttttatttccttatgtcagaaggaagtaggtttttacagatccttggacatgatcatctttgtttctgatattcagaaacggaaccaacagtttggtgtctatttattttatttggtttgtttttgagaaagcgagttaaataaactcagcttacaaataattaacagcccctggactatttaaaacctgctactgaggtggtagagataagttgaatccaacagctgtcacatgtatgggtttgacagataggtaagtccaagagtggacaaattaaaagcatttttcatatgctaatctccacctgcacaggaataattttttttaaggaggcagtctactggcagagcaaattcaagagctatcagtagtacattacttctaggaattatgacatgcaataatgaataaatacttctatgagaaaagtctgctgtggaatcttaattccagatgggtgtcctgacagcaatgtgccagcaatattgtggaaagaaaaatgacatatatacatacatatatatatacacgcacatatgtatatgtatatatatggcttttaaacttgaataataatttcttccatgtgtaataggttcacaattatatctaaggaattacttttttagttgcgaatagagatcaaagtgaaaacaatagtcaaccttgcccttcaggtggcagttacatgtgagctgcatagtgagtgtgagagacagtcaaggatgtcaatcagaacctacagattaacccacagcagtgaaatctgagatggtttataacaagtagataacagtttcaggcctatgtgagaacgcataaactaaaacttcatgctgggacaaaacagggcaggacatttgaggtagagagtgagaaaaccatacttttattatgacaaagcctctcccatacttgttgaaatgtcactgggttgttattaaatgctcaccatttctctaggttttatattatcttacaaaaagcttttggagtttcctttaattttgataaacattcaaatttgtgcataatttctgcacttcagctttgaatgacagaaaatttcccatgcttgttgagtttcctttcaagtaagaaagtaattcttgtaataaataaaaatgttatatttctttcttccaatgttatcaagttaataaacccttaccttagtttataaagtcaaaatttactaatgtattgaaatgagaaccgaaatactcaaaaagaaatcttaaacatcaaataataacgagggtaatgaatgaatggtcatggttatggatggtgatgatctaatgtaaggtcctatctctttttaatagagagtcctcaggctcagacaatttagggttaaagtgcctataaccagatcagaatcctcagttattacgtagtactcttttaagacccgtgaattaagttataatcaatgattacaacactggtatcatttattaatgtacccttctcttctagggtagcagagatcagtttctgacaccttagaactcttcatgtgcaagaggaaattgaaacaataacaacatatttaggcagtaggcaaaatgatttgctttggctttacctacagggaaacttgggcaatggtcattagacttttttaatggaacttcaagtctgatgccttgtgaccaggtgctaacatggaaaagagttagcatcattgacattctttgattcggaagcacataagaggtagataaggagacaacacaggcgacccacctccaggccaggagaagaggacagttcctggaatgtctgcaatgtgttactatttttgtcacacctatgtgaggccatccatctggtctgaatcaatcagtctcatcccagggctctgctcctctcccagctgaaataatacccttctttcctcagtgctgtcttcaggaggggcgctgctcaggactgcccggacaaggccaattaatgagcctgtgtatttgcaaacgatgacccaggattagacactggagaaaactttctttaaattctctataagctctgctctcctagaaacagtacttgagaaaaccgggtgaatcattagacaaataattgaccccagaaagcgaaagactgatgctacattactttgcatacgtacatcttattttttaaagaaaatgtccttgccttgaatttaaaccatgaattggtctgctgttatacccaaagtagataaagcctgggtgtgaggcattcaccacgacttagcctgaagtattttcttcggccacttcactctcctccacgctacatgttcaatttccctgcacctctgtaacaaccctacacctctgcttctagatcatcttcttggcattcctcatgtgcacatcctgttctctagcagtcccttatccatgccgcctcatcagattcctgcacacctgacagcctcttgcttgctatttcagctactagactactgacctctattgtacatgcctgcaatcccagcactttgggaggccagggtggtaggatggcttgagcccaagaatttaagaccagcctgagcaacatagtgggaccctgtctctaccaaaaaaagaatcaaggtatgcaccagttaagccagccacgttttaggaccacatagcactcttcccacaagagacctcaaaacttaatgacattggctttggcaaattcaataccatgacataaaactactcattttccctatctgcctagttttccattgcagtgggaaataccaccctatcgtggacctcccaaccaggaaccccatggttatttttgtctcactgctgtctttctcactccccacaaccagtctgttaccaaccgttgctactttttctttgccaatgtttcctgaatccacccctttcctttccattctcatagttgtggtcttagtctaggctttggccttggcccatggggactttgcagccttctttcccctctcccaccacattcacatatcaaattccagcttactttatttaataacactgacaaatttttttttctcttgtctatgtttttggtccattcattctctctgagctccattgagactgccagctgctctctggactggcttctaatgttcacttcatacatgtcacctcttcatccagctacctcctaattgttccaatcttttttctttctttttggaggtaagctcttctggtacttctttttttatcgttctcacacttcttcagaaactcttctcatggtatacatgttcctggtacacaccactcaagggcagattctgacactttctttcggtagtccatccgtgcttcctttctgatgtagcaaagtgtcctctttgtgagcacgcccaggttcaaaacttccatttccaccacttgctacctatgacattgggcagttacctgacagcacttcacctcagcttcctcatctgtaaaatggattgttgtgacgagtaataagatcatttatttagagcactgctggcacacagtaagcactgttaacatgtttgctattagtattattatcatatctcataggactccccaatcacaccccgcttcaatcaccatcatgctgtatgccatattatccttgcatgtaaattttgaggaccacataactgggttttaaaaatctggttctaacagtagtttatgtcttagaaatcagggcaaagttaatcgaagatacctaatatcaaaccaggtaatgatgaagactttaaatgctttttgaggatgattataaagaacattatgataagaatgatgatgatatgatgatgatgatgatgatgatgatgatgaagaaaacatgaccaaatgcttctttgggttaatactctgcttataaaacgaagtgtccaggaaacatacagtattcctcctgaaattagtttttttttcccattaaatggaaacatgttatgcataagaacatatattgtgcagtatgcatgagatttatttttcagaaagcagagaaatggcaagaattttaagtgttctacatacttatttagatctcacatcaggagataaaacaaatgaaaactctgacttgttaataatttacgttttggtggaaaattcatacaagctgttaagatacctctaagacccaacacagaaaatgcaaataacatatatccactgtgcactgaagaaaatttgtctgaaaagaaaataacatcaattaaaaaaaaaaaacacaagtgatttcaagggaatgttgaccacatttacagggctgtaattgtgcttattaattttagatgtctcttttgaaatattcgtgtaaatgatctctccacttaccaggtgtttcttacagaaagtccactgggctacctcactacctaggaggtggcttacaaataggggatttctttttagaaagccacaccattacttttctctaacagcttatgcaaaagttttgtgggggagggaaaaacccaagccaaaaaaaaaaaagaaagagagagagagagaagagtgtgcatgacaataactacctctgtcccttaggtttttgttcttttcatgtcatggaactttttagctgtgctgcctgggtaactgctctggaaggttggaatatctgttgttgaaggaggtttgtgattgagggccctctgacacaaccttttgttgcattgaggtgtttgatcctctttccctttcttctaaaaccaatcccatccctttaaaaaatggataaccagcacttcttttacttattgtcagcttttggaaagttactctgggggtttgtagaagtttaactagttaactctttgcatgctgatgtcctgtcgctaaatattcttcttctttctaaacaggaaggattttaatcacttacatcaggtaactaccgctgttatgcaggcatagcaagtgaaacatattaaggtccagaaataaagcatttgtgttcaaggtcttcaaatgtgagagtgattcaggctttgcaatgagacacatccttattttctttttgtcctagaaccgaaacatgtgagagttatgactctgccacttgaaaaaacatgatgatatactaatttttcattgaagaacaacaggctttggtaataagtaaatgcaaagggttacttcagaactggggtacataactgaatggcaacaaagaaagagagccttagaatgaaaagtgtaggggtcttgttccagtctgctgactaaatgctggaatatttttttcccaaaagaagggacacaacccaggctctaggaaagaaaagaagcttaagtggattatttaacaaaaaagcaacttatggcttctagatagtgacctacattctgcacacaataatgatgttttacggtggtgatagggttaataacctaacatcattcatgtagtgttttttgaaaattgaattttactgctacaaagtaaatgtaacagccctctggagacaatattacaggcactttattgtttgctaagctgatgtcatctttctacagactgactttaaaacaaaggcagaacatttattacaaatatcactgtgtgaaaggaaatctactgaaatattgtttagaaggtgagctgataaaaaagtattaatacttggctttgatcatcttgtactataaagttatgacttcaaattttttctcatgtgatctctattcaaggcaaacttcatcctggcaattcctacctgtgtctctaacattatttgccctcaagttgaaacatttgtttaagattcatgcgtgttttaaatacatttttactctctaaggcaatttcttaacagagttgatgagtttttgagagagagagattaaatagcatctttcagagataatatatgtatgattttaaaaacaaagtatggagattaagctgtttagtttatataatgaactttcaaaatcacctgtaagtggtgactgcaaagtttgcaatttaaataagctgtttcaggcactgccaagcaagcattctgcatcacaggttgcttgcaactcagagggtttggtctctgtatctgatgcacgtgtaatacagcgtgaagttgtttgtggatcacacaggagcttcttagagcttcatttccacactataacccttgaaaatgtatcaaatgagcagatgcacttggctcttccttaaaaggcacaagtaatttgtttgtaaatcagttacctttcaagaaaagttaaattagggggaactcttgtttctttgatgttttccctcttagaaagccaaagagcaaattaatgatcattttgaagtaataatgataatgaggaaaatataatttagtgagctacactatcccaaaataactttttcaggtacagcatataaataacagcccaaaggactaaagcagcctgatggtgtttttctaagaaaatgatttactgctctgcctttgtctctgaactctggttagaaggaaaacacaggtcaaggaaattgggttaagggaaaaaaagcctgttatgggctaggtgtagaattatatgaatagtgactaattgggagtctgtagcactcagatcagtgtgtgcaatgctcagtactggctgatggtatttatatcagtcaaaaatgaagctggatacatctttgcgtgctctatgaaggcagtgtgttagttggtgaattggccgtgaccaggagaaagctaccagtagtactatgattgtgactaaaccaagaactgaactgcaatgttttaaaaatttattttactaataagtgtacttctgtatagaaaaatcatttttaaaaaaccttacaactattttgaaacattttactataagcctgcctttgatttgtttgggaagctattttatagtcactcaattcatttattgtatttgacaaatactagctacttaccatgtgccagcaccaaaggttcaaaagtgagccctcacagagccttacagattagtgtcagaaagaactgcttggcaagggtaagagtgtgacacattgtgagtattcaagaaatgtttgttgagtgactgatagaatgaattgagggatgatcaaggtaagtcctcgatttggtatatgtacaaggaggaactaagagtttccctccctgaacaggtcagaaaggacatgcttgagctggccttaaaaaatcacctgagtggcatgtagcatgtgaataatgaacaggaatgggccactggtggtagaaacagcatcccagaatatgctctgagttttagcagcacagcccatttctgacccctgcatgcctcaaagccactttaagaatttggtctttgcccttctgtcctcacccccgttgtactgtaatacacgcaaacatgtgtgtgcatgtacacacacatgcacacacacatgtgctaactccatcgttggaattcgactgtccaccccttcaagaatcaaagcatctcctaaaaaaaggaaatggcatgcctgttccttacttgtatccataaaactcacatttgagttgtctatcatgagacctcagttttttgaccaaacattgtccttaagcatcagacacataagaaaaactggaaagaggaacaggtaatatttaaatcacccactattcttgtaatgaaaggatttttcaaacatcaagatgaaatggttttatcaaattattaaagtttgctttttgtgtccgacttagcaacaagtcatggatgggacactcaaaacaggccaatttgggacagttccaactgtaggaggccttgtgtcattacctctataaatggaatcgagcttcccttcttctgcagctatacattttcttgcctttgatttcccactctgctttctctcccggcaggctcttcctgtctcctctatcagttactctataggcagatgtgcctctttttccatttgccagatccccccaacccagatcttccaaactactcccctttgaagtctctattaccgatacaatcacttttgtttcccttccatcccctctctcactgctccagtttcttctctccctaaccccattagttacatctgctgcccctaccattcagcctgtgttaaatcgtaatgcgcttgacataacttcagtttgtctgctaagtactcaatcagcacgcattgctatcttctgatttgtaggaaagggggcaagactgagtaagctggctcagaattctctgagtgattcagctctgcccaattagcacaaccaaagtgggaaattgacaactaataataatgaaagaaatgggttttagttgtgaatataaatcccacaaacttggttcctgatgcctgtggtagatactgtatgcttcatatggtggtcagatggctcagagaatgcagaagtggatgaatgaaggagagtgtgtcaataattgcaatatttattagttgactgggattctttccctggaattcattaatggattttttaaagactctgcaaaccaccagaaattgtatgtaacatttagtatattgatgcatttttttcctgggcagtgggtccatacgtttaagcagattcttaaaaggctctatgtctccccactatccgcctccaaaaaggtgaagaatcattgctataagtgaagacacctatttggtctatgttttcatgtggtctgctttttttcccagcccattttaacattccacatgatttgagcagttcagagagtagaaacgtagggttttaaaggcaaaatttaccttctttaagaggaaaaatgtttaaaccacctaccaggttatacaattcacattttaaaaattattttagttttaccacaattcaaagacaggcctttttttttttatttaacaatgggtataatcacacatctgaacataagaattagttttatgcagttccatagaaaaccaaaatcttgaggaacactttcaaaacaaccagagaaaaataaaccattccttatgtcagtcttgttagggagggattaagaaactggcaattattttggcgaccttaattgttgcgcggcaggaaaatatgtaattagagcacgttcccaggcctgcacacctgcagcacatcctacagcataatgtcagctttcagtgcctgtcggtgccaggttctagcacaaccagtcacagtgacgctctgagaacatttcggactcatgtaatgtggcttctgtgtatgaaagaagcaggcatttacactaccacacaatggagtgcattgctgcaacactggtttcattattttctgacgcctaccttcagcactgccctggtttactccgtttgaggttttattgttacggtataatagtcctgtacatttttgaaattcccttattattcagcttattaatacagtactgacttgattatcaggctgcagttgcacagcggaagattcagtgcattagctaagtcagaagctgagtaaattcttggtataatgagaacaattgtttgacatttttttatgtagaaagatgggccatggtagttctctatatagttgcattttggaattcactctatattccctatatgttgttgagtattcgtttttcatataaagaaagcttaaaatgtgttctcactaatttgaaaagtgtttcagggtatgggaggactccatcatgattctcattagcttttttcttctttttcttttattggcttttctcaacaaaaagaaactctgacgttagaaaaagtagtgaaaatgaagaaacagtatgcacgatgcctatttttcagataattccataatctggcatagtgatagttaacagacttttcccccctaagggagatacactgtattttgctatctgacatgttgtcatatataaagaaatcaattggtaattaaatgatgcaccttgtgaagatgacaaaaggcatttggttgcgaaaagagaactgggttttgaggggtttgtagtgaaggcctaatgactattcataagagattttcagtccgttgatccacttgactggaaagttctgccctggagagttagtgctgtcagtttctctcacctcagaaagccgccgcaatcgacggtgtagaggatgagcgagaaattatctagtagttgctctaggcctgtcttaggtcacgtgcagaaggcacatctggcttcctgtaggtacaacctcaggacataaactttgactaatttttaaactataaatatgtacgagtgacactgaataagttaccttttattcatatttcctttattttagaatgcatgcaagttgtgtagtaagctgccattttggccttatttttcttccaattttaactgttacacacttgcttgttaagctaagagtgactgtttatgaaagttgtcaaggaccaaatgataacagtctccttatgtgaaatccaacaactctgtgtttgctgagaatatgccaaagttgccctgcaggaagctcacctgaaacaaatacagagtatatgattggatagcgctcttggggggtgtttattgccctatttggcaaaaggcagtaagatatcaaaatgtacatacataggactggatacaaggctgccaccacatcaagatctctagaattgcagaacattgttgctccagtgtcttcataaacacaatcacaaaaactacgatgaaaattcatgcattcaaaacagaccagttactgtccaccatggaccaggcaccatcctagctttggaggagacaaacatgagggaagtaaaatctcagtgctcatagtttactgaggaacagacaaataagaaaacagttacactacaacatgtaaagagttatgattgagttgtataatagcacagagtttagaatccaggaaagggttttctgagaactgttggggtctacaaacggggtaaagatttcttatacgagctactctttccattgccaaagccaaattagctggcggaaaggtgagttggacaagtgaggtgtttctgttgcatgtggaatctcaacagaacagtagtggccagcaatttctgtacatatttactcttggaaagtgcttctccatgttatcttatcaagaagctcacctaatcaaaggtaaacacatttatcgcctcattaaggcttgttttatggccacttcgatgtcatgtttgaggtagaagtacctgtcacagtctttgtctggaatgtatgtaaaagggatttcatggacactgcagaggttttaatctttcaatatcaaaataatttaatgcataatatgtatttgagaagatgtcactggtgattcctacttgtgtactgtgtgtactgagttttgctgacacatttgctagagctgtcaaggtggaccaaatgaatggacagatgccaaaaaaacaattatgcttattaatgtacattgattgcttgtttaggttataaaacaaattaaaaaaaaccattagtatttaaacccttttatagctgagctaatgattgcttgtaatatagtgtctggtaaagaatattctataatacctgtaaagcccagctatgttatctaattagtagactttgatttaagtggctgtaattatggaattgaatagttgcctttctaaataaccaaatggtagatttaaatatataaagatgttgacttgattatttaatatttgtagcaaagacaaaccacctaaatagagagattaattccacatcagtgcaacattaaaagggagagaggatgccaagaatcccattaatttgggatataagtgtctgaaatttcctcaaaacatttacgccaaggaataccaacaagacaatatcaagcagctctccctaaggatagagaggtaaggcaaacatgattttaaactgcacaatatcacacagtaaaattaaggacaatgtgttccaccagatgctaaacacagccatttatcgagctacaaggttctagactaagtaagtgttttgtatacatattagctccatattacctccatgacctctttccccatgaagccttccctgagcctcagtatccactctttcctgtaccatgaatccatttttcttttactttttcttttctttctttcttttctctctctctcgcttgctctttctttctttctctctctgtctttctttttttgttttttgttttttgttttttgttttttgagacagggtctcactctggcacccaggctggagtgcagtggcacaatcatggttcactgcagccttgacctcacaggctcaaaccatcctcctgcattagcctcccaagtagcttggaccacaggcatgcaccaccatgcccagataatttttttttttattttttgtagagacggggtctcactatgtcacccaaactggtcttgaattcctgggctcaagtgattctcccacctcagcctcccaaagtgctgggattacaagtgtgagccactgcacccagcccatgttttcaataaagatggtgctatttgaaactatggcatgtcacgtgtatattattttatttcaccatgtgtttaaatgagataaccaggtgccaagaaagcttcaatatttgcttaaatagccaatgtgacggagaataggtaacctcttttctttttttttcttatgatttgctttggctattagttttgaaacatacatgttatattcccaattagatctcgttacatccttcacaggctgtccaaaaatttccatacttctaacaagaacttcggttgactgagtttatattatatagtttttctgtcctttgccctatttctttcaaggcctttgagtcagaagcattcagcaccacggcgtacgatagccaccatttgctttgcccttttaactttgggggttacttctgaccatagtccaactgctcagaagggctttttcacaaattgtttaccgtggcagttgctaccctattggggtttgcattcagaacccataagcagagagcaatggtgtcagtataacaaataatgtgtacaattttttaaaatgctgaatttaccaaatccccatattatgttttcacactgctctttcagaaactgtgctaatacaatactcctataaactgatcttggtcctggcaggccctgttggaactaatggggcctgacagttcttcagttaaaaattatacatgagggccactttcccttaaattatctattgtatgccagctgttcacaactgcactgcttcactttctttgcagtgctagaaatgtctaattttctcataatatccatagcaactattctcatggagggcattgaagttagtaagacttcaaacacaccttcacagaaatcatgctagagttgcagtttccattttctttaattttttggttctgaaaaatgtttagatggctcattttgccggtttcatgccatagcacttgagttatatcataatttctcatttgctgcacaactttattctatttttatgctcctaaatgacgcagctctaagtacccgtgagtggcacttccgtgctgtgagtgctatcaaaggcaacctcagatggataaaactcctggttttttgttttcttttgttttttgttttgtttttgttttgtttttgctggggaggggagaagcggagtcatcaccaagggccttcttttgtttttcaggcatgttaaaactgtataaccaacagaaccatttaaaaggaagaaaaacatcacccaagttccgtgtctgaatgaaggctgtcttctcaaatgctcctcattactccagagcagttatatttggattataattaaaacgaggcttcttttttttcttttattcttcttttttcccagaatgcctcaagtgaagtattcctcccaaagttattgcacctctttactaacaagtgctgggattttaataagcctgtcccccctccttaccctgtacagaggaaaggatggcaaagagtggctgtggtacaaaggttacatattcagtgatattttctgcttttattggtaaaaatggggaggtgggtggaggatttcctttaattatgaaataagtgtgatgttagtagttatttctgtaacctggtgaaaatgctgcatatttcaggcctaatttttagcatatgttaccacgtgtgtaataaaacggtgatctgcgctctccgaatcttttggctgttaaggagcactctgattataactagttgctgtagaaacctggtcatccagatgcttatcaagaatgcattattattttttaaaccttggtggagaagccacagactgcagcagttggacaaggtcacatatcgatggaagtgacatgtctttcctctttccattgtgtgatcgtccagggcctgggggcattaatatgcaacggttctgtttttctttcagaaggacttgtaaactctttaaacagaggcacacagttgcaattgttgcggtactgagtgggtgtatagaagctagggctgcagccttgtccagttgcagatagaataaaactgacaatgatgcaatgggcctggcatgtagacaactctgtgggatggatgaatggtgcggctctcgctgtccctccggtggtggtaggccctgtaatagctagcgtaggaagggtggtgaaaattgatatgcactattactacacgtataaaacttaacactggggccattgcacaggtggggggttcctgtttattgatttttatgagtttgttagaacatgcgcttaatgcttttatactccgggagctctgggagggctcaccttaggtaataaacctttccgtactttgcaatcgctcacaatttacatggggactcacattatccagtacaaagcccagcattccccttctacttggttttaggagtgtgataaaaaaaaaaaaagaaaaagaaaagaaaataactatagcacttactttgaattttttgaaaacctgtccactcccgctatgaaaatggcccctaattctaattactcatatttccaagaaaaattagtcacacaaacttatgttatgtgttgtctcagaggttgaaagcaaatcaggtttccaataagacagtacatcaaacaaagtagcatgttcttgatgccgatgacttttttttagaattatggttggacatttttggcagacagattgtcttttgctctatcaaaatgacagtttcttttgtaactgcaacattcataattagaaggagagaagcaatctgcccaatttaatatactaaaagaagtttagagtctctgctagtaatttcattatttttaaatttgaattaattgacttaaaataatacagttaagaagtataaccagcaggattatggagaaaggtttctttttccttaaaaaaaaacagtgctctcagtgttacacttaagatgagattgaaattttcttttttacgccaggtgccccgttctaagattcagagcagcaatgtgaatattcatccttgcagtggagctgagagaagttgtagggcaaatcctgggaacaaggtcactttaaacaaaaaagttctccaagtttcccatgcttataaggctggctgggcttaattaaagtcaatggatgaccaaaaaataaataaataaatagagagagagagaaagaaaagaaaatgaaagaacaaccacccaccccatatcagtctctttctaggcctcacttcacattgtataccttagccgttgatgttcaagctctttacatagatcaagaataatatttcttaaatcccttaacaacactgacgtgtccatggtttaatcactcttccccagtccacatctctaacctacgtcacttgggtggccctcacccacagcaccacaacaaaaacaaagccagaattgcattcagaatgaaatcatcataacatagcaaccttgttcaggatgtgacctttgggtttcagcaaccctgtcttatgcagccctggccaaccttaacctttcctgttggctcggagggtaacctttcttcatattttcttcaggatctctccttacgggacccagtatgttgcatgcctatgatgcacagggccaaaagtttcggagtgttaaaatctacgagcctgttttcctctatgagagaatgaagcctgcactcattttaaagaatacatacgtagcaagatctctttttacccttcctgtataattttggttatgcttaactctaaaggaaaccaattctctttagctctgttaccttatttcgtaccttagctgattgtcatctttacatgagcatcagatatggatgtgacaaagattttttagaaataataacgaccagtgctttatgagttgtgaagtgtttttctctcccacaagaaattacaacacaaagtgccctatgcatttttttagtatgttgataagacagcaggaaattttttaaccctcaaaactttctgattataagctgtgctctaaatttacacgggcagtgttccaagtcccacactcctttacaagtatatcattacagacctgcaagtgagaaggtaaatttccccatggcagttctgaaatctgacttcaggctaagaggccatggactgagagggctgattgtgctgggtacctacatatcaaaatctcctctagtattttagtagttccttctgtcctttttgcagccccgtgtcctacagaagtgacattttgttccattttcatttatcttactctccttagttgtatatcaaaagatatacacatttatataacccaagaagccagggattaaagcacaatatttcttaacacagcttcctctaagatctccagtagctacctaatgcttaaagcttgggctgacgtgggttatggggttatagtagctttatagatatttctatttgtgtatgctatgtttatatatgtaatacatatatgtgtggcttagggctatactgacatgttattttctatgtgttcatttattataaacagcaggcaagcagacgtttcacctcacacctcactctggtctctatcattcaaaaaatattgcaagattcccattctaaattaaatacatccgagcttacgtcttttatcaattctttattcttggtatctcaaaattctggtcttcgtcctttgtctcaaaaagggaaactgctgaaagcatttccacctggatgtttaaattatttaagttgcaggaaccagaccttttccctcctgagtagttgtgggttttaaaggctaaaattgcttcatcatgccaaagtgaaagtatgcataaattatttagttaaacctgagaaaatacagacttttcccagtgatctttcaagggctgcctacttaaatttcagaagaatgggcaagatttttttttcattctcttagaaaattgaagtatctcttgtgtcttctgtcagttggaatgtgaacaaaattacaaaatggtaatttttttaaaattccaagcttcataatatccagtatatctatatcattccaaggtgaatactgtgataatcaatcaataccaggaagactcctccagctggcgagaactgcaaaccctctctcaatgtattcttaggaaaatcaggcaacttgttataggtctttccctagtgccaacctaaagactggggggcatttccgattcaatttctagtcatccagagttggtatttcagttttaaaagtagaaagttaggtaattttaagatgttatgaaaactttgttgacatttttaatttgctttttaaatttacctttacttcagtaaataaaaataccagaaaagtgtgaagttgtgtggtggtggtggtggttggggtgtgtgtgtgtttgtgtgtgtatgtgtgtgtataagatagataatattaaagtagcaatgaaaacagcccagaaatataggcaattgaggcccaatttcaagtttctgtagcataaggcatgtatattacagaatgtaccacattatgtatctgatctctaaattcgccttagtataaatgctccaagtacattcttatgaccaagaaaagaatggtatttttaattgaatacctaacctcaaatcctgaaagaaacattaattgggacaggacaaaatgtcaacaaaaaagtacttatgtgagttatttagtatacagctgtctgttcatttgtagaatccatttgaattttatgttcagagaaattgggagatgagagtaaatatggggggagattggcatgtaaatttgttgagttttcatgaaaaaataaaaatttaaaaaaccttccaagcaaaataaaacctgttccattcacaaatgatggatgtcactgatcccattaatacctgttacataccaggtcctcttccttatatctaacttgctttttctcccaatttcagtgtagttgctcttgaccttgcctttgttcttctctcctccttctctcttctgcccaggcacagttatgtccactaaaccagatgaacaagatttcatactgacaccaccatactctgttaaatagttaaaaatcctattttggcttttgtttgctcacttagatttgtacacccaaggtgatgaagagagcacagatagaatctagagacaaatagtttctggagtcaggaatcagatccagattctaacacgaggtgatgtgggaaaaagtcagttaaaatttctgagattcaatttactcatctataaaatcatcctcataataattgctccccccttcaaaggtttgttatgaggagcaagtggaaaaatgtctattaacgggctctgctgtcagtagattaatgcataaatccaggtattattatataatcaaactgtccttttaaatgtagaagaaaagggtttttaaggcacacatgagattctggaaacgtagacgttatagaaagtctatagggactaaaaatgcattgtcttctatatgcatttatcttgccagaggtacatgcagacctttggggggtgctgctctggccaggacagtggtggagagctctgactcttgagtgtgagagctggaacgattgagaaaagacaggagggaaacttcgaggtcaggtgacttctttctaactacagcaggttctcagatccctaggctggcccaagatgagagaacagtcaccaaagagagtctggcacagtaagcctaagtctcagtgtcatctgattgtgaaatctgcttgtttgcatactcatacagtaccagagcttaagccctggccactgtacggatgactgtacaagagcagaatctaagaccaaggggttgtttttactaaggaagaaaaatttattagagttacttcaaggaaatctattagattatctcaccaaatacattaatagcatcaattattgtattttacataattttttttacaccagatacacagtatattaaagaatttgtggaagtcccccatgtgaaccagtattaaccatgataagagtaatcaggactggcccaagaaaggtagaaatgagaatttataaacttgtctaattctcattgcttgaagaaaattgaaatgaaagaatccaaaaagggatttatgaatattttttaaagcttaaaaagcccacatacttatcatcgaattgtctgcttacgataggagctggaagagtcccttatatccactcaactgtacttacattttaaatggttgttttcctttctcttacactactacaagagaaaggaaatgcctaggcaaataaactcagttaaaataactttatggttgtgacacagtttgacaaaagcaaaggaaattcagagtcactgctcacactgtatcctcagctgattccaactgtggaaaataaaatgctttaaaaaaaaaaaacaatggaacaaacttgggatggatttagtcttagtcttagaggcagccttcttaaatgctgaatctctgagttcgccatctttaagttcttataagagttgcaatatctgtattcatcataaatctagtcagagttaaagaagagtatttggttaagtactgcttggaaaatatgttgtccttttttaagattatgtgattctaactcaaagctgtaacttcttgggggttaataacctaccttgagatatactttaagtaataataatggcttcttgggattaggaaagatattaaacttacccatttccaacgatcctgtactattgcaggagagatgtggggagggagagaaagagaaagagagagagacgagagaaacattttgaccaaaattccatattcactattgctatgcaaattataaacctaacagagaggtgatgtatcatttttattaaacttatgctgcacaaatagtgtttacatagaagagtataaagttaattccctcccgggaagcatttctaaaaaatataaattgtattttgagagttaatcaatttgttttttctcttttggcattttaattgaagcttccaaaccgtatgcttcctcaaagtatcagaaggcaaatatcagtcgtgtggttataaaatcaactcttaattttctttcaatgaagtagcagatagtcagcctgtaaattttacctacattactatggagctgcagtgctataaattcaaaacagtgtgcaggttggtggaaattgaggtccaggcagcaaggcatgtccataaacttttctcaggttattggaacagaacgaatcaaaagcggttcctggttgtatgatattctcttttgatagagcaggctgcttgttgttagcaatccaagtgcagaggttagtcagagcagaatgtaatttctagcaatctgacagacctgcggattgaagcggcaggttttcccttccgatttcagggaattgcttcttactgtgacaaatgattagctgttatctctgactgaatttgatttctacaagcagctgagtcaggtaactttgcagcgtttgagggggttttttacaggaaatgaaatcggctccctagtcatatgtggaccaaatgaaatcttctctgtcagggcaaaattgtgcttttggttaattgaaggcagatttagcatagagggtgtgtgtggtgatgtgtgtgcagggtgtgtgtgtgtgatgctctgatggtgtaggcaggcacacccatgtgtgtacatttacaggaacgagggatcatttcatggattctctcccaactttgaaaatcctgggttcaaacaaaatccctacattctgagcagggttgaagcttttagaataaactataagtggagacagtcatgtgggtgtcagaataatgagccttcatataaggacatcctgtttcaaaagagtttgaactgcaatattaatcaaaacacaatagatactcactgagcatggttttcacaaaagtattcatcaaagggcagctgcattcaaagcaagagatttaggtaaaataagttaatccttgatctcatccaggtttgtgtgtaaattttgaatagggaggggttctagtgatagcaagcgtcctctggatgataaaacaaaaaacgtggcatgggaaattccaggtttatcttgtgcttcttgttcgcttttgatggaatcttaatagtgactacacaattaggatcaggtttatccttctgtttatagtttgtaattgctctggaaatcctgagtttcagtagttcaacttttagtttttaagcagtcggtgagttttttaaaaagttactatcggataatgtttcatagtttctaatcctattacagcaatgtaaaataaactgtatttcccaaatacgaagcaacatcttttattcccagacctcttactttgcaaagaggaaacaccatctttaaggtcatactagtaatactccttattttgtgatgaacataatatactttgtttataaatcctagtttaaaacaacagagatttgtggtaattgacgaagagtaaaaaagtcacaaatactgaatcttcatttttcagatgtgagcacaacattcctaggtatgtactaatatattctaacacggcattgcgctgtcatcaagacttttgtctaaatgtcaccactattatgagcaatacttttgctaaattctttagttgtattccctaaatggcagatacctttggacctctctctcattagctattaaaaagaatagttctttgaaaataacagttctgtgctccctaaacttcttttgttttttgttgagtgatgtcaacttagagttccacactgattgcccttcctccttgctttgtcgccacaaaaggggtgagggggtgccggagtttgacccacacctctggttagtattaatcacacagacatcaggtaatcacctaagtgcactcagacatactaatagaatgatttacagaccaggccctttgtgtttttctaaatctcattttaatttatttaaagtgacagtgaagctagactccaagctaatgagtctgcataaaaatgatttctttttccacctttgtgtttgctaaaactttctgactctgaaatcctgtcagtgaaaaattatttgagatgaaacactgcaaaagaaggtaaggggaaaggagacaaagaatatgatttgatcatcagagacctgccctgggtccaagtgggcctcatggtagccacaagtgtccagatcagacaaatggggacttttgcatatatgttttagtgcttcatccagacttgagtgcttcacagagtctgtgaggcaactcacatcctttggtagctaacaaattggtcctttctgaccagcaagcagtttaagaaagctaagctgtgttgtatgcgtattaaatatagcacgaactgcttggctttgcttaaccttagttgtattaacagattgtttgttttgatgactgcgccgttagcatgccagatgataaggaaatggttttggattagttaggacctataatatagaaactaaataagatgatagacttacaaggatatacatttcctgtaaaaaaaaatgaattcccttatcaggatttacttgaaaggaatatgtcttattacagaaggagaatgccttgaggaatgtgggaaagattaaaggcttttgtcagtagtttaggttgggaccaggtttcctgtgtagccagcccccctgtccccacgtaaatgttttgcttttcctcctctctctctttctctttaaggggaagagtaagcccttctcgctgcctggcggtgtcagattaaataccgagatggcgacaggaaaaaggctggaaggaaaaacaaaagacaggggggtgagagttatcaggttggcgacggaactgcaggcttgtcggactccaatttacagaaatccaaacagattttagttgacacgatctgcaatcattaccgccggagcagagctaattaagaaattagctttcctgattgcctgttctcacagtgatgagtagttgaataatgttgtatggctgaaatgttctaaaaccagacagtttaacaagtgtttagccttttgtggtgatgctgtatttactttatctataatatctgtgctgcatcactatttgtttcctctccttagaagcaccccttgactttttttttccttttccttggttcaccctcttcttcttggcattaagtcagagcttccccccttacttcagccgcgtataggagagaattatcatacagatttgtggcatgtggtacagaaaagttatcggaaacttgtggcacattcaaaagcatatttcctacccgtctaggcatttttcacaagaaaatatcaggtccaaagtggcatttgaagtttctgaatctgactaaatgcagaggtgattgtgaataaataacattaaaaggctttagtcagcaaagatacagtacgagtgagtggagctcattagaaactagccgtggaccccagatatgtcaaaggggggtttgctgagaggtgaccacgcagtcttcataacttcctcatctctcccacaactatcaaacacataggaagatgttatttggagaaaaaaaatagttatgtttaaaaagcttgacaaagaaattaatcaaaatgagcttcatggaccttgtaaaatatggtccaggcacatgtaatgcatatgtaataggcatgcgtaccgatgtgtccatatggacaaatagaaaacccaagagttaaaagtttctgcaaaaagacaacaacttctttccaaattaaatagaaggcttatttgaatataaactttctcgcaatacagcaaaataacaaagattggacaaaggtttccaggtgtcactgttgaaactgcaatgggaggtaagagtattgctagcttcccaaatgaaccacagaaggggaagttgcatcattcaagatgcttatcctttaggatttccaagttttaaaatgtaaatattcatctatggaaaaaccaaaatttccaagttttcctagtacaccttcaaatcatttctacacctaagaaaaataaatactaatttttcttaatgaggcctaataacacctttaacttaccattttaagagacgctaagtcaatacaatgtgcaggtcccttctggatatttattttcctaagcacaaattcatttataccgaaaaaacagtggatgaaatactagaaaaatcttttctgcactggacctctcttttccagatttacctaagagaatcttaccaggaatggagatagacttttacttcctaagtagatttaaatttaacaccaatttattcactctagtatttctatatgggaactaacagcttctataggacctctacaaagtgccagaaatatgatctcatgtgtagtaataaatttaaatgtgttttcttttacatattctatccctccgtattttcccaatctcttccttttttatgactcccccactctcagtttctaaaatcacttgtccactccggagacccaggggcactgcctagagaaggagctaactttaaaaaaaataaaccaggctggtcacagtggctgatgcctgtaatcccagcgctttgggaggccaaggcaggcggatcacctgaggtcaggagtttgagaccagcctggccaacacatggtgaaaccccatctctactaagaatacaaaaattaaccaggcgtggtggtgggcgcctgtaatcccagctactcgggaagctgaggcaggagaattgcttgaacccgggaggcggaggttgcagtgaaccaaggtcatgccactgcactccagcctgggtgactgagtgagactccagctcaaaaacaaaacaaaacaaaaaaagcaccatactcagagctgctataagtaacatgcagttgtaagccacacacttctttgcatgattcttattttaaagattggaaagtagaattcgtatttgtttgttgtactaattccagtggtatacctggaattaataaatggtactaagacactaaggcgttactttcttgcattattctaaatcagagtgttgattagagagaataatccaaaggtaaaatagtcagataatttatttttatgtaagtttaaaaagagaaagagattgatttttttgaagagttataattacattcagtatgtaccttttgtgcattgaaataattttagattttctgaaaaggaaatattgatgtaattcagctctcaaaacacttgatgccatgcctttcttcctagtgtttatgtaaaagcaagtggtcaattgtcgctgcatcagagctatgacaagttcttctatattaggtgggcatcactcaaacacttttccatagtagatccagtggtatacctggaattaatacaatttattaagtactaagctatgttgtatttattgtattaattccagtggtaatacaattccagtggtaatacaatgtattaattccaggtatacctaccactggaattaatacaataaatacaacatagcttactactcaagtctattacacgccatctaaaatagctaatcagaaaggctgtatgtctgaaacacccaaaagtcactcatcctctttcttaaagcattaaaagttttggcaacttttctgaatccgagttgtgtgagtcctatactgtactaagctggacatcttaagggctgcaggttttaatatttacactgccccgactcagttggtaaccgctagcaaatcatctcaccccagtttttgtccttttcctgaagaaagctgaatttggtttcatgatcactgtttgctgaagaagacagtcccaacaatggtccaaagcaaggccagcttttaaaacagccaccaactctgagtcaaggcatctaccttcattctaatcaagaagggaagatacaaagtttcaagaccagtcttcaccttgcactgaatctgacggggtcttactcagccactttccactacctttcaacctaaaagccaagaaaagcaaggatttggattttaaagctgtacttgttataggtgttcatgggttttgttagcattgttgttttttagggatgaggggtgttactggagtggaagggggagctgtgttgcttttagtttgtcatttaggatgttaaagttagtatgggtttcagtttgcattttaaaaattagaatggtaatgagcaaggtgccagaaggaaataacaaagcacattttcctgaatagctccccctgtcttctgtgttcagattctactctgacttcccaacccggcttcctctcccgcctgctcccttctgaggtgcagtgtagaagttcattctcaggtttctctcagtttgcaggacgagatgctgccggccaggccaagggcagttatgccagctcagtgtagtgcagcttccttgccccagcgtgcgcaggctgaaagctcagccagtttctctttctgaggctgcttcacgtcttctcagggatttccaaggcacggacgttcatttgcctaaaactctcttaaactgcctgacaaaaaaaataagtacctaagtacgacataagtggtacacccacgcaggataattaggattgatgtgctcttttagaggcaccagatcctcaacctccccttactagtggcatttctcacctgctcatgtggtgcccacctgtggcttgctggcattgccactgcctgcgagtggggagatttccaagttcaaaatgaaggcctgattttacatggtggaacgctgtaggactgtgtggagctctgtgaaggaattaaggatggcatgaagtcctagtttatgtcactgctcccttgtttatgttctttccttgactattcccacgccccctctccagattttgcatggcttttatagcctctagtaattatatcagcagcatggagtctatttttatctcttctgaatgtgtgcaacgtaaatgtcaaaaaccataaaggccctttttagcatgtaccttgcatgcacagtttgaaaagtgtgatgcagcgttcagagagatgttgcattttgaggtgagacagatgaaaagtggaaaactcaatttcaccacttagctgcgtgaactttcagtaagtcctttatcatcttgaacgtttagcattttcttctgtaaaatggagtccggctgcctacctcatagggtggcagcatggaacctagtttagtgtctgggatgccccctttccacagcaggtgcccccaaactcctaaattatatatttcatgcttaaatgtcatgacctttcaatgccctgcattgccctttatccaacttagaaacggagtaaaaataaaatcttaccactgtaagtcacaataggattgtcacaaaattagcatgtgaaagaatgatacggaactcactgtcaccaaaaaactgtccctagacttggctaataattataataatacctagcatttattactaagcactttctgggagctggtctctaggtgctttacatgtaaccttcacaaccatccactgacccagtggatagatattcttgtcctccacttaataaaggaggacatggaggcaggttagataacttaacaaaagtcacaagttaggaagttagtcagctggattcaaattgaagcatcctgatcccagaacctacagaaatataaaatgtctatcaggcaggagcattcacatggctgagctgccccagcttctaggcaaggttgtttcctctctttgcacttcctatttgaagttgggccctgaaagcggctagatgggcccgtcagaagggcatgcgaagctgcagtcccttactcagctacgagttagggaccatcatgcttcaaaggggaaatggcctcagcatgtttaggtagtccagtaccatggtacagtttttatggctcattaatttatctttaattgaagataagttgggagaatttagagttgtgagaaaatgtgttgttttctagtcaaaaattctcctgtagttgtgatgaatggacaagatgggagtaactgggggatgtggtaagggataataataaataataaagagcatatttgtaggccctcaacaaaatctagtgatggaaggaagaacatatataggcatgttagacatatgagaaatatcataatacattttatgggtaagctaagaagaaccagttatgcaaattttctctacttttttatgaactacttattgattaccccagtcatttttccattgctaccactgcataaagcagaggaagccagtgcagtcagaaccctcttatttatacagtaaaggctattaccgaccaagtacttagcagccagagaaatcttgcgtgtaaaacagaactgggatctgaagaacttagaatatgtcatttaaagaaatatgatcactggtatgtactaaagtgctccaactttttaaaaactttaaaatcagttgactgaaatttacagttattaaacttaattcttttttttttttttttttgaaacagtgtctcactctgtcacccaggctggagtgccgtggcgcgatctcagctcactgcaacctccatctcttgggttcaagcaattctcccacctcagcctccccagtagttgggactacaggtgcaggccaccatgcccggctaatttttgtaatttttggtagagatggggtttcaccatgttggccaggctggtctcgaactcctgacctcaggtaatccgcctgcctcagcctcccaaagtgctgggattacaggtgtgagccaccgcgtccagccaattgttagtctttggtacggtgcccatgagtcatcaaactcatatgtggaagtttttgaaagaagaaaaaaaaatgagagtagattgattaatgactattaaaaatagcctgggatctacgaatacccatagtaaagagcaccaggcactggatagataattggtctaaagagcctggaccttgctgaagataatatatacatgtaacatgttttgtgaaaatggagtcctgaagatgaaaggtgtatcttttccatattgactacgtgacttaattgctcacttactaggctgagaaaggggagcagaggggatgtggagagggaagaaggagggaaggaaggaaagaaggaaggaaggatagagggaggaagcaaggaagggagggagaaaagaagggaggaaggaaggatgtggaaggacggaaagaggggaaaggatgattcaatatcctttgactactaacatatggcctatttggggaagtagacgatggtgcatggagtctcctgaaagcatcatatgaatgtttgaaaatgttattgcccacacagtgcaagtgcatttaggtatgttttaagataggtgggctaactctgaactagggattcccaagtttaactgccttatgaaggttagaatttgagcacttaagttcagggaaggaaggaaggaagggggagagagaagaagggagacggcactgcaggtagagtatccccacatgtcttacctcttctgaaaggctgatgcaacaaatgcgactgaaaagccaaagtatggatacgttttcaatttatttctaaagagttcaatttaataactgtctgagactgaaaccattgacacagcagagcttctagtaattataattctgagattccccaaagtggaaagtcctaggaatactgcctgaaatgacagtgcatttgctgttcaggtaaaattctttaggaattttctctgattctgatttctatttctaaaattttcgatcatcttcaccattttcccccaaaaaatgaggggtgcatttctgtcattttgtgtgtggttgggtggtattgttgcgtctcagttaggggttgtgaaatggaagctctggagggaggaaaggcattcttggtttgcaactgagagcaaaaggtaccacctaagcatcttctgtgagactagggtgcttcctttagataaatgtgtatctgtaatcagcttaactaagcaggtaaggtgttcattagctaggcagggttttcaaagagagagagagggagagtgagaggaagagagagagaatgaatgtggaagagtgagaagaacaaacaagtcaaagcatttgttcatgctgcaatctacacatcaattatcccgctgtgctaattaccacctttccataccccaggtacctaagcattcacacttactcactttcatgcctctgatcaaaaaaaaaaaaaaaaaaaaagaggaggaaagaaatgatagaagcaggggatgatgaacccagaggagaaatacattcttagatcaaaatttcctttacatatgaaagtataaataaggggtcttctccatcttgccattgttgttttagacaattaaatatttgcaaatgttttaattgcaaaatattacttactgtcaggcttccaggagtgcttccatctcatcagcccttgtttccatacttaaaagaagacagagaggtgagaattgctggtcttgcctgagattttggggttgtgccattagaatgagatcagatcattaaaagtcagtgactactaattatcaggctacttttctgaggctattcaagaattgggcagtgaggagccagagagctacctttgtatcaaaaccttggtgttccccctcaccgactgaaccttcatctaacaattaaacattctttattatgatgaaatctgggcttggaatccctgttggtttgtgggcttccttgtcagggtgctcattttctcatttcagagtgaagttggataaaaagaaaacctatttcctgtagctcatttgatacctggtggggatgctattcaggtgacaaggatacaggcacagagggggaacagatgtgatttacacactcattatcatttgaatgaaagtgcagataggcctgttcaggggcctgggcatcacctggacagctttccttctgatctttatcccatctgagaggccaggtccccctgacatctttaaatccccgacccccagctggtgacacacagagttttatgacagtcagcagtcctctgaagctccaagcacagatgccattcagaattgtgcttcacactgtttttttcattgtgttcaggcttaatcaggaatatatccaaaaaaagcttaacttgaataatttcttttggtacttctccagaaacctgtttgccactcgaagtttgtgtatagtattctaaagggcctcagattttgtgttcttaaagttatgtgcatacgtagctgcttcagctttcgaaaaaggacaacaaaatggaaaggaccataagttatagatgtcatcaaagtcttatgtttctacgactatcagatcagatgagcttagtattgtggtagatgcagtcagaatgttagagtgcaaagacaatagaaagtttggatgaagctaccaaaaagaaaagtttctgtttggcctcttttgctcttcataaaggattttcagcgtctttgttttgctacctggaatggctgctgtcaccatgatctctcaagcattttgttacttatttgtgggatgtgtgaataacatggaaaaattgctatgtcatctgaagacctcaaatgatgagtcctgaacagtacaaactgtttttttttttttaaatacattttcaagaaagcttgctttcgttcaggacaagaatgcacaacaaccttgaataactttgtttttaaccttcccttatctcaggcagcctgacagttttggtggggagcgaaaagtgaaaggaatctgtgagaacaaatactgtggtgtttcatgattttaattaggtattgtattaaagagaaaaatataatgaacacaagcacatacacattttatttcccatctaacattaacagttaaagaaaacaatcactatcaaattactttgttacagtccataattacaactcaggttacgcttaactgttattaacagaatgtacagtaatatgttctggcatcgtaatatgttattgtagcattataattaatcttacaggaagtataataaatttacagtatcagattgaagcaatactgcatatagatttattaatgcttttaatcagttctggcaaaattaattttgcactgattgcttacattggaatttgcatatacttagtgaaagtaatttattttttatggattcctttttattaaaatagggcatatggccctttagctaaaaaactttgtggattctttagctaaaaacatttctaaacattttgaaatgccatatatcttccctttaagataattctttctcttaagatttatttttaaattatattctttaaaatacttttttaactcttatttcaatgatctattttttgaaactgtaatatttatttccctattgtcattagcctacttttccccaaggatctaagtttgaataaaaacacaggccttgaaaaatatctacattgataagggactgcattaacatttcagaaagtgtcatgtgaaaattaaatatcattgaaaaataatgaaattttactctttgaaaagtccagtaaaaatgggacagcacatgagaattttgccattatttctaagtgcaactatgttacaatactccaaaatgctttctgtgccacgcaatgtatgtgcagaaaaaaggcgagtgcagattttttaaaaaaacttaaactgatatcagtgttgtaagttcaaaaatagtattgagaaaaatatacctaaagtgtctttctattaaaatatacatgctttgtaaggaaaggtaaattattcaccaaaaaaaatcaagatgtcttcataaaatatatgtttactatatcttaacttgtcaggcaatttgaaattttgaataaactcatcacttaaatctttattttacctctttcaaaaatagtaaattaggtgttcctgtaggtattgattaatttattttgcaaaaaatatttgaagaataagggaagagtgatttcttattcttataagtcttaacaataaatatgttccttggcttgaaaattgagtgagcctaacagtacatagctttcttttcctatgttagtgagttacattatgtaaagcatattcatgaacttatatagattctgggtagttctgatgatatgaaactaaattttttaaataatttaactgaatattttgatattgcttgtatcaggaatttcttcactaaaagagcatatatgcaacagtgtgacctctttgggctcaatacaaaagtgatttgtacagtgattctgtgattttccaccataataaattgagaaaggcaggtcttggtaaaactttatagtcatgtatgaatacccatattcaggtcttcacctccaagagacattcattttaatttatgtcgttgtttatcatcaaggaagattttgaacttttgagaattggcctttatctgtcctaaacctctaacattccactgtatcttaatgaaacggaggttctgttctttctgcccagggcttctgataagtgtttgcagactatgtaaacttctgaataataactttcagtaaggcaggagtcttaaacctcttagtatcattttgtgcagtattattctgctctgtaagataatgtgttatcaatacttcataagataactttggccagagaatgaataaaatttatagtcactttcaaactgctccctttttttagggtgtgggtcatagatcatgcagctgtctgccaacagataatcttgatgagtaaaaagaagctaacagagaaaaaggtggcttagtctaaaacacttaggaaggacttaaaaaattatttcccaaagaattagggagtaaaaaaattgtaagtacatttgtttacagtaaaagagtggtctctttgtttgaggaattttccttgccacctcagaaagtgaaaatttactccttttttttttttttttttagaaaattaatgctggtgtgattgtttaacttgtgtaacctgttccttgaggtaaaatgaggaagaagcatatgatttggcctctcttttcagtgaaggaaggaagtccatggaaattactgaaccaaactagagatctaaagcaaaagcccttttgtgacacagatgaactcaatagtgcactgtgactatctgacttttgccacgtccaggcttaggccgccaagcggccagggtcagcaaattccactacctgaaaatgacagaaggcggcagggaaggggaattgaggcatggggagaagcagttgaagcatactagggaggcatgaggttctctctctctctctctctctctctctctctctctctctctctcgtgcagctaaaggaagagaaggaaggaaaagagggtgatcattgaacgactttaggggcaagtctggagttaggcgctgtggtgtccaagcagagccgtgtctggtggcggcaaactagattgctccaagcatggagcgccctgcttgaggacacttgttgttggactgtttgtttacatgcagtttgggtggcaaaaaaaggggaaagtctgggtgacatcagctgcaagaagacttaaccatatgccgatgtcatccaacccccaattatttgaacattgtgaaggttaagacatcaatccatccatttttctttctcttactctgaatcgtgacattattttctctagttcattgaccttgttggcaatttacaccaccaatataagcctcaggatccttttgtaaaatgagacttgacactaaattagtcaactaaaaatttaaagggtaaagggtccccccagccacccactcctgcccctccctgtactaaagtagaaaatttggacaaggcacaccatgcgtgtgactcaattgttctggccaaaaaatgggatgaataattttatttcatagatgcttggtgattactggactttacaaaagttaaccactagttaaaaaaaaaaaaaaaaaaaaaaaaaaatatatatatatatatatatatatatatatactgcttttgggtactgaggttgaacaattggtcggggataattccataaaatggatttaagtatttaacaaataatgtaaatgtatagagcaggcctaaaatttctccactgcctttgagtatacctttagaagtttacaaatacatgaggataaagcagtttcaataaaatgatcaattgtacaaagtatagaaatataccaagcgtctcttaagtaaatgattacaacatttagaagtattcatgagtttgacatatgcaaagcagcctatctctcatgagtctgagttccagcctccctgaacctttgtgcatttcataggctggtgaacagcccaaacatgtaaataaatagccattcaaagtgcaagcatttttaaaagtttaaaactccacacaagttcttttacaaaagagtccacccttttatgtacctttaaaaacatttagccactttattcttttgtgtctttgaagagaaaaaaaattaataaagttgtaggatccttttgaatttagaaaatgttggcaatgttggaaagaaagacattcagcatttcaaagttctggtggggaaggaaaaaaaagattctgaataaaacaattttatgtgattttgcaggtggtttgagctatcattttatatgtacgtttgtaccactgctcattggaatgttcatataatactgacctaattatgcatagaaaaagataagccatttacttgattcatttcttctttttaaatcaagaaaggaacaaaaaggctcctattttctgaaagaaattgttcgcttttattgcagaaaagtagcagcttgtgcagagctagaactgtaacaattttatattccaaaggttttgtgtgtattcggttagttacagtaattatacccaataactgacagccaaaatcacgtaggagaaagcaaaggctgttttctcacacaggccctgctgcagaacatctgctgagagatttgcatattaattaacccatattaactctaattattctgggaaattatcaaataaattgaattttctaattttaacctttcttttacttgacgcgtgtcgaggctgagaggacgcaccaggccgtctcacctgggcaatgagcaaaagatcttttctaccccttttgctcctttagacctggggcagcctggggagcttttgtgtgccttgtgcttttttggcttctgtgcctggtagggtctccatgcatttgttgagagagggaacatgtgtgcttgtgagcacagatggtggatttatacaggggtgaggaaaggtggtacctcagaacagttgagcaaaccttaagtttttttttttttttttttttcttcctcccagcctgttgtttaggcctgagcaaataaatgggagtttaattcaattagagcctggctgtagtcagtgcctcatgacagaaattattcaatatttttcccctcacattgtttggtttacacatcactgactcccttccttttgtactctgtttagagtggccataatgtgttgagcttttgtgtctgccatgtcactgtccctttcaccgttgtctggttttgtcaattgtgaggtgcaatgatgctgttttgaaaacagggtcctagtcagggtgttgctatgtgagtagggtggctgcagttttaaacatactacacagtaaataatgtcattagcccaatagacctgaatctactgctaagccttaagagaaatcctttgggtagggaagtgaactttacatgcctttctcaggtattagatgtagcttaaaactgagatttcaaagataaatctggtcagggcagtatgaagaattggactccattgcatgatcccctttcaggcatttctttggggtaagaggcaagattgactgagattagaattttttgcatgtgatcaagtttgtaacgacccatactttaagccacagcgatcaggagaaagctactgatgaaacctctaccacaagcagatctccagcccccctacttcgagccacatctcttctaaagacctatgactctatttccccctcaatgatttcacttctccccatccactaagatctattaagatgagccacacctcttgctaccttgaaggtaattgttttcctctggaagagctgttctttcccattatttcagctgatggagtagaagcattacggtacctccatgtaacattccttagactcaagaattattattgacttcagtaaactgcagaaaaccaagaaagtcaccaaataggtctgttggatggacaaatatttgaaagcaattatttttatggataggctagaactccagtctcctttttcatggaagcatggaatgccttttgcaagaaaaatatttctttaagagacaagctgttgctacttcagatgaaggtatgggttcatgctaaggtttttgaggggaggtggtttaatttcgtgggactacaatagctaaaagtgtatttcagttatatctgtatcttagaaaaatgtacagttacagacaaggtttagggtggggcaactaaaacaatcagagaaaatttttatagtttttctatttcgtgtttattttttacagcacattccaacgtactctggcagttactgactttacaccttttatgggctttgaaagttgtgtaaccttttcagaggaaggtgatagacacaatatctatttacacaaggacacatttcccctttctttatattccgtttattcaaggttttatttccaaggtcttattactataaaacttaaagctagacaaggtctgccctcatgtcagataaaaaaaaataccaaaacaattttgatggctcagaagcttattttttcatacttccaggtcctaaataaattacagttattttcacattcctcttgaatatccttcaggcatgatagtgagcatattttttctgtaaagccccttaatactttccttctgatggtttgtatagagcaagttgttgaatgatcgtggattccaataattagagagagtcttctaaaatctttttttccttttgacatattgttggaagacatatagtcacttgatgtatttatgaaagtctgtggaattattggcagtagatgtacaatatatatgaaattatttgtgtatagcagttgttttgggggtcttccctcagcatgccatcatgctaggcttgctgatgaaggtgctgttagactttttagccatcaaagggcattattgacttgtgttctggaatatagctaagtattatgtccttggattgtaagcatattatagatgttgacagaaagtgaagctgaaaaaatttctaaaggatagaaataactacaaaaactcactaaatgaaaggagcggtcaggggcctgtatgtttgaaacatcaatacaatgactagtttcctttggtaggagttaagtaaggtaatcaaaaccattatgagtcctagatatacaggaaaacccgaatatgtttacttttgtaaaaaaataaacagatgtcaagtctttgggaaatcataaatttcactgagaacactgtgacctagaaataccgtgtcttcttgaaagaaagtgaatttactgttacaaattcttcgaccaatatctgtttttaggatagcttgacaaagggagggtccttgcttttattcttatttgccattatgtttatatttttgatattaaggaagaggtttggaggggaaaattacatatctaagatgttattacctgcatgttggagcctatccagaacctcaacaaatgtatggaaatttgaacctttttgaaaatcaccagcatactgaaatttgaaaacctctcccaggtaccagggaacctgctaatatttccagagggaatgagtggctgccatcttcccaagatgctcctgtaaccaggaagttggaggagcctcagaactggcctctctccactgcaaccatggcattgcagaaattctgctctcattttatttaatatgcgtatttttttacatagctaatctgaaatggaaacatttttatccctatactgagaactgcttttgttttatcagctgacattttacaactcattaatttataatgcaggtttaatgccttcgaatgttcctgggataaaaaattaaagtggccaagctagtttgtataaaggctgactatagtatgttaacaataattatttataacaatattttgtattggatagcacattccatctgaatatttcaaattggcatggtcccttctaactggcattaattcattcatcttgcatccccaagtaataaagttattcccatttttaaatggagaaatcaagattcatgcatttcagtgacagatgttcaaattcagaagaaaatctctgtttgagtttgtctttgccttgtaatacgtatttgtcactaggcctccattattaaataagaaattgaaccttgcatttagtcctatgatctttacccacccaagcacggaggtaacaaggtaactgtgatttaaaaaaaaaaaaaaagtcaatgataaatccccccggatgggcaagagtcactggacaaaaattattgaaaaatagctgcatcctctcctcagtagcacatacttggaaattgaaattttgtggggaagacaaggaggaataaaggctaaggttcaggagaaaagtcttagaaggtcttcccgacacttgccacatgtaaagacgttgtaagaaagcaggcccacaaggcctttaatccactggctcaaacataaatgatctctaagcatgtaagcataagagatttaggaaaccaaatgattcataaaattccaaaacacttcttttttttttttttttttaaagacagggtctcattctgttgcccaggctggagtgcagtggtgtgatcatagctcactacagcctcgacctcccaaactcaaacaatcctcctacctcaacctcctgagtgactgggactattggcatgcaacaccatacctgactgattttttatttcttgtagagatggggtcttgcccaggctgatcacaaactcctgacctcaagaaattctccctgcttggcctcccaaagtgttgggattacaggtgtgagccaccatacctggccaaaaggacttattttaaatttgaagtcatattaccagcagagacatttttaaaatgaggttacatgtctgtgtcacgtctaagctgaaggattaggcatggtctctctcatcatggccttcctacttgaggaagcatttgcaaataaatttctaagtgaagggccaacacaaaaattgtgactggcacaagttcaaatcttcctttttcctcgtagccaccacacattgcagcaccagagaaaagacaacagacactgaaacaatggtatttcagtgattataccagttacatcaccttgcatttccatgttactgttttatacatcacacagtgccattgcacatacaactttgtaggctcctatgacaacctcataaacagggaaccattatcatgatttttactcatttctaccaagcttccttggatgataggccaaggccacacagctggttacacgttggttctgggacaaggcaagtcttcaagctcataattctgtgaactgcctctttatctctattgtttccaaactattgcaggaaacatgggtgtattgttagattctggtaattgatcaaattggtaggcttctataactcaaattaaggggatccatgaaagtaacaatcatcaaaacaatttaaaattaagcaacaatctccatttttgtggcatgaaaatcccaaaaagtcccagggatttccatcccttactctggtcatgtggggtttaaacttagattgcattctgcactgggaatttgtattatcatgtatgtttttgtttggctgttgtacacctaaagacatgctttctggtaccggctttgctaccaactagctgtacggcctttgacaagccatttgacctcactgtgcctgtattacctcctttgtcaaagagttgacttcaagtgtccttctggaactacaattttgtgattatatttctccaaataaattgtaagcttcctgaggtgagaatggcacttccttctatcttctggatttgccacattgtgggtatttaataaatgtttgatgatggcattgaacgatttattggcacgcttgagtagagttataggaaatcattattggctgccttattaacaattagctgtctataagctgcatatgtaattttcctttacatcaatagagtttctgcttctggtgaagacgaagtattgccccttcacatcagttcttctgtatgttaatacattagcaactgatatcttatttgtactgtaactgacagaataatgtagagaaagcatataagtaggaaaaggggttagtaaggtaacattgtatagggcatcttcaaaacaacagttctgctatttcaaatgtcaagctaattatcagcaatgtttaaatgctatgataggccatttttgcaaatgctgaaattttccagcaggtatggacgttataaaaatgtcaaattttgctactattctattacatgtcaccagaacacaaaaatctgaaaataaaagttatatgtataggcaaggaagagaaaccattatttgttttgcatatgactgtaaaattaattggcatagtgatataatttagagtattgtttacttggaaggaagagtagagaggatttaatataatgtaatctggtgaagtgaaaataatgcttattatagataaactataaagccttttaaatataggcttttagtaatgcatatgcagatatatctttccaggcccatttgctataaagcaaatttaagtatcagctttatgccctttggtaaccccatattatacatacagttttagagaaaatgaaactttaatatgattccacataaaatggtgagccatgccagtaattcttatgcccttcatatgcaaatagttttatcttatccatcaattatcatgtaaacatagtatcacatggcaaatttccctgtaatacagtacagtacctgtatataattataggtgcattttgccaatgcaactgttacacagaattgtaattaattcctctgaagactactgtgagagttttggatactgatgctgtttttggacatttattactgctctttagttggctttttgctatgcctcagagacagatgtaaaattagtgtctattttgagccagcaaacagtacatctttcctcttgtttattgaattgcagaaaggaattctttgggctcccacttctttgtggttttgaagtaactgtctgtttttgtgccagccatgtagctccaatacatgtctaaaattttgctgagactcatgcaaagggtggcttatttgacctgtaaggactgaatagaactttgctacgttatatgggaacttccaggcttttaaatgctgaataaaaagatatatatcataagttcaaaaacagacactggcctaatatattctgcccaatgaacctcatttaaaaccagtatacgttggttattatacaaaattgaatctcttctttgcagagacaaagctacattattaagatctcttctgccagtggtgatgatggtgggcaaacatcaaaacaggtccaaatgggaaaatgagcttatttttatttcataatgtaagtgcggctaaacccatcaagtattggccattctagagtaagaatattttatggtgaaaatttccacagtacttgtactaggcaaatccactgactagacgtgagggaacattttaaaggaaaatcctgggatttagaagtcggggcatggggtagggatcaggaagtgcaaagtccatctcagtgcatttaattttgattgtcagatggtcaaccagaaagagcagaatgagattgtctcatttgaattcagatataaaaactatgttatgaattgttgtacctggatttaaaaaggggttgggagagtggcacaccagcataatggcatatggaaatgcatatcctagttaacacagcgctagaaaagatggcatactgcctctgtaagtgaatttgacagcagttatttatttagtttaaaagtatttactactatttgtgagcacaaaccctaaaggttgtgaagtattgttgtcctgtgaaggtgatggatgctgtactcctgaccctatatggtgagacatgacttcattgcttgtttagattgttctgatatttgggactcctcaagggctgttcataaatcatttatctctcttttttttccacaagaaaatatttcaattgtattgctgcaggaacactcacgtgtcacacgggatattgtggtccatgcagaaaaagaccttaaaaggcatgggtttttttttttttttttccaggataaaggccttttaatgcctgtccagccttagataattttattcactccttctggacctttctttattcctcctgtgcccagagatcagtttttaggaggtgggttgaaagcttcccaggccttaggagcttttgttgtagcccccccattcccactcccccctacccccagcattctgaaaatttgtaaagaatcttctgcttgttgctaagaaatagttaaatctcagtcaccaggaaaaaaaaaaagaagcacattattgattgtactaaggtatatctggaccacacagctagagcagagatgttagaatatctctctttttgtagatctgagggcattacccagcctgaacttgcctaagcccttgtggtcacacctcttgaaaaggttttgtttcccccgtcaattggtattcaaaccaggtcagcagattctgtttgcccggctccgctgccgttttcattttaatttgcacctgttgtgcagttgttcggaaggcaagtgcagacccgcggattatacaaagatcatattatgagcagatatgcacggtgtaatctttttgtccccagcttcacatgacaaaaaaaaaaaatctctctctttttgttccttttttactccctgggaacctgtcaaagcaaacagatatgactgactaaaatttgtaactagacatgtttccagaattctccaaaagcattatgaacctgacacacaatccttttcatttttttcctccttttctgccacttttgtataatccgatagctggcaagagccacttgagatagctcagttgataacttagcggaggattgctttattaggcgcagagaaatcaaaatgaacctgaaaattgtttgcgctttttttttccacagccttttttccccctttctctctccctcttgttcccatgatgtcatggttctaacttgtttttttgtgtgtgtttctggagagttgggttaacagttcttggcaatcctgtgtgtgcgtaacggctggtgtgtttctctagctgagctaatgccccgtgtttattactctaatctttcttgtctggtggtaaagtggacaatttatgtactagcatgtaggccgagagcctgtgagggctgactaattcagaaacagccaccttcaattgagttcacagaccttatttacaggctgtctattttaagaaaagctactgagcattgctgggactgagggctgcaaaagcagcccgccggttcttgtgagttattttaacatttgtgttggtcttgcctgtgtcactttgaaatcttctgtaattatgacactatgaagacatctcaatagtagtattaatggcccagaagatatggcttttcctcattttctgcttaaaagattaggatataaatggccttagcacatgacggttgacatagaagaaagagtgaaaattcagatggagcaggtttgtgtatgtgtttgtgtatttgggtaaatagatggacgtgtgtgtgtgtgtctactgtttctagggaaaaaaccacagttaatatagtgaagtcatctcgtatttatagtacaacattatatagtaaatacttcatgtctctaagctaataaaattgtctattgtagatctattttataagtttttgtggagtatcgaaagtacatattgcaatacgtctctttacatatgcagtataggcatagtttgtgtgtctatgtttctgttgctttttagaatttcccatcatttttaggaaaaaattgtttaaaatcagaaagagcacccagctataattgaaaaagaataaaaatgctaaaacctgaaggatattaattatattttcctgacatggttgagtaattcagttatgaaaatattaattattttccatttaactaaacaattaggggtggctgatgtttctcaacagagtgtttagagagtgtgttttgtgcttcttctgcagtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccaggtaagtgtctaaaatcacttggcctcttcctgtaccatcttcacatcttcaactaatctgttccacctagcagatcgcccacaaccaaataattaaaatatttctttccattgagcccttgcagaatagagataccaaagctggtgacagattatgaagtgatagtaatgttatcacattgcggcagttacatcttaggaagggattatatttcagttttgatgcaagtcaaacatgaaccacactttcaacacataacatgaggtatttgcaccacatttacaatgtgcaaattatgtaacatgatcaagatctatactttcatgataggaaatggaagcaaatgtaaaaactcacaacatatatatgtatataaaaatattttgtgtggaaattatgtagcatttcaaaccaaataactgtcagtttaatgtagcttcagtgtctgtctgacacctcctattggaattcaatcgtttaatgattcccttttgttaagtgtgaatgtgatttcacacttttacctggtcaggtagctttcttattatttatcagctaagtacttgataatgattcctgctgtttggtgggactctcaagggaagtaaaaatggtcccaggccaactataataaaactaaggtaaattatattcaaactaaaacttccgacaacactgtgcaaacgggaaatgtcttggtctaaaattcacttatgacggagaatcgctaaggtatgaaatgtttaacaaaatacaagaaatcttattcctgtgaactttctctgctcatctttacatggtaaagtggcctggaaaatttgtttaaatgacctctctaattcagacctcatgtcaccttcatctctattcccaggacccactgagagttatcattgtttaccccaccttgttttttctttgacaacataagcaacaaaagcatttttataaataggtgaagtggctgggaaggagtctacctatatgctgttgtgatgtcgcagactataaaccatcaaacataggcagaataattgtttggtatactggaaggaggataataaaagcacttccactacgaaagaaaattaaatgtgagatgaaagaaaaagaaaaaagactgatggcaatttgagtacagtgtatttgtttttcgttttcctaacatactgtgccaagttttctactctttccgtttccaattttgctttcggtgaaggtttctcgaatctcagcaatcccacacataaacatttatcgttatatccattaagccttaaggttttagattttcaactatgagggagaactcagccaaagatgcttgaaagataaatacgtttaattaggggcagaggatgatcattaaaggaagtctgactgctgcagaagtcattaacaatcttaaatgaaatttttatttttatgatagccatttacatgtataataagagccaatgattcttgggagcagtgtgacagaaacagagtgtggcgagaactcatgtaagacatactatttaaatgagctggtgttagctattcatatttgttaatgaactagatatgcagggctataagaatgaatgttctgatgctttaaattttaatatctagaaatcaagggtaaggaccaattactagaatttccacccttagaagaataattaataacaatgtaacaaatgtacagccccaaacctcttttaaaaaagtttaatttaaaaaatttaatatcaatagttgaaaaacagccaaacagcaatgtcaagctgtagtagtttgtgattgtggcagctttttgtgttggtcatggatcataattctaaacgttttaatatacagtaatccatatgaatgcattgcagaccctgttatcacctgtagttaatggtgcctgtgatacaagtgaacaggctgttctttgctcttacctttatggtaaataaaccagcattctggagtcacaataattaaataaaatgtaaatccctaatctcatttggctatttggaccaagaaacttacccggctattacctgtctagttctaatgattactaatgatttattgttctttttttttattgttctaaaagtgctctgatgtggtgccttgatgtctaatgaaaagaaattggtcttaaaaagctactcattgtttatcctgactctgagataacacatttttcttctgataaaatatttttcttatttattgttcaaaacacacaatatagacaataactctaattctggtgcagttttatttagtagtgttttatccccggtgcctggctgtctacagtcatacctcagcacatagctttactctgagataagccctctctcctttgctctttctcccatgctttctggagtttgtctgcaggatgcaggttttgaactgaagagcgcagtggagttcttactgtgcctttccggttccagcacaatcaaagttttgtgtttggaattgtccttgacattctttcgtcccacaatggggtggacacagtgtgctggaaaccatgacatcattatcattgacacagacttaaataaatcacctgcatcttggcctctttctgcttattcaaggattcttcatcttaaggaagaaagtgctctttatttttacaaatcttcatcccaggggtgactggaagacgcaaacttttacaagtgttttaaaaataaatatactatgtggttttagacacagtatgctgagtcagaggtgtcttagagaatgtttaaggttagacataaggcagaaagacagccagattgcctttaattcggaggcaatattcctaaactgtgtatcattatgtccttctgaatatggattcacttgaaacttaattaaataggcatatacataacatttcaaatacatacctgaaaaggcttagtagtgtttcattttcacacattgagcttgatattcaaaaaagaaaaagattgatgctcagtgaatcaaagcaaagtactttctaggtaaaagtgacaccatctcatccaatgtctctgaaagatctcagttgcacagtctttggataaaaagggttataactaaataatactacaaaatgcaatttacacaatgtgctgactacacatttgtatacccagcatttattaatttgggaagcaaccaactactgtaacttctctttactttttcataagaaaatgacaatgaggaaggaagtgcagcagaaatcttgaacattaccactattatgcaaaaaaaaaaaaaaatgctgttaactgttttcccctcagtgacttgatgtgctctcagatggaaaacttatgattcttgtgactcttggctacccgaaatcacatgagatgagcaaggaagaaagacacaaaagctatatttatatctagccctgaacttctcagaaataccttaatatgattccttgcagagactgataaaaatatcagatgagggagactttcaaatgatcagtgattacaattgacaatacaatattgctatatattaaacttctaaatgtttaatgtaaaatgtctctctgaaaatattttttaaataaaggaaaattccttgctcaggaatgaatttaagtggttgtacagcttaaacaaatatcattcaaattatctgattattatgaggagtgagattaaattagcatccaggtatatctgtgtattttaccttaagaggatcatgatttttcagttctgattccataaagagatttgctgcactgcttgtaaaatatattttattttatttttgctgtaacattttctagaacctgttctttcatgaaagtagattagaatatgataagcaaagaatgaccaggacagatttggaaattcgtagagtcctagttacaaagtttcccttgttttaagtaaaatgattatcacagagagatattcatcctggagcatatttggtctcattagtattgtcatagtaaaaataaaaatttttaaacttcacgtttaatttacttaagagatttttaactatcagctatcctgctctgtcctcctacgtcctctacaatctggtaggcagaaaatttgagagtgcccctatttttcaaattctcccttattttaaaatattgcagtttttgacaatgacctttaattgtttatgaatttttaacttcaacattatatatattcaccttcatcagaacactgagctgttgttatatatgtttccccagaaaatgattatgattacctacaggggcataaatgatgatgaggacaagacatttatggagtagttgggataggaataaggcaggtacgttttagaagtttgtatcaagcagtgaaacaggtattgttgttacttctgggatatttgttgtacaaactgggcattccaagttttgatatgtagaattaggttttcaaaaagtatgcttgcatagattagcaccattatagccaccccaaggggaaagaaaagcatgaaaacaaaatgtgaaattctgacttgccactaagcatccagagtttccagaggcatagcagccagcatgcctcttcatgagtgcaaatacttagttgcttttgactcttattgaaaaaataatatctttcccccatttgtcactagaactgccaccagaagaaaagcccttcatttgctccaaataagcacttctgtttttcacagcttgcagtaatgcttaaagtaaataagttcttgtgcagctagcactattggattcattcaattgcctgaacaaagctattgtttagaggtctacaacaagccttttctctgtttcctttaaaagaatcttccttgttcctgtgcttggcatgcttagtatagtaagcctttctacaattctcaaatgctaaagataattttcccccacagaagaaatgaaggaagactatgacactatggggccagaagccacgatccagaccgcaattaacaatggtacaggtgagttatgttggccacgctcagatcacatttgtcctgtgtcatgtgggtttagtgaggcagggaaggaaacagtgacacatccatttgtatctccatgacttaacaagtagtcaactttacaggtctctggttttgtttcaaatcaaaatttcctacattttggtattttactaagcaaatacatctttcattctcacacccctaatttacctgtgacgctcaagaatactgaactctatgaatggatcctttcagtgcatgagttgggtgaatttctagtagtaacttttattttaaaagactgcaaaaaattattttaaaattaggatatgatatacctctgctagccaccacttgatatcagtcgttgagaattcaaatgataaggtgtaatttagactgtaaaatttttttttcagaaagacaaatttccacgaacatttctctcaataattaatcatctcagttccttttaatcctttctttacttgtaattctctgcatccttgagcccttttaaataattttttccaggcagttttagagaagaattgacaagtttacttatttttaatgaagctaaaaaattacagtgggaagatactgagtggtgttttgttttactctgctactgcaatagaatggagtttcaggacaactgtgatattccatgttttttcccaaacactgaatggcatcttctctcacattcttacatcaccaacacaaatttacatgttccatctctcttttcctagatgagactatttattttgtggaggggaggggtgttgcaaacagtcctctacactaccatcacaaatattagcatagtgtccaccataaaattatcttccaaaataaaacaaaaaaaaaatgtaactacttctactcaactcatccatgaaaaataacttgaagttttatgaaatgtaaaaaactaagatgattttacatcacccttatgttgatacacatcatgatagactgctcatgttgtgtttctgtttaaaatgtgcttattaataacttaaaagcatgaattcactttcctgggtataaaataagagaaataataaaaacctattgtcattctattcattcgaataatgtcaatttaaggtataaaaataaagctgtacaatagatgattctagaaaaagtatagaatcaagcaccaagaatcctaatttttacacacagccctgacaatgactagattgtaacccttgggcaagtcagttttcctctttggaactcagttcccacaactgcaaaacgaatagattcaactagtttcttgataataatacttctagttttaatattttatgttgcatgggtattatcaccatgtaaaaatagaaacaagataaaataacttcatattaaaacaaaaataaagcgatatcatgaattagatactttctataatgtcccaactcatgggatcaaaaatggcttcaagttccttttaaagataaatgttaaatttcagcctccagcataaataaaagctgattttgattacccttataagcacttaaagtgtcacaaaagaaaatttaccccacaaagtaacaatttactagctgttgtatacacctagagtttaaagtgaggttaataaaaattgcttctattcagaaggtttaaaaatcaatcttgaatgtcttttcaccaggctttaaacaccccttttttctcataatacctgctgtaccttgtagttcatatgtattcagtcaataaataaatcaataagtgttcattgagtgtgttctatatagtcactgctgtgtgcatatgtggtagaagatgggtcaggaagactaaaacatggttatcatttcatttggaagatgagactaatacacctgaaaaaataatgatgaagaataagtgaaaatatgtgataaacctgcaacaaatggtaggagccataattatttagttttttgttgttttgttttgatttgttttgttttgtttgagacaagagtgtcactttgtcacccaggctggagtgcagtggtgcaatctcggctcactgcaacctctccctcccaggttcaagcgattctcctgcctcagcctccctagtagctgggatttcaggcatgcaccaccatgcccggctaatttttgtatttctagtagagacggggtttcaccatgttggccaggctggtctcgaactcatgacctcaggtgatcctcccacctcggcctcccgaagtgccgggattacaggcatgtgccactgcgcctggcctataattatttgaattacagaagtgagagagagtctatggaatgggcattcacatcaggttttgtgaaggaggtagaattcgaactaaatacattttcaatagtcatggaggagtgaggaagggctttctaattgaagaggagtctgtgagccaagaagggaaagtgtgacatctattcagaggatagtgagtaaagggttttggctgaatcagagagtcctaggaggcaatttctgggaaataaagctggacatttaagttaaagccagatggtggagaatataaagcaccagacagaagagtctgggtcatgttatgctaccatgatttctgtgggtgaaaaccagactctgagagaccaactggaagtcactgtagttatccaggtgtgaagtgataaaaatcttgtcctaaggtggagacagtgatgaaattagcaacatgacttcttaacaaacaattgattctctgaatgatggaggcaaaatggcttcaaaattacagatctgcatgtttagcatatagcagtacttgctatttctagatttacagaagaaggatctaattttgagaagatcttgaaccagcctttagacacaagtattttcatataaaagatatatagatatgggaatataggaatgtcctttggaaatgaggaattgaaacccaagaagtcagggctggagatagagatttgagagttatgcaaatatactcagatcatgttcaagatcacacaggactatgagatttacaactgagtgtatttgttgaagcaagtagaaagctgaggccagggctcctggtgggtggggaggaaaatcaacaaagattttcttttgaaaaaaaaaaaaaaagattatgacacaagagaaaaaaattaaacattcagaagcaaagaaagagaatttcgtaaaggtgagaactcagttaaaagcttcaaataactacccttgaaagaaagctgagcaaatacactggacttagttaattagaaatttactagtgatcttcagcttacaactctgccctttgagagaataagtacatattctttcttcctagctacaagtttaccacttcttctccctgacatctctttggatgctaaatacatgtggttttagaaataatacatcttttctggttgaaattgcatctaaaagactatcttcctctgctcccaagtcttgctcatcaagctcctgctattggctgaatttcttctctagccattccacactagaatgtctccctccaatgagcctgtggggtttgggctgctttatcgccatggatcctggaatggtctccatcacaaagtgtgtctgaagaaatgagcgagtgaatgggagacaaacagcacttggacttcccttttgtattttcaggttaacatatttttgagccctggcctgaagtaaccaaccagacattttcatctctccattattccagtcatccaaacttgaaagccttagttatatttgactgttctctgtccctcatgtcctcctctatttagtcagcccacatctttcctataacagtttcctcaatgtccaaattcccttcttagaatcctgaattgccccttagcacctacaggacgttcttcagtccgataataagtgccatccattgtataccaatggcgctccattcttgtcagaccaaatcccttggtgacaacaaaaaagaaccacatttataccaacctctgaatctctgcccatgctatcccttcagaccctaatcccccagctcctttcttccagtcatccaaattctccccatccttctgttcttcaagtccaggtcacatcccatttccttaatgtggtcatctctgaacaccccaaacgacagcaatctcttcagaacccttgtggggttctgaaatcccacaaccctaaggtgtatgtggctaacttcagcatgtttcatcgttcctccttatattgtttgcccttatttcatgtagtcaatttcatgaagacaagaggtttcttcagctgaaaaatgagggtggatcatcctggtatctacctcattggctgaccttgttctctagccagtaattaaataaataattactgaggtaattaaataaataatgaagccagttgtggtggtctggcccataatctcagctactcaggaggtcgaggctggaggatggcttcagtccaggagttggaggctacagtgagccataatccactgcactccagcctgggtgacagagcaagaccctatctcaaaaatagtaataatcagaatgtatatgtcgatattagtaagtgactaaaaaaatgtttgccctaaggaaaggactattccatttgcctcaacaagcccagttatagcagggagcacacatggcagatattacaactggtgaaatgaatgaatgaatcaatgaatgaatatttggtggagaagaaatggattctgataaaggaagccacagtaggggaaaacattctctgtggaggagactaagtatcttcagagagtgaaactaggatctaagtccctgaaggattttgccttgttaaaggcaaagaagaatagcctagagtatcactacattttttttttaacaacaaagttagattaactgaatggcaaaattgatctataacacataaaacagtgcaaacctggatttatattaataactttccacattgcataagttcaccagtttttatttttttttaaaaaaggaacaaaattgtaatgctttcacacgtaagataaagaatatcttctaacaaagagccttacaactttcagatattaataggatttaaattcaaaatgaaattattaggtaaaatttttaagtgtgtgaatgaaccattttctaagaagagtagagaaatggaaaaacttggaagcattatacacatgagtttgcctacgtgctagtagtaacaaggagctatcttaggtgcatggtgatcattagcattaatgcagttccacgtgcatatcaatatccaaatagggccctgatgttttactctttgaatgtgtgaaagttatatttactcagacaatctagtacctctagttataaagggctattaataaccacctgcatctgcgcttcctttgctaagagggggaagaggtaccttacatccagaaactgggcaaggccaatttaggcatcagttcttaatcttacacaacacaataaatttcttgtctaagaactaactttatagactctaactatagtcaaacttgtttccagtattctaagaataatacataaattatttcacatatgagaggcaattgttttgggaggctccagattctagagaccaattacctacacttgaattttatctctaccaattactagttacattaacttgagtgtgtaattgataagccttcatttctacatcggtaaagtggaaatcatgattccttatgtacaaggcctcgctgtagggattaaatggcatgacatttttatttatttattttttaactttatttttattttctttctttttttatttcaataggttttggggaacaggtgatgtttggttacatgaataagctctttagtagtgatttctgaggttttggcgcacccatcacccaagcagtgtacaccgtgcccaatgtgtagttttttttccctcatcaccctcccaccatttccccaaagtccattgtgtcattctcatggcatgccatttttaaagcacccagtacaacaactaacatagactagatgctcaccctgttttgttttgccagtttttttttttgtttgtttgtttgtttttttttgagatggagtctcgctctttttgcccgggctggagtgcaatggtgcaatttcggctcactgcaacctccgcctcctgggttcaagcaattctcctgcctcagcctcctgagtagctgggattacaggcatgcgccaccacgcccggctaatttttgtacttttagtagagatggggttttgtcatgttggccaggctgatcttgaactcctgacctcaggtgtccccccgcctcagcctcccaaagtgctgggattacaggcatgagccaccaggcctggccaacttcaaactatttttgttcattaagaaatgaatacatcgtaaacggttttctccattcatactggttcctccttaactttttctctaggaaacaaaaatacaattttaacaaatttgtaatgaaagaactaaccaattttgagaggctttgacatttaagttcttttgacattctggaaaactacacagacaagttgtaggacacattattttcagtactctggcatttgaggctaaaatatgaaggttaagaactagtttcgttttatatctgatttcatttttatgtagcatcccttctttaactgtgtaggaggaggatttagtagtatttataatgattacgtataataatgatgaaagctgtcagacttttcctttctttgacaactgactcacatcaggaatcgtattctttttaaaaatttattattgacacataacaattttacatattaatattcgtgaggtgcaacatgatgttttgatacatgtataaattaatgatcaaatcaaggtgattagcatatccatctccttaaacatttatcatttctttgtgataaggacattcgagaacccccgttctagctattctgaaatatgcactacatttttgtgagctccagtcacataatagaccaacataactatttctcctatctaactgtagttttgtacccattgagaaatctctcattgttcacccttccccctactctcctcatcttctggaatcagcctaaatgtccatcaacagatgaatggataatgaatggtatatatacccaatggaatactatttagccataaaaaataatgaaatcatgtcatttgcagcaacatggataaacctggaggacattatgctgagtgaaataagccaagcacagaaacataaatatcacttgacctcactcatatgtggaatctaaaaagctgttctcatggaagtggagaaaaatcatatatatttttttcttcttaccctggataacaaccaataaacaaaaacgaagcatttgcccattgttaacaaccactaaaatacatacattcagagtgtttgttgtatgtagaatttgaactgaggcttgaggaaactttaaggaaatagaagggtgagttccttccactaagcaacataaaattttaggggtgttgataaaaaaaaatcataatgacaagaagagaaaatttacaaataaataattatagcctcattagttattcaactcaatggtcacttattgggaccctactaagtgcaaggcattttgttagtcatcacaaaagatacagtgagaaaagaagagtcactgtcattaaggacctacattcatccgggtgaataaaacagtggtagacgaatacgaaatgcatgtaaaatatttagtgcaacgttagcgcataataaatgcgctatcatttctagccattattattgattataatatcatctggattaagacgttttatttgaaatacagcaagctatgtaagttcaaatgcaaagtgttcagtattgtagagggtttctgacagtatagggtcaaatattggagataggacaagagaggtgccttaaagaaattgcaaatttcagggaagactttcttcaagacaaagacttgctgggtatgcctctgtgcacaagagagaaagagagaaaggctgaaatgtaaaaggagactgggtgaaagatggagtgggttatcaaacgagttgtaagagaataattttagatgatagccacaataatgtttattttttagcagtaagatcagaagaagaagacagaatgatgataggagagaatgtagtcaatttaagatgatccaaggaatacacactgtatgggttgcactctttgaagtcaataggaaaaagagactatcagtcagcagtaagggaataggaatacagttggaatcttgagacatggacatgtagaataattgctgtggacaatgcgtggagattcaattattaggaaggaatatcccattttgaaaacatagtctgcaacaagactatactattatttaagatttttttaagatacgtttgatactccagaaattggactggatcgtagttcagcagggtaagaatgatacaagtgtaagggacagagatggaagtgatgatttcaagttccaaggtgaactgaggtaaataaaatcagaatgggtaaaagggactaggaaacttttcagggcctgattgtcacattgaagtacacgtttcaagggaatgagaaactggatgataggcaaggggagaaagtagaaatcagagagcgaaagttcgcggttctggttcttgtcccagggttagcccaggagcaagtgtggccatccatgttgctggattagagaaagcctaagcactgtgaagccaggttctgcatggactatctattaagtgatgaagtttcccagaatgcaatggcatcctgtgggaaatgtaatcatgggacaggcgtcattttgcttgcagtatacaggcaatgtcctaaaacatgacggtgaaaatggatgactttcgacttcgacttcaaaccattacagctacagagtggaaacaatttgagggtagaggttaggtctgctcttctccataatccctctcagaggatgcagtggtttatacagtgttaatggttcataaccagggtatttgttgaattaatgaataaataaacaaagaaataaatgatgagtgagttgacgaaacaggaacattgattggaagcagtagcgtgaattaaggagtttgttgacccttcctctttgttctgtgagtcataacaaatgaaagcaggaatggccctgtggaaaaggtctgtaagggatgggttattatcaggggatgacacagtttcatttagtctgaagaagtggaacacatgtaggaggatataattaagcatgggaggaaaataacgagtaatatgtgaaatgggaaagcaaaatgaaccgggaataaagttcttttttggtttctagtccaaagttaagcttgaggcatttcttgtttactataaccacaaaatatctaatatctgctaactaataactaatacctgctattttaacagatgttaaaataatacctaataaaaattcacctttgcaaggtgctatggaaagttattctttattgagcgcctttagaaacttgattacaaattagaaacagtcaaattaggaaatacaatccttaaatattaaatggaaattttaaataagcatcttgaacagagaatttgaaaaacttttatgtgttctctttgccccactagacccagctctggattacccagttaaaaaaaaaaatgtaagaataaaacaagtgtctaggattcagaggaatggggacatttaaaaaaaaaaaagaaaaaaagtaaaaattttctacacacacatatacaaacacacacacacacacacacatacactctgaagtgggcattttaactgacttccccccatattcattgtatggtgtaataatgttgctatttagaattgcttataatgtcattgtgatcgtttcagtatgtagggcctgttcaaatggtaccaagtcaggcatgatgaaaaactaaaaagatgaggttctctcttttcttgcctctttctctcatgttgagtcattatggtgcagtagaaagagcagtgggtgaagagtcaggatacataaatcctacatacagctcttccagaaattacttgtgcaactttgtatgaatcactaacctcactgtaccttagttgtaacatctgttaaatgaggaaatcaggctagaaattttgaactccaccccaccctgccctttcttctaatgaaattttactggaagcatgaacaaaaaaattactggaccgcactagccgtcatgggatgggaggctctcgggggccctgcctcacgataacatacacagggccagcttcctgggtctgggacctgcacagtcgcacagggcccagcactgagaagggctgcttggttggctctgcagttgctgtcttgaagctcttgacaatttttgaatgaggggcccaacattttcattttacactgggccccaccaaccatatagccagtcctgttcatgtctcacaaaatacatgagaagaatagcagagtacaagctaggatgggaagtggtggaatcagagaggcactgcttcaagtattgaacagaaatgccagttaggtctaagtttacaggatccttctttgggtgtctccagagcaattgaaccccaagtaaagatccagatctagactgaaaatcttgcctcagcaagaaatacagtggtgccaggtgtaactcccctaaactgataatattagtataaggttggcagcctagccagcaattaagtctctttaaccatcaattctgtgcatcgcatcgttagcataggggaaagtgggggaaagaagaactttttttactttcactatcctcttggtttaataactctcaatttctcctgttcctcttaacatggagcttaaattaaaacttttaaattagttagctttcttatatcagtaacagaagcgatacaagtttgattataacgtatttctctgcaagagttgagtggatatataatgttaatcaattgtacaaaatcagtttatcagataattcagttagtacctaaatacttaacaaggagggaatcatactattacaaagtatgtcatattcttcttggttgtatctatcacatttttataggttggaagagttttgtctgccagtcagacatctgtcagggaagtcattattttttaatttcttagttaacttcatacattgagtttttaaaaataaggtggagaaagagataggtttggaggagagaaaaatagaagtagtgcttggcaggtgagacgggggatgattttcagactataatcagtgaacgccaagaagagcctgttcacttcctggctaatgaatgctgttgttttattagctttgtttgcgattaggagcagctatcttcacttcacagcaagtgttcccacaagaaataactgatatttcaagcttcttgagtgcctccttcattcattcaacaaatatttaataagcgctgttttgcttgtgatgttgtctggggtttccaggcacttccaaaatattttctcttaatctgcatgtttgttttccccatcagaaagctgtgttgttttgagtttttaattgaaaagaatacagataaaattctctaggcctagccagtaaagaaaaagcaaactgattaaagtaattaattaattgaaattatggaattctggaactttgaggacaccccagaaagcacaccctggctcattttacagatgaggaaattgaaattcaaaaacatgaaataactgagccaaaatgaggagtccaaggaccctgaaccttgcctaatcattcaattattgcataataactgtgacccaggcactatgctaggtgctggtgacacaaagctgaataacatatggttcattcttttatcagctcacagacacgtaagagaaagattacgatgggatgtgatcaattcaatgattgagacacacagatgacattcagtaagtgaagaaggaagtctatgtgaactcaggctgagatagtcaggaaagctacctaataataataatatgggaccaattgtgcttctctccaaaatcatgttatgaatgtctcatttagccatgcgaggcagaggattgaatttgtagagttcttaaattggacaagggtcagaatttcgtgaaagacttgttaaaacacagattgctggttccataggtttggatgggccccaataatttgcatttcaagcaagctcccagatgatacggatgccactgacttttgaaaatcactgactgtcctgagcattcttaggtttcacgtgtctctacataaagcataagaaaagagcattgaattgctgggcaaaatcaccttacttcatcaactcctctaaattataataaactagtctatctttttggtaatatgccaattccaaatttttaggttacacagtaatgtgaaagacaagtgcatattgtctatattgggaatttttctttgtgtgtgtgagatggagtttcactcttgttgcccaggctggagtgcagtggcacgatctcggctcaccgcaacctccgcctcccaggttcaagtgattctcctgcctcagcctccctagtagctgggattataggcatgtgccaccacacccggctaattttgtatttttagtagagatggtgtttctccatgttggtcaggctggtcttgaactcctgacctcaggtgatccgcccacctcggcctcccaaagtgctgggattacaggcgtaagccaccgcgcccggcctatcttgggaatttttaaaaaagtaatggactctatcattctgtgccaatacacagcaatcaaaatcgttgagtgttagcagtctctacatcttgatattcaaaatcccctaatgtaagatctcctgctgtttagggagatatttgatactgcagactactacagattcccattccttgtccactcttcacctcgctctcctgaagctctcttacatgagaaactctcattggcatctgaacatgtgttccctggagaaagccatgttcagagcaggggtggagagagcggccaagatgctgtactaattcccaggaagagcagaaaacttttctgttgctcttgacgacctggctttatccatgcctctgtaccagctggaggctctgcgaggccgcccatgtagctgtgtaatgagaaaaagatcatcctcttccctcacggttgtttttaggtaactagtgccaatatgtcttttggaaaccttctgcaaaaacgcatacatgcacttttaatgatgaaaagcttacatttattaattagtcaactttaaacaaagtagccatgagaatctatagacctcaacaaatgctgaatatgtgcttccttaaactaaaaaactcaatacaaatgactacattcaaaataattttcgtgttttcttatcatctgagatgttaacaaaaaggctgtttttcaaaaagatgataaatacagttacctagatttgtaattgcttcttcaggtccctttgcctttcatagtgaagtaagcaaaagccagattatatgataaatacataatttatgttatatacattacattacactggggaagcgtgtgtgtgtgtgtgtgtgtgtgtgtatatatgagatgccctattatacatatatatatatatatatatatatatatatatatatatatatagacatgtctgtatattgcagaatcacaaccattatgtgtatatatctccaaacgggtgaatcacagaagtaggaaaaaaatttaccactcatgtcctcatttccaagaacactggcactagtaggcactcaataaacagttattaaacaaggggatggatggatgattctactcagttttttacatatacttgctgcaactcctctgtaccttccaagatattttctttttaaaaagaattatttattcattttgatgtttacttaaatggcttaacataatattcaattttcttccattttttatgaaaattaaaagcatgcaggacactaaaccagtgataatagagtacctgtcttccactgtgaacacaggcttgctacaaataaagaaaatgaatgccaaagggaaacagaaaatgataaagaataagtatctggtctatatttcattacctgtaaacactaagcaaagcccacttttaagtatctttgagaaagtattctaaagcaacttgattatgggggctgactaatttggggaccaatatttctcttttatttagagttctgttaacatcgcttgaattttaggcaataatttttaaggccagtctatgttgatatttattattatctgtctgaaaaatcaattatctatctaacgcagccataaagatatctataaaagtgtcattaataagcaacattagtaagagtggccaacatattgccaagagaactgaggctttcctgacaaaaagggacctgaaaattcaccctaacaatctaacagtattaaaatacacatggtcatgaggaaacatttttaattaacattcttttttatggctgggcgcggtggctcacgcctgtaatcccagcactttgggaggccgaggtgggtggatcacgaggtcaggagatcgagaccatcctggctaacggtgaaaccctgtctctactaaaaatacgaaaaattagccgggcgtggtggcaggcacctgtagtcccagctacacaggaggccgaggcaggagaatagtgtgaacctgggagacggagctggcagtgagccgagattgcactactgcactttagcctgggcgacagagcaagactctgtctcaaaaaaaaaaaaaaaacaacaacttttttttggtttttttgagacaggggtctcactttgtcactcaggctggaatgcagtggtgcgatcacagctctctgcagcctcaacctcccaagctcaagcgtttctgctacctctgcctccccagtagcagggaccacaggcacgcaccaccatgccaggctaattcttttactttctatagagacgagatttgttgcccaagctagatattctttttttggatagagaaaaggttatctaaccttagagaagattgagagatatttgcaagacattagggtaaattttaggactaaatgcaaaatctctggagaaggtatgggaagaaattacttgaggcttcttgtgaatttttgttatggtttgatcataaataccatgcaaatatcctttgtcagtgtgttttggcagttcttccaaagagaccagggagtgaagaggattacagaaagaaggaaaatgaggttgattttacactagaaaaatgcagtgaagaattctacaacctttcagctacttttgtacctcattcctgtgtccagtacacattattgcataatctttctaaaaacaaacatacaaactttcagatacaatcaaaacttcattcttcccaacaattctgagagtaaccaaaattgaatcccatcatttgtcctagtattgtaactgttagggtgattttagttttaagagactgaaacacaacataccttcaagcagaaaaggaagtttcttggctcacggaatttaaggaaggtggtcaaccgaaccactgcaaggtgcacctcggcctcaggaacgagaagagctagaaatgaactgtcagaacatgcaatcttgtctgcttttctctgtatgtctgctttattctctcttcataaatcttctttttctagatggaaaataacaattccttcattccacattttatagctacagtcacttggcagaaaaaaaaaaactgccttgatgctttttctggaacaaagtcctaaaatcatagggaagggatttattgaatttaattggatctattggctaccctggaccaatcaacaagttggcctggagaagagaggactgagattggctcacctgagcaacagagatcaattgtggctaggggagcaggatcacatggtaacacagcagctccttgggtaccataagccttggcaatcaggaaatggagaagcattcctaggacaaggtgaatgttgaagtactgggcagaaaaactgtatattactagcacctattgcacctcatggaaaaactacattagattcatgctggtgatacctagtttctgggaggtttaactctagcccacttaagtgaccctaggtatgtgagatatataaacaacagaatatctatacagcatgaagaaatatccagatggagcaaatggatttaaatgattgagtgacatcttcatgaaaccctttttgaatacttatctgagccctatcaaactctttcaagtatttatgaccactactacacagtttatcaaataattattctacagttgcctgagtattaggtctaagttcctagctcagctgcaggtatcttattttatgcttccttttaccaaaagacctctacaccaagattagtgttaaggacataatttattccacattcatcccataaatgattcttgagagcctactaatttctaggcaatatattcaatgcccaggatacaaagatgatcaaagatgaatccttaaagagagcgcatgatttgatgtattttgtccccatcacacttgacatagaaatctagcatagccaaatttgatctagcaattgaattacctctccaaacaacagtagtgtatctagatgcagttttgtttgcctatccagaaaaatcagaattttcctcccttttaagccaaaaggctattaatgcaaatccaattgaatttgcatatgattacatttctgatggaaacattcatatgcaaatgaaaattcatgcaaagatagccagatcattcaaatagttgctgaaatatcaagataaaattaggatattaaatgtacatccatctatgtttactaggttacactaaggtcatcaagtaggacaatattctcaaaaaacttaaaccatgtcttaacccttaacataaaccattgacaaccctcaagtagatacgaattcagaaaggagctattacgttactttgtgctgtcatagtactgaaaaagaagtcagtcactgataaaatcagtgaagttactcaaaagacattcatcatggctctgccattttgccccttttatcctttcttcccatcaaaagtaaaaggtgatttttttatagatctgatgttattttgatgatccaaaacaatgagcaaatactttatgcaagttgacagtttctacatactccataggggctcagtgatgcaagtgaaatgacatcatcacagtcaccaccaataagtatccattggaaagcatccatgacattgtgcatacagcaaggggaaagtgatcttatctaaagcccatattctttattaagtccagctaataacagatttaagcaaaatttcaaggtataaaatcttaatccactactgtacattccaaatctatttttgagggaaatacggtcttggaatagaccgttgttcttgttaaccttattagaagttacagaggcaaaaaagaaaggtttgagatcacagcattcaggattactggcgcttagtttagtggtccacatagtgtaattctcccacttccttttatttggtcccatatatttgtttatagtttcaagtctttttagaattctagtgttctttgctttgatgaatgtcacctaccatccatcaaatttggaaagtataaacctgagggaggtaccttagcatctcccaacttgacaaactgaattctttcccagatgaatctgaggaattttggatcttaggtatttctcaaatccagacacttccttcatctccatcatcaattccttaacagtatcttttgcctggcctaggacaggaacctcctaaccggattcccaggacctacttttctctttctccaatccctatcatactatagccaaggatgtcatctaaaaatgcaaataatcatagtttcatccagccatcctccttgcttaatactcttcaatagcttcctgcttcttttagagtaaaaacccaaatccttaaacaagctcttacctgctgcatggcctggctcccgccttactctccacccttacatcacgtggttcccctttcatcctctgcactccagcactgtcctttttttttaacatcctgagatgtcccatgcttgtttcagtcaccacattgcacatgctgctcttctccagcttctacatttagttaacttcatgcttcttcagttaagaccttcctgatcttctagctgccatcaggttcctgtgttactttttttataccaccatataactttctttcataatacttatctgagtttgtaatgatgtgtttactttggagataatatcagttgtattaatctctctcatggcttcccgaaggatgagcctagaactgttttctgctcaccagagcaggacatgatgcctatcacacactaggcattcagaaaatacttgttgaattaatggatagttccactttctattcccctcataaaaaatccaagttcataatcatgaaagcaaaaaaaaaaaattgcctagcttgcttgcgcatcaccctgccacagttgccaaagagaattagtatgtcaaatactataatattgtttatggtagagaagacaaggtgaagaatctcgtggcaccaaggttaactgctttcaaaaactatgataataggattccaccattaattgtaccagcaaagcacttttttcacctacttaggataaagaataatataacagctactctcccaactttgttagcataaaaatattatttatgatagctaagccacatcttatttcagaaacacatctagaggtttcaaatatacaaaatcttatgacacaagttgctaaaattgagttacaactgttattcatttcacaggaatagagtcataattacaaaagttaaagtcacatcaaaatcacacaccagtttcttaactccctctgttactttttattttatttctatcagctgtgagcttaattttattttcagcagctttaaaatacggaactaaagattaaaattatagggaaagataaaatgccacattctggtgcttttttttttttaacaaagttgcattattatctgtctaggaatatctttccttttgcatctgtctcagactatgtagtcctggctgtctgtgacattcagagggtggagggttaaaaacttatatttagcaacaggatgtatctgtggttagggacgctcagtctagtggacaatgaaaaattaaatatacctttcttagaagaaaatgaaatttcagatagactattaaaataggcttaatcttatattatctttaatgtttatggatcttagaatgcagttgttggctttttaaaaaaaatttatgaaaaacattttaaatttctttcattctttgtatatacagactaatattccaggaagaaaaaataaaataaaatgtgcttatttaacttgaaggaaagtgcccgccttcttgcatatattgcaagaataagcattcagtcaataatcggtcatcttcaacacttcttacaaataaactaggttttgtagtctattgcaagtcagcatttctcactggctatgatggagatggacttgggatcctaggaagaaggcccggaaacaacatttcttctccttttatgatttcagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatggtgaggctgtaaatcatttttagccactgcactgacctctgcagctgttacaattacaaatgcactacatgcctgggtgtttaccttaaaatttgaagaacagctgcagaggcatggaatttcatgagcaaagattagaactgtaattttagggtattgtgaaatttttttgtcagcaaatttgtgtcatttgtacatccaataaagaacaagaacaattagagcccatttctaagagataaaaatatctaaatgtattcctatctttctgaaatattttacttttgaggaaaaaaaagttgagaccgacactccctcaccttttgttcttctccaccgacacctgaaacgccccttcacactgtgagttcctgagtaatctgtggctacaggtttcataggaactgtcagtcacctaaagagaatttcctcatttatcagctgtttaagtcccccccacccccccaaaaaaaaaaaacctgaagtaattaattaatttttgagcacagtgtgagctgattccgacaagtctgtcctgggcatgcgaggggactggtgtgcgagggggccgggtgcaatgatggcactctgtggagcagattgcagtgattcctgtcataccatcccgggcagtcagcccattagctgccattgatttactgaccttttggcccgcttctctctctctctgtctctcggctacagacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcaggtggggggatggttttaagtgatttctttctataataaccccttagagaaacgatattgctttgattggcaatcattattaatttttcatggcattttgaagatgcagatcttttaatggtaatagctttaattgaggtctaaatgattttttgatggtctcttctaatatgatttaatagtcttatgttcacgatcgaatgagtgtgttaatttctaatttagaaattttatttgcactttaacttgactttagtttcatttttatgttccacaaaaagtgaatgaaattgtagcattttaattatacattattaaacatctcagcaattttaattccatttttcacctcgctttacttagaaattttcttttcatataggatctaagtcatagaaaaagaagtgtgtatttctttcatttttcatataacaccttcaattacttagagtatttttataagctgctactagtttatgaaatctgattaagtgttttaaggaaaatcaaaaaggcatatattatctgtgtatatataatatataaaataaattggattagtactaaaacgttggatgtacattaaaaatgatcccttaatatacatatttgtagctaaatgttaaaattactccccctctttttgcttacttgtctcaaaaataaaaactctgtcttcaacagttaagtatagcttcttaaatctttaaaacaactgaataggattgattcacagtgttccttaaatgttacatcaaaactcctctttcccactgggaggattgactctgcaaattgatattatgatatgtttgcatggacagaagtggtgtgccttaagtcacaataactggccctacagatccggaatcacttaatttaagtcttgacaccatgtctgtttttaaaattattgaacatgatattgtattcaaaattcttaggttttccttataaccttcattttcttcgaataaggaaaatgaggataagcaaacacagtcaataatggtgataagactagattatggaattttactattttaggagaacagctcatgtaaattattccatttatatctgattgggcttgtcacctgaatgcttttcaaagatgagttataaaaaatatgcttgcatagttgcacttatgtaacagtttatctccccttgcttatatgcacaaaaactcaaggaaaaaaaaagtgcctagatatttatctagcataaccgctttaaatttcacatgcagaagtgtgattgtgttggcgcattatgaatggtagctttggtgttgaaaagtcccctcatttgctcatggcatttacaattagtaaattaaaatgattgtatcatattaacagtggcacaactaaagtttatagtagtcctctgagggctgtggggggagacaaagcagctgttgctgtttgtttatgcaactcagcaacatatgagcgctggtccctcaatggcgctcggcgggctgggctctgcttgatctttgaaggttgctgctgtttgaacaaacctccctgtgtcccatgtaacaccatctgtctcactaggaatgtgggaagattcagcacaccctagcagttgtcataccgtttctgtgctgtctttttgcaaaaggcttttgtgtcattgctgctagaaaaaggctgacctcctaccttgagcatccagagtggatgactgcattttttttccagaattctaagtcacactgcttttttccccttgttcaaaaaggtcagctgtgtttgattatatctttgctgcttttaacttgtcttttcaggaaactttttttccttttttgtccctactccctagcacactactaaaaaggaaaatgaaaagtcgttgaagtctttcctactggcctgtgataaaactgctcaagcagctataacccaagatgttgtctcttacgtttgataatgaatcaaatctgataggcgacacctcaggaaaaactgggcttatatttgctactagcacaatgaataggatatttaaacatgctcatcatgtaatgaaatatttatagtcaaggtttttttgtttgtgtgtttttggtttgggattgggttttttttcttttttaaattttagattgcttcagtataagatatacttttatgctgatacaaaaaaattgataacttttgttgtgtgggggtggtttttcttgagactattcagaattttcaggaaaatatttttttcttgacagaattgtcacattctagcagagaatgttcatattttagaatttgtggtaaacacgaaaaacaacaaatatctttacagttatacttcctcgtccccaaaggttcaaagaaacattttggaaaagacactacagaaataattctaaagcaagtgttggatgcgcatgtgaaagcacttttttttatttgttccaattttattaccaacattatcacttttattgcaactctgaaagactgagcagataaataagcatgcactcaaaccttttggcctgtctgaaaaacagaggccttttaaaaatatttgtaacaaattttctttgttcctcctgcacaaaactgatgtcagtctttctccttttatagcaccaaatgctaacccaaggagcaggtaatcgcaagttcaaatgcacagagtgtggcaaggccttcaaatataaacaccatctgaaagaacacctgcgaattcacagtggtgagtagcagaggtgctggagctcgcatttgcattttacttaattaggggagttttaaaagattgtttaaaatttacacagtcctatttgtagctttttggaactatctatttatttcatcaactctgtgtgcctgatttgtgttcatgagacttatggtacaaccagtagcactgtcttataaaaagaagcagaatgcttacatgtcttaaaaattacaaatgctttgatttattacaaaatctagaggctcctttttgtccttttaaaaccgcttctccagaataaatatttctgacctgaggaaactcaactggcaaattctgaaagatattaatttttgagacctacccatgaaaaaaagggtgaagaattttggataagagctatgtatgataaatactccctgattcctgagggccgtggatcacagaacagaatcctaccactgagatttcctctttataactagtttgatagctctgccaagcattttattaccaagttggatgctattcaaaggactagttggattggtagaatcaatggaatctccacaaagtttattaaagccatggctacacttgcctttaaatactgtgacatctttattgtgctattgaccacacattagtctgacactctgtttaaataggaggctgccgatggcagacaagatttgggatctcagctgaaaaaggcatagatagcccttaccttccactgtgaacatcttgaattatgtcctcccagggcagataaagttcagaaatggttatggtcacataattctaatctaagtacctagaatgtagaggtaccccattgtgttccttttgtttggtttcacagattcttctcttggtagacaattgcaattgttatctaatcaaggaaatgtaacggtaattttaattatcattttaggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcaggtaaagagacaaatgtttttctgctatgaagaaaagaggtggcaattattttgattatgtgcatgtaggaaaaaaaaatcttagtgaaaaaactcagcagaaacagaagagtttgctttaacatgaacctaaaaccatcagtgggctagaacaatggatgaaacagtggatcactgtactctaagcacatttgctttaaaaacaaaaaggataaagaagaaattaatatttattttgagatgtatttagatggactcatctgcttttaaaattaaactttggtgaaaatatttggtaggacttacctaggtgctagaagttaaagtttataaccgtcacgtgcttttaaagatgtacacaggacaggtgtgatggctcatgcctgtaatcccagcactttgggaggccaacgagggtggatcacttgaggtcaggagtttgagaccagcctggccaacatggtaaaacaccatctgtcctaaaaatacaaaaattagctgggtgtagtgctgggtgcctgtaatcccagctacttgaaaggctgaggcagaagaatcacttgaacccaggaggctgaggttgcactgagcagagatcgtgccacagcactccagcctgagagacagagcaagactctgtcttaaataaataaataaatataaagatgtgcacaacttgcaataatgtatatacacattttaataggtacatttgttttacagagaatggtttattttgaagagtattcttaaaaatatcttccatatttcacatgacttcttaccaaatcttcaaagtagttaataattatgctttatcaaataggaaagcagttatattttaacattatgcagcatataatctttgtttgcaaaataggagcataagtagcagtgcacctctgtaacagctgttccagtattccaatttacagtacatctgccctctttgtaaatgtatttaagcctatttaatcttctctaatattaattagtacaaacatagtctaagaaaactgaactgtgggctagcaaatggaaatgtatgttatcatgcaagtttgcactcctttggatcaagacaaaataaatatcaagaaatttaataatttactgatccacattcattaatgttcaatgctgaaggctgttttaacatagaacattgataaaaagtgttattaatattccctatttcaaattagaaaattaaatataaaaatatagcttgaggcctttagttggtagacatacatttaaatagattgcataataataacattttgtacctaaatataaaattcaattaaaatcgggtttctacagctacagatcatttctaaagttaagcatactggaaaatacacaaatttcaatgttaaattttcacttatgggtatttcttggtataaaggaaatgaaggattttagaaaaatttgtttctctcaccttcagagttgaccatttcctgtccttaaaaaacagtgagatctaccttccagggcagagaagtttatatttttgttgcgtatattgttgcatatactgcatattgagacctcatatattgttcatggaaaaaaaaatgtttaactcaatcaattagtagcaagcaattttgaggttctccaaatgtccccctatgtgaagttgtttggtgtgagcacaaagagaagccactgtattgaactgtgtgattctatcgcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggtatgagtgactttgcctaactggttagagcttcccgtcctgctgtacatttcataatatttaatgagcacacttgtgcaacataagatgtaacatatgctgataccttcaacaaggaagaaataatgcttttgccgagctcagtaggacttttttgttgcctgtttattggatcattcatgtctttatgagtgtgcttgtcttaatatctttccagttattctgtaaaccaaatttagaaattatgtcaaagggacagtcagatggccagggcaatgaaatggcatgacacagccagttattgaaaataccttcaaattcttaagtttcaaagcttaagatgaacctatatatgtaaaaatctaataagaaattcagacagtaatacattagtttcatcatccaaaacaccaagaaagccataatttaggggtaattttgtttgccttttttttttaaattcgccacattttgaaagaactaaaggcattagtgtcataaaagaaaagtaatagatcagatgagctacttgaaaccacctatatttggaagattgaaataaaactttctaaattttaattagtatatttccaattcatgcattactaattaggaacaattacaaagagttgacaagaaaacagcctaattcttcactatgagtagagagatagtgggttaatttttgaaaagaaagatgaagtaccatatgtaatttaatattacttcccacaatccaagatctgcagctctatggttgagctccacttgtgtttcctccctggctccatccccacctccctgaacaataaggtagctgaacctcatccctacccctagcccatctccaattcttctccactggaaatttggcatgctctattagccctggatcgggggggaaaaagtgtaggatctcagtcaaaattttggcacgagggaacaaaaaaaataggggagtataggaaaacaactcattctaaaccaggaagtctagtatcaaacatttcaatatggaggaaaaaaaactagcactttggggggaaagctttttgggggaaaagcgatgatgaggcacaaaagaaaaagaaggaagacagaaaagggaatatgagccaggcgcagcagctcacgcctgtaatcccagcactttgaaagaccaaggcaggaagactgcttgagcccaagagtttgagaccagcctgcacaacatagtgagaccttgactctacaaaatattttttaaaaattagctggatgtggtagctcaagcctgtagtcccagctacttgggaggctgaggtaggaggatggcttgagcccaagaggtcgatgctgcagtgagccatgattgtgccactgcacctcagcctgagcaacagagtgagaccctatctcaaaaaaaaaaaaaaaaaaaaaaaagcgaagggaaggtgaatacttcctgtcatattttgactacctagatacaaggcactcttttctgtcactgaaaactgtccttgggaagtactcgtactcatcatcggctattattcctcactgggcacatgctggaggcagctcaagtgaccagcatcagcctgatagtgtggggagggtttttgtgaagcaacaaggttgataaataacagggttcttactccaaccaatacagttttctttttctttagctgtctgatattcattgttattattttaaaagtttaatgataccttaaagacaacccaatctaaatccaaacagcttttatacttgtgttatataattcaatgtttgaaacatcaaaattttcttttagtgtagatattttctttagtactaagtgctacttaagcatttacaaagtaaagatattttcatacctaaattttactttaattttaatattttaatcaaccttaaatatattttgtattccattattcagctacaataggcacatcactgaaggcatctttccctctctgattggttttattatatgaccatatgcaaactctatcatttactacacggtgagtgtacaacttttattttagtgagggctgtcatacacattgacatccagtcaatatatttacttcttataaattagagaattgtaaccttcataggtctgtagatagttgagaggcccaaaagttgacaaacacaaatatgcataatttatttgaaaaataaacttcaggcctgatgcggtggctcatgcctataatcccagcacttttggaggcagaggcaggtggatcacctgagagcgggagttcaagaccagcctgaccaacatggagaaaccccgtctctactaaaaatacaaaattagctgggtgtggtggtgcatgcctgtaatcccagctacttgggaggctaaggcaggagaatcacttgaacccgggaggcggaggttgcagtgagccaagataaggccactgcactccagcctggccgacagtgtgagactccatctcaaataaataaataaataaataaacaaacaaactttgttttttaaagtaaaaataaactattctgctccttcaagatgtgagagctgctgcctcgaaacattgcctagcaacaagatgctaatcattcaatggttgctctaaacttgtgattaattatcttcctgttggctttccaacttgtcaagtttccagcatgttaactttttggtcacttgaccaaacatctcatgacattactactgtcagtgtattaggttctattcaaatcaagttcttcatggattttctattgatgtgatgtatgtggaaatttagtccatgttcctatcccaattgaacctgtgggatagttcctatcccactagcctttcatttgtttacattaagcactagtaatattttgagaatgcactaagatgaaaattataagtgagaactgtcttgggactgactgattctaaggtcgggaaataaaattgaatcatcatttcattatgcattgattatgaatgtgtccttggtaaagtgtgtttgtgatgtctgtctacaattttacatatagaatcgtttaacttaagaaggaaattatgagctacttattcttgagacccagtgctttttttgcctcaatttatttcctaggcagataccaaagtcatcatgcttcatttttcttaccaatggcttattgcttgcttgcttttcctgggacctgggactgggacagaggagggaaacactatgtaaatgttgacttcaacagaattaattgtcacaaacaaggactgtgaaattaaaaactctgaaactcctgttaggcactgtcaagaactcatttgtattctaaaatttaaatctgacctttattgagtgctttctctgttgagacatcatggtaggtgcttttgaaacccaccttatttagaaaagtaatacaaatgtttctacttttgagtagataagtctaagttttaaataaatttaccagtcaatcttgtttctcagttatatggtaatttttttcataccacaaacctttcatttattattaagttcagttaccattctagctgtcaggtgaatcacaaatctagatattagagaaaatatttaccctaagaaagcttgattcactcagtatcaatttggatgttctgaatcttggtcatgtggaaatttaattctaggacatcttgatttgaatcaggtaaaccagcaaaacaagttaaaaagagatgaatgtccaagtcagttactatttaaattgaatttattaaatgcttaccactgaaacttctggagatcagtagactatttagtgtaaggtatatgtcaaaactctcacctgctcccagattctatcctttgcatggtatcataactgaacattttattttttcaggttgtcaattcataatgcaggattaatatatgcgtattataagcatactgtttattatcgaatgagttctctgaaaattgaatgtctataaccaaggcatatctctaagacagactgcagtttagtgggcatgcccgaagcattgctaacgggccttgaaacctataacagaggatgcttgctctctctggacactgctctgtgttttgttgctttggaaaagaaagccatatcataatgttcattcaaaattattcatacagtctcttccagaagttacctaagtagttgacctttttgtgctcctgagctaatgagacattagtatccaaaagaggttgtaggacagtttgcccatacacgccgtagcaactagagcatcaagaaaattttcatctataatttctcttctctctattcagatttattacttccatgtactctgctcctgctgcatgcgtcctacttagaacttgagaaattattgaacatgtattaatgaataagaataacatgatctaacattaactgactgcctactatgtgcaatccttgtactaaatgctttatataagttgtcttccttattctttatgcccagtccatgagttaggtccccaaatgatcttccttttacctactgatcctgagagaagttaacatgcctgagaatgcacagcctgtcataaatgatggatgtgaacccagataatcatattcatttaacactgcccctatggatgaattgctgcgactagaaacgtcttatcctttctcctgacagcatcctttcctttaaggtccaagtccacacaagtgagaccaaattcataacataatgacatgaagtttcccgggagacaaaacctcttgtctttttcccaaatacacgtctgcttcctcttaaattaccttcctaccacggtgtctttccaaatggaaaagcatgctatctttgcagactcttggcactccattgggattctctgttatccagtttacctcattcaaaacatcttttccaaaagttaaggaatggttcttgtgtggtttgaattatacttgctttcttcagagtatgagctaccttgaagtaggttattagaactgtctttatttcccatataactagtagtcaccaacaaatatctttctgatttccactcttccagttaaataacttctttctactctaatattataccttactacatttatcatcactaaatttctagtggacattccagttaaataaagaccattaatgaaatgacatatagcagtctacagcactttccgaatagtggcatgccctggaggcattcaataacattattaaagatatttaattactgattgagattttatatcaccatataactgaatacctaaagtgtatagaatgggtccctaaacttataacatgacacttagcaaacgaaaatgggattggatctactttgttgggttttaatttaatttgctgaaatgcaagtttgtattaggaaataaagcatacaacttcatatatgttacagtgatccatggcactctacatgacacatttctgactttaactctggagcatcaggctgataatttttttttatcagttctattttggaaataaactttcaagtatggcagctatggaaggtgttgaaggcattccagtgctatttgtggcctggaatcaaccagatgtgtttaggcttggcactggctttaagttccaaacactggttagaaactgcctggaatgccaaaggaaatacagcattccctagctgaagagtattttaacactcaacaagtggctgacatcttatggaaaactttagagggaaaacactatttggaatcagttcagcctccatgatatacaccctcctaatttgtattttctaatggtttcttctctgatttttattcttagactcctatgactgataagacagtcttgacatcctctttcctctgtttcttccactccctcctaacttggcagtttgctcccatttaagacctaagatcccctttcaaagcaactatctcatgatataacaagcagaggatatacatgccaatgccagcgatgatgccatctttatcacttttgtacaagtctttgttttaaaaatgtaaggaagagaattacctgatgaaaacatgtgctagatcactagaaatgtcttgttgaatagaacatttttccaagttttaaaatgagacaattagcaatggaaagcttcctgtctgagaattttcctccagcagctttctaagttcttcttgtttattaactacattgcatcagcaagcattagaaaaccaaattgtgggatggaaatgcatcttcctaactctccatcgattagaccggggtgtgttgatctttcaggcataagtacacacgcttatgcctgagtctggactcgcgtacagaattagtggaaagagacttcatgcaaagacactaatcaccctgtcatcttgttctttctcccaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacagagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttccaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctg

SEQ ID NO: 12757 - DNA, 91993 bp, Human
  misc_feature (1)...(91993): n = A,T,C or G
actttgggaggccaaggtgggcagatcatgaggtcaggagttcgagaccagcctggccaacatggtgaaaccctgtctctactaaaaatacaaaaattagccgggtgtgggggcgggcgcctgtaatcccagctactctgtaggctgaggcaagagaatcgcttgaacccgggaggcagaggttacagtgagccaagatcgtgccattgcactccagcctgggcgacgagcaagactctgtctcaaataaataaagaaagaaaaataaaatacaaataaaggtaagcgaggatgactttgaggattttaggcagagcagtgttttgaaaaaccactttagtagcccaggtttgcagaagagacaggtggaggaaataactggaaacaaagacaagaggctttaaaattgtccaagtaagaggtgatgtggccagaatatgggcaggagcagtgggaatttgaaatagggggcaacttgaggagacagttgtttgatgagtgctgatgctttggatagacatggtgaagagagagagggatttaggatgacctgggagcccaagagggtggccacctgagtaacagtgtcatgcacatcgtgactgttagctgctgtgtaccgagcacctactgtgtgccaaacatatgggaagccttgtcccatgcactattaaatctgcacagtagtcggaggaggtaggcatcatcatcttcatgttacaggtgagtgtagtgaggcttggtgacctaaaagcaccgtcccgccacacaggtgatgaatgagagaaccaggattcacatggaggagtttcagcttcctgagcccaggttcagctgaggtgagagagagaacacacctcctctctccacagggctctcacatcttgcttcagccctaggaaagaatagagcgggcagtgttctattcaagtaaagaggcccttgagttacttttcaagagggaataatagtttgtcatgcctctgagaaaacatgtgcttgacattctgccttacaagtatctaagagtgggcctctctgaccgccaagccttcctattgaaggcgttgctatgtttgcacaaattgacacaggactccaaatttatgccacgtatgtggatagaactcttaacccccactcctccctgcacactctgctccttcctttcataacatcagccactcctggctttcttcccacttctggcctcctctgctggtttctcctcttctgccttcttctacaagccatgatggatgatgccccagggatctccccttggctgccttctctcctccctgtgatgtctccctggataatcctacccatgggatgactccagcccagactgtccctcctgctccacacttgcttatacaccactggggtagtagcccactggggtctacttgagggtggacagtgggaggagggagaggagcagaaaatataactattgggtactggccttaacacctgggtgatgaaataatctgcacaacaaacccctgggacatgagtttacctatgtaacaactggctgctactccacactgccacgtgaatgccccacagccctcaaatgcagaatgcctgaatcctttcccagcccccagtcctcctctcatcaccatccacctgtttgcccaggccagaaaccaagaaacatccttagcccttccctcaatcccactccacacattcagcccctcctctctttcttctttcctacccccctgaaccagatcaccccatctcccattctgaccattgcagtcatttccttgctggtctctctgcttttactcttactctactccaagccattcggaagacataaattaggttttgccacgtctttacttaaaacatgccaacagggcatttagaatcaaatccaagctccttatcatagcttcatgctgtatgtatacctggccccgtctcatcctcatgtggacactactcttgagtcacgctggccttctttttgttccttgaacatgcttttcccaacctcagggcctttgcacatgctgttcccctgagggaatgcctttccttcactcttcacattactgacatcttatccttcagctttccactcatattgtctcagggatgccctctgtggtcaccctagctaagaaagtcaccccagcctccttctaagtcccttgttttccttcatagcaactatttatttgtccattggcttgtttggggggttgtttttctgtcttccttaccagaacctgacctccctgtgggcagacttcattacgtctgtgctttttttttttttttttttttgagacggggtcttactctgttgcccaggctggagtgcagtagtggcacaatctcggctcactgcaacctccaccttccaggttcaagtgattctcatgcctcagcctcccgagtagctgggattacaggcctgtgctgtcacggctggctaatttttgtatttttagtggagatggggtttcaccatgttggccaggctggtctcaaactcctgacctcaagtgatccgcctgcctcggcctcccaaagtgctgggattacaggcatgagctaccgtgcccggccttcatgtgtgcatttgatcctaatcttcaccactgagtgtagagccctgtacaagggtggctctcaacaaagcaatctaaatggatcaaaacccatagcaactgactttcattttggaaaaatgtgaaattggaatggttaagcattgtaaggggatgtgtttttgtgccatatgtttgctgactatgtggaaattatgataaactttgcatcgtttagcagtcaggtttgggctgggtgggctttatttttgtgggttaatggaaatggagctttaacagtggtgggggcctccattctgtgcccagtaactggccagacccatttcattatcttatgtaatcctcaaacctacacagtaagtgttgtcttccccatttttttcacagtagacactgggaggtgcagttgcctgccccaggttacagagcccaggcctgtctccctccaatgcattcaatcacaacaccacaccccacacatgggcctctccatccaacagcacatccaaggcttcagactgctgacgctgtcagaaccggttggttttgaaaagacaaagaaggaatttaacatctgatcccaccctgatatccaggttaagtaactctcactctgtgagcagccaccacatttctccagtgggatgggaggccgagacagcagtgccggcagtcccagccccagacccagccccagccccagccccggccacagggcactgtgggcagcggccaagcagccacagggacatcctggagcacaccgcacctcggccccgtgcttgtgttctttggtctccggccactgacagccaaggtgggggtcaaatgttgataaagggaagtggcttcttcttgcagaagcagggaggtggctacgtcagctaagagccagctcttgaactctggatttaaacaaaagcacttgaatagcccagacaggaggcccttagaacttgtttgtgaggaatttgagtttgagggggtgagagggagccagccaggaaccgggaaacttgcctctgctcttggattccctctccaggcacagtttacctataagtcaaaaagagctgaactctgtgaaagtgaaagcagcctcccatctcccccgtctcctctccactcaggcaccttccatgatgatgaggatgttgaagggggctgtttttatgaagagccaggctaagccgggttttacgcttggccttggccatctaccgcattgcacctgggttaagcacagccacgtgtatcaccctggtctgagggcctggacaatgtcacctgcaccatgcatagccaatcccccatcacatctcaggtttcccagcctcccaacattggcccattgctgtgccttctgccaggagagccctccccacacatcttcacttgccaacactttacccaccttccaactgtgttccaaaccccatttccctccaggagccgtcttcagatcctgactgcaggtcatctctcctcgccctcctggtaaccccatggcatttcatcttgtgtttctgtagtggcagcaagcatactgtctctgggttacagttatctacacattgatccttcacctgctggctgagaggctctttggggagagagaatgtgcattggcagtagggatttatgcaaagggctttggggccaggtagatctaggcttaggatcataaggctttaggcaacatattcaactcctttgaggctcagtttccaggttcacaaaatgctgttatggggactgcttgagctaacatgtctaaggtgcttagcctataacttggacccaggagggtgcagaactgcccgctcccttgttctgttctctttccacagctcctaaggctgagcttccctttccccagctcctaaggtcgtgccttctgtgtgctagttgcatggagctaacaaatttcacactatctcgggcgttctagttagaagaaacaaacaaaaaagaaggaccgcccttcctgtgcttcctcagagtgcagaagatgtgggtttcaaaacgtggacagtgactccctatgtcccctgtttttggtgcagacacagagaagtccctcttggttgctgacctgagaggcacatggccttgacctccagccccaaggggaaacagccaggttgctgttggggccgcagatgtgcctggccttacttactctgcagctcagcctcctcccctgtggtgtcagggacagcctcccaccctcccagagctcttggtttggtttatttatcactcagggatttcccaccagggagccttatctgacatccgcaggctcagatcttgtctggcttcccctagggacagtgtggagggaggatggccagccccagccgtggggccagcacaccattgagtccctgcaggaagtgtgctctgagagcctgctccttgcagggcttgaggatagagatggggtattcacaggtgaccaagatgtccctgtccccatgctgcatgcagtctggccaagacgacagacaccaccgaagaatagaccacaagtgtggcgggtgtgaggaatgggtgagtcagaccttccctgatcacagggaccaagtccccattctaatctatggtcacattgtgatctctcagttggcaaacccgactgccatggcccagagatttaccagccctgatctggggtctgcacatgcctgtggaggggagaactcctgctcactgtattttgtgccaggggtgtaatcacacccaggcctagccccaccagtcatttatatcccttcttccatttgtgccttgaccatgagaaccacacccgaatgctaccttctgcacatatgcgtgcgtatttccgtgtctggtttgctgtgtgtgcatacaatgtatacagcagtcccccttatctgccgtgttgctttggacaatttcagttaccagcagtcaaccacagtccaaaaatattaaatggaaaattccagaaagaactcatcagttttaaattgtgtgctgttcagagtagcatgatgaaatcttgtgccttcccactctgtccagcctggaatgtgaatcctccctttggccagtgtatacacactatgttcactacctgcccagtagtctcttagccacctcagttatgagatcaacagtatcttaagacttgcattcaagtagcccttatttacttaataatagccccaaagtgcaagaatagtgatgctggcatattggtacaattgttctattttattatgagttgctgttaatctcttactgtttctaatttataaactttatcataggtgtgtatatataggaaacagcatagcatctatagggtttggtactattcacaattccaagcatccactgggggttttggattgtagcccccttggataagggggcactgctatatattttatttattcttcttccttctttttttttttttgagactgagtctcactccatcacccaggctggagtgcagtgacgcaatgtctgctcactgtaacctctgcctcctggattcaagcgattctcatgcctcagcctcccaagtagctgggattacaggcatggggcctggctggttttcgtatttttagtagagacggggttttgccatgttggccaggctggagcatattttcaatagaacaaaggggagatctgtatagccagagggacaatcttgtgatttggaaatgagatcttgcttcctgtcccagcttttccaccaaagttgtctgatcttggatgacttatttaatttctctgagtctcagtattatcagctgtaaataataaaactcatcttaccaaactcttatgaggctctttctgaagcaatacatttgaaatcatattacaacatcaaagtgtcatacatagaaacttataaataaataaataatccatagaaagtgatcatttcattacgtctcctaccagagtctactgactccattttacaacgttaagcagggttaagcatcttgtatgttgcagtaccaagaaataaatcaatgaatacaatgtagctacatacctgagtgagataacttgggggtgagtggagagcaccaaacccagagtaccctagcaaccgaggcaaaaagaaaaacgctctggcttgcagagttttcatgatctcatttgtaaaagctaaattaaaagttctgctataaagcaggcattgagtggttgctttctcataccgtggttacagaatgacccagatgcagcaccccatttcaccagaaggtagacggaggagttcccattgcaaaactgctctccctctcttactgtcttttagccacaatgcccctattctgaggtcctgctggcccctgccgcaaccccactgcctgcagcttctccctcctcccgtttggcaccatccttcctcctgctgacttccttctccaaatgttttctcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagtacgtacactgccatttccctctcctggaatccacatgcgcttgcttgggtccagagctggcaattttatttggagttctttctccctgccggctctccctgcagctggaaatccctgtaggattaagaatagaggagactgtaggtccccatcactgtctccctcccatgttcctccttctcatttccctcctgatttgtgagaaacaaaagaatgagtgataatcatgacactcccttcccttcggtgcaaggtgctccagtttctgctcctcttttcttccccctgagcatggacctcagccaactggagctctgctgggccccgccttgttgctccctgttgcagcagctgcttgtgcctggtttcttggtcctaccgaagccgggggtggaggaagggaggctgagcctcttggcagctctagggaatgggacaggtggcctgggtgtaggcacctcaaggacacatgatttccctgctgcccagccgtggaagcattcctccctgcccagggtccgaggatcccaagatctctgctggaatcaccactcctgtgttccatgcatgttagcagacctcacaccacttcctggctgtgcgtccttgaacaagtcacttcctctcttcacctccctcataaggttgctgtaaagattaaatgaagtcaagctacaggccagacacttggttcaacttccagcacagtgagcatgaccttgaacaggtcatgcctcctctgcatttaatctcaaggaaatacaaggccaaggaaccaacacaaagacatttggacaaaaggatgtccaagcaaacgcaagcatgtggaagccatggccagtgtgtcgggaggactgtagcatgcaagggtatgagatgaggctggcatccggagaactgtccccatgtctcaccatcgtagtcagtggcaccagcatccatcattttccccagttcagcactcagtcgggggacctgtttccaaccctaccacctcttcttcctcatctgctgacatcccttctcggtagcctccctgggattctgaagcctccaggcggtcaccacagcctactggcactctcagaacttgcctggctctgccctctgttgccgtctctgagccccttggatttgggagttcccatctgggccccacaaagtaaccttctttccaggcaacaccaccctctgagtcctcagcctctgccctgctcctgggccagaagtcacagagctggacagacaagcccatgagagaaccctcagagggccaatgacctggatttttttttttaattttagattcaggggttacatatgcaggtttgttacatggatatattgcatgatgctgaggcttggacttcagctgaatccatcacccaaagggtgaacatagctcccaataggtgatttttcaccctttccctccctcccaccctccctctctagtagtcctcccagtgtctattgttcccatctttatgtctgtgagtacccaatgtttagttcccacttaaaggtgagaacacgcggtatttggttttttgattctgcattcattcacttagggtaatggattccagctgcatccatgttgctgcaaaggacgtggttttgttctttttaatggctgcatattttgtgtcatttatgtaccacattttcttcttcttctccttttttttttttaaattgagacagaatctcactccgtcacctaggctgaggtgcagtggcactatgggctcattgcagcctcgacttcctgagctcaggtgattctcccacctcagcctcccgagtagctgggactacaggcacacaccaccacgcctggctgatttttttgtatttttagcagagatggggttttgccatgttgcccaggttggtgtcaaactcctggactcaggcaatctgcctgctttggcttcccaaagtgctgggattacaggtgtgagccaccatgcccagcccacgttttctttattcagcccaccgttgatgggcacctggatttgttccttgtctttcctattaggaatagtgttgcaatgaacctgcaagtccaagtgtctttttggtagaacaatttattttcctttgagtatatacccagtaatgcagtaatgggattgctgggttgactggtaattctgtttttagctccttgagaaatctccaaactgctttccacagtggctgaactaatttacattcccatcatcagtgtgtgagcattctcttttctctgcaaccttgccagcatctgtttttgtttttgttattgtttttttttttttactttttactaatagccattctaactggtgtgagatggtatctcattgtggttttgatttgcatttctctggtggttagcgatgatgagcatttttttcatttgtttgttggctgtttctgtgtcttcttttgagaagtatcttgttcatgtcctttgcccactttttaatggggtttgtttttttctcattgatttgtttaaattccttgtggattctggatatcatgtctttgtcaaatgcatagttggcaaatattctctcctattgtgtagattgtctgtttactctattgatagttttgttgtggttgtgtttgtttgttttttctgtgcagaagctctttaattagatgatgacctgcattccaaccccagctcccaactgggcaagtcacctactctttctaagcctcggttgcttcatctgtaaaatggggagaatgacagaacgtactggcccagaagcatagaatttttctgcagattctgcatggagctactgcatatgaagcactctactgtgatagcaggcagagtcggccccggtaaaagtggtctgcagtaactatcactgagattgtcaacagcaccagcagcagcaaccctgccaccctttgcagcgacttggcagtttcttgggccagctcttgcctgcagccctagattatgtttggtcttctaaatgccctgcctgccttcttcctctaactctgggcagatcaccttgccttccaacaaacagagacaccaggaccctcctggtgattctcttcctgttcatgagtgtatctatctcaatgccctcctctcctccatttctggcatctagcagaggcaaagcctcctccttccagggccaaactctgcaccttcttcatctccctgcacgtccctggactcccgtgaccctcccttcttgtctcatcctccttgttggctccttcttgggctttcacataggcacctgacttcctgatctcggagaatccctgtctggccaacccaccaaagctcccctcccacctggccctgccagacgtgtctgtgggaacctccttcttcaccattcatctgttgttagcaccttacagcctggctttggccctgaaggtattgaaattgttgtcccagcagcctcggataactcatatgaaataacctgttctcactggtcattctacccaaactctgtccaaccagctcctctttgttaatgtcacccttggctgacttgatattctgattctttttttacctttgccttctagtcaagacgttcttggttgtaagtagagcaggaacaaatgtactaagtcatagttccaggtgtgcaaaaagataatactattttactattttctattctgattttatctagtgaaactcagttagcttggccaaattaaggatgttttattgtctcacttctcccaacatgggaaaagggtggttcttctttactcaggaagcagagaggtaccacctctgtgccaggctcatgtgtggcccggccttgaagaaaatagggaagcttgagaaacgggagtaaaggtaagcagggctcaggattccatggtgcttcctttgttcaacagatgggttatggagggtgctgagcatgggcctttcaggagctcttgagacagggtaacaggatgtgctcactgacctgaaggagccaggtgcagggcggtgagagccccaaagggagaggaggaggaaaacaccatcctggatctgcttagcatctgttcaagacatagctttaaatgccagcctggatctgcttagcatctgttcaagccatagctttgtcccaggctcatacctcctgtcatggccccttgctccagccactccaggctaagacttgagctcccataacgttcttgagctccaagaacgtaagaaggggcagacgggagggacaggtagaatgcaatgggggcagagaataaatacttccccgcagggcctcggagaaagcatccccaggaggtagcactgcagtggggtttgcaagaaaagtaaagatccccctgtgaaaaccagccccctggctgaggttttgctttatttttctgaaagtcaggcagcactgagaaaacagaaaagccatcttgtacagggggtggcctacgtagttcctccagacaactgcttttgcagcttgtgaggttacacggatcaggatgccccctcaggacacagttacaccagaagcctcaatctgtgtctctgaactgaaaggtcctacactggtgaagttggttggaaaagtctactgtggacggtagagggcagtgacaatcagggatgtgaactggccagctcttttttgaatttgtgaggcgaaactttgccagcagtaggcagacttgttatggaaagatccttaaatgctctgtgctgaggggaggggatggcgagggtggagtgtgggcaatttgcaagctcggttgctttcagtcaaaagcatccaaaagaaacttcctggagaaactgagtgtttaatgttgaacatttgtgtaaagccactacaaagaagacctctttatcatccttgctttttttcctgttccatcaaatatggaatgaggtccagaaaaacacagactgatttaacgtgctggtcacacagcacaactttgaaacgtgccttggcactggggggccaagactcatttggggctgtttgttagcttgagtcatttcagcgtttttacatgggcacgacctagctgctgtgctttcttcatttctgacatctttttaggggagtgatctgaagttatctctttgtgtctgttcaggccaagtcctatttcctgtcacagcattgttccaacgttgtcataaccacacctgttggtcgtgctcgtgtatgtgtgtgtgtgtgcatgtgtttttaaaaccccagaatgcccagaatcatgacggagtctctctcgagctgactcaccatcacgtctccttcgtcatgcttagcagtggccacctggttggtcctaggcaggcagtggagcataggggtgggtacaaatgaagtcaaaggaaggctgctttcctggtctctgcagagcgtagaggcagtaaggggctgaaacagccagtcaccaagccccagatctgggagctatcctggatccctccctctcattcacctcaacaggcaacctggcacagaaccagagccccacaggttctacctgcgattctctctagcgcatctcctcctctgcctctttggccttgcctcagttgaggcctttgccgtctcacaagtgatcatcggtcttcctgaccatctcccctgccttccatcaggcccctgctgagccagtccacgtggcccaggaagtgagctctaacacacacacacgcgcacacacacgcgcgtgcacacacatgcttgactggaccgtgctgctccctgccctgatcgaatcaattccaaaccctgtaacaagtatttcgagtccttcacaataggcatgcagatggtgctcagtcagggtggatattattagcctccatccccagacgcctcccagtgtgcttccagttactcccagggacatgattccagctacctcagaatgcccgcttcatggcttcttgctcacttactcaggctgagtaaaaacccctgtccagggagcatcagggaaaattgacagcatctgcccggactcctgcacctcgccggcaggaagccgcacttgatgcattcactttctactcctcagccgttgtagcccagctaatggagggcagcactggctgtggtaggaacccacttccctcgcatgtgctgtcagtcagttttctcctgagcagccctgctttctccttctctggaatttgcaagcacaccgaggtttatttttataccattgccgtgaaatgtctgagaaaactccccagggctcttctcaggatggggcagcctgcaggtcagcactttctcttccacacatgctcagctatggaagcagaaacccaaaggttgtgggatggagatgctgatgttccgaccacagagccagagcagttagggtcctggggatttgccagccatacctgcgacctaatttttctgcttcccagtgaaaggagctttttctggtctaggagcccaaagaggaacagaactgaaagcaaacccccggcctaataccaagaacccttatcacagcctttatccacattagaaacatgggccttccccaaacacagacctgcaccaaggtgtgtgagtggagagggccaggtttgtgccccacttcgccccttggccaggcatccggggcacagctacacaactgcgcacagtggtccctgtcctgtctctgagattctgggcctgggccagagaatggttcatggattgctgccatcatggggagttcactgcttcaaccccacaaaagtcccaaggaacagatttttctctttcctgtggctcaagatgcccaaggtactagaatgggagacatggaataattgtccttgttatagccatgggtatttctcttgggctggggcagcagcctaggccagagtaaaaagaccgcaaggccaacagccagacagacttgggtttgagtcatatgtgttccatattcttgccatgtcacccggatgtaccctttacacatcaattacattctagccatgtcgccctggatgcatcatttacattctaactgttactctggacccatagttcacaccctggacacttacatctacactttcctcatatgtctcagttgctttatctctaaaatgaggatactgcagagatgtgaaaatattgacaaagtgctggccatcagtcctacattaagtggaaggtgacggtgcccccaaggtgtgaatcaaagcaaaacataacaaaagccataaagtaagaataagagagtagagaaagtaatgctttttttttctattgattatactgattcatttttcaatttctgaaatatcaatttgtttggaaaattatttctagtgctcccactttgctggtctaacaagtgtgggctgagactgcctggtgggagatcacatgcttttggttttatccttttccttttatctgggctcccacaccgacattaggaggcagactgtacccttggatagaaccttgttcttcctgaggcgtcatcttaactcaccacactgtaattgcttgcccacgcctgtctttccctggagactgtcagttccatgagggcagggatcttgtgggttctgagcaatcagtctgtccccggtgcctggcaaaagagttccgtacagttcactgaatgaatgactcttctgggctgaattcgaaacagaatgttctcagggtcctccaactggggttcccttcaaggaggccttcccttatggtggggacacacacacaccagggccatcagcacagacggcatggccagaggaggaaatggcgttcagatcatacatattttataatgccgagtaaaagagtttagaaacagaatccaacttattttgtgtttctccaggggcagaagttgttccccagatgaaagttatagggaggtacatttcagctccttaggggtcaggctttttataagtatttctgtctgcaaatggatcaggctgccccaaaacgtagtgagctctctagcagagaaagtcaagcagagactgaccagttgcctgtcaaaagaaatgatgtactgggggttgctgttatcagaggagctgtggaccagatcacttgtgtgcatttgcttcttaggagctgaggagagttggtaaatagcaatgcatcttttgtgtaatccaaacagcctacacttggaatgagaaaatctagtcttgctcagtcttcaccacttaccagcctggtgattgtgtttctaccacacacagttggtgcaccctctgccttgcctgtttgcctgggaggaagattgaagttaaccattgtggaaagggccaaatgggatcccttgatctctgtcctggttaagtttggccagtggagggactggctggaaacaaaggaacaagagtggaagagtaaaaggtattaggcagccttgctcaccacggctctcacaggtctgatagctgctcactccccctgtccctttggccctagggatggtcatggcttcctgttgttgctagcctaggggctcttcaccatcctagtataacaactatgaaagcttttcctttcccaaatggggcagacagcaaagcaccttgaaatcagaagtatcaggtcagtccttggctctgttctgtgatagccacttgccagttggccaactttgacaaccacttaacctctttgaacttcagtttcttaactttaatatgggggtgaagtaaccactctgaaagcttagtgtgaggattggatgagataatgtaaacacctgtccatttatggccacacctgttaagtagccccttccctaaaccttctttaatcatcccttttgagggtgccatctattttctgcaaacctctagcatctctgggcctcagtttcctcatgcggaaagggaattaaaaaaaaaaacaaacctatttccaaggtgactgtgagcctaaggtgagttaggatgaatgcaggcacctagcagggggccagggcaaatgcacaggggcgggtgcaggtgttacctctgccttccttccacggtggccacacaccaccttctcctggatgggggcctccagattctcaccaagcctgtgcttttgctgatagttacaattttgttacagtttttgttacagtttgtttacagttttgttacagtgttccagccatgcattcctggtggttcctccccaggaagctggtctaccttccacacctgctcctccccaccagccacttcctcatcctagataacaaaggcttcctctcccaccctcccctctcttcctacccacagaatatctagccagccctccttgcatcccagacccagatgaggggaggtggcctgtgggcagttcctccatggggttccccaccacccagtccaggacacagccatgggtgaaaaaagtgggaccacgaacgtgtcagaggagacccactgtgatccttcttgtttcaaaatagacagtggacgtaaacaaaggaaatccataaccttcctaattaatgcagacacttgagagattgtttttcttggtgttaaattttgctcacccacatagtttgtggccataattgcagcgtgcataatatattgtgctgcacttgaacttttccacacctttcatcataccttcctgtgtttccagacgatcttcacagtggttgctgtcagtgctgtggaatagtcactcaggaaattaatattcaggatttacaaagtcactcctgattacagccaactttgcatgggtagctcttacttccttccactgaataatttccttactacagctcagcagcaggatgaccacctgggagcgtgtgagcaagtccacagtccctcatctgggtcaccatagttttccgaaaaggtcgtgccatgcacacttccccaacaccgtgtgaccatggtagtttcaatgcaaagccaccatgtgaaacatatttttaccaacttagcagttgaaaaattatacttcaaaggtgttttaatttacatttattttgattattttaatggcaaaatgtttccctgacttgtttattgtatctattatatatacgttattataggtacatacagtacatgtatatttgtccttttatttatttatttattttgcttgaattgtctgttcatatgctttaaattgattgctgggctgggagtaatgtctgttagtaatttgaattgcatagtaccactaataattttttgcctgtccttcttaatgatatttacaattgaagaggatcctgtcatttgccccatttttaggctctgagctatagagttcactttcccttgaaaacaatccagtaaagccgccatttcctccagcaagtctttttcttccccaaatggagcaggcagcaaagccccttggagtcagaagtatcaggtcagaccctggctctgttctgtcatagccatttgccagttggctgaccttggcaaccacttaacctctttgaacttcagtttcttaattttaatatgagggtagaataaccactgtgaaagcatagtgtgaggattggatgagataatgtaaacacccgcccgtttatggctaagtgttagctgaagccaactgcttcattcagcattaaacccaactgcttttctgaatttgccttaaagtatttgttctgcggtatcttttgaccctgcataaaatgaagtcacacgtcaaaattggtttcttaaatagttgagtttggtagcctaaacatgaaatgcaatgtctggagtcttgatttagggcattaaaaataaaatgattaaaaatggaaaacaatgtagagatccatcggatatcacccactctgcctctgaggtatgggaaaagtcctggcttagccctattgtcaccccttctgttcttcatgaccctctgttgtcttcttgtttcacaggcaacttcagcaacagcaggcagaattggaagtgcaccagagagatggattgtcatcgtatgacttatcccaggtgagtttctggaaaaccctttccctgttggaattgtctccagcccaatggacttgggactcaattcagccctgagcttgagcccctcaacacaaaggattgccccatccccccactacaatggaaagagcagacctacaggtcccctgggggtctgctgctgtcactcctccctatagaactgagccatgaagaatgtgtgagtaccaggtgaagaaccaggggccatagtcaacctaagggctgagggacatttctgaggaccatgcgtgaactgtagtatgagtatactcagaggccagcaagagcagcttctgatccccttgggccccttggcttcttggccatttccctgccactgcctgtgtcctgttcttcctcaatgtgcctcttcctgtcatgctctgagcctccctcttcaccggctctgtctcctttccttctcctatctccacatgatgtccacttttcctgatatttagagtaagttgattgttgttcatttctcactctctctaagaaagtaatcagtgtgactctgctgtccttcctctgaccttcagttcaccgccccctaaccccctcaccggcttttcttggctttcacatatagaaaagcttcccacccgataaaatgttccagcccaaaatgccagtgattccagagggagggggctctgatgaaggagagctggtggctcctggggacgcatgttctgtgccttacgcatgagttgctgttgtgttttatttaatgtgcaaataggtccccgtccccaacctaccagccggtgttcatgaggccgggaagtccgtggaaaaggcggatgcaatcttctcccaggaaagagatcctcggtttgctgaaatgtttgcaggaattagtgcatgtaagtttccaaatggtactgaggttttgagagtgtgggtttacagttgctttcaggccatctacagacagctactcttagtaagagggggccacggaaggtgagttttgagtaaccattgcagggtataaaaatacacgagttggaatggattctgtctactcctggccttgcctctgtataccagttacccagggtatggtaactaaactttatttcctttattccaatatcgcattgcgggtgaacatgttagggattgtaggaatgagatgggtagaaatttgaagattctggggcactgggagggcactgcagagagccctgggcaccctcgatgaccgaaggagggagaactgtcacattggagcctgctgtctagcaccctgccaccactcgtgttcccactcctgtttctcaaaccaccatacaaagcaccttctctctcgtgtaaaattctaaacagccagctgggtcttgagcccatttcttcagccgtgtggctgtgggtgagcctgtgggtgagacgactctgctcaccattctgcggtggcagaaaatcatgcattattgcacctgctggccaggggctgagtgttttcagtgttagaggagctcagtctctcaaagaaaccctagtggaacgtcaaggcacacagatccagggctgttccctggacatcacctgctgcggcacctgctgggtgagggtggccaggggtagctgagttccagagtgggaagagcactgggcttgcattcacgccttgagccctccctcgccggctcatgactttggacaagctacaactcacttttctcatctgtaacaaacgatagcaaacttttagtttctgtttgctcccttaatcaggcactgtcgtaagcacttaggttaactcactgaattgccactacagccttctgaggaagatacttttattctcgccttctttctgttgggaaactgaggcaggggatgattaagtaacagtccaaggttgcacctcttaccttggagatgggattcagacccagagagctgagataagagtccatcctcttcgctgttaccctgtgcttcctcacccagaactagaggacttggaatccctacaccgcagggttggaaagattgggataaaaataatgtctggagaaagaactctcattaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggacaccatcactgatgacctttgggagaagagtgaagctgcagacagggctcagggcagacagtccagcgtgaggtgcagagcctgggtaacgctgttgtcatagaaacaaaaatgtagggtgcacagggcagtgatgagtgatggggaaggaaaagcaggtttggggcagctggcagtgtggggaaggaatccaaggaacgtccgaacacctgtgcagagcctggcatagaaaaggcacttgctgagtactagtctgtaaaatgaatgaataaatgactgagttaattaaaggatgcctgttagggctaaagcctgtggaatgggcagaatttcctgtatatccgaaggatctgagctggcttgggatggggtaggctgtgggatgaaggactctggggcccaatacagccatagggaatcctgggccgcttgcagaatggtgttgctggcacctgaagtgcatcctcacccacagtcctccctctctggtcccgccagttttggcccctgcctgtccacactaaggcaggcagctgtagcccagaggcccccagggagggctgtgcacaagggctggcgctttgccccaagaagcccatccctttctgccaaggcgcctttcctaggaccgtctacgctgtagcggccctcatcagtcagtgttttggggaggacaccaagggctgggggctgtggagagggtcctactagacaatagtgaccagaaaatgtcctctgaagcaatactttcatcaggaaggagaatgggaaaggagcccttatgttaaatgaggaattgattgtatgaagacagaaatgatgtcccctttatataagccactgaacttgttttacaatgatcagctcaagaatgtctctgacattcttggtttctccctattttaaaagggatcagatagcataggaaacttattagaatacaatagtaaaattttacccaatctctgctgatctctggcttgccttttttttaacacggagctgaaaatctaccaaagccttctgtgatgagccccattctgccctacttgactgattcatgggcacccagcgcactgccctgcatgctgagctagtcccagggaggcaggaggaggggcctgaaacaaagtaaaagtctgcccccagccttttagtctttgatgagcttctcatgtaatcgacatagcctggaaaatctcctggaagaagcgcctggtggtacagacagtgcctgccgaggagctaagcagggtcagagatttagcctgcaaaggccatgcagagagcacggcacacagcaggggcctaataaagacaaactgagttaagtcgaaggtgaactgaaggtgggaggggtaaactctgggtagcaggactaggccccatccagcaggttttcattgagaagcttttctttccgtttaaaactgacagcctgcaacctatttcctgaatccttaagcctcataggtgccccaaaggaacaaattaaccagagcacaaaagagtgagtgaacagtgggactgatttttattctaagaagcttctctctttctgggaaccaaatcatctgctgagagcagaggatgtacaggcataggataggggctgaagagtgcgtgggagaccctggggagaacgaggagaggaagtaccagactactagacatggcaggactactcagcagtgtagaggaagccctgaagggagaggaggacggccaaggggctttgaggctcacgatgtgtgagtcattttctctagtgacgtgctgcatggagagagagccaggaagatggcccagggcagattgtgtggttggctgggcacgtagactcatgcaaaccaggtgtgtcctcgggataaatgcattttcctcttttctagctcttcagtggttcatgtgcctggagtgaatgatattcagtcctcttcttccacgggccagaacatgtcccaaatctcccggcagctaaaccagagtcaggtggcatggacagggagtcgtccgccctttccgggacaggtatgggcatctgtgagggcatctcccctgggtgaccagagaggcagagcactctgggaagtgttttctttggattgcggttctgaggatgggtcggctcctagctggaaccaaccaccctaacagcagctggctactcaggagcaccatccaccctcagggctctcggagagccaggtgcccagcctgcaacttcagcagccttttctccttacagccatgccctgaggcagctggcagggaaaggttgggcaggttgagacacctcatcaagaatgagcccctcactactctggacctctggctgcccctgcgccaggagggcatgaaaccaccaacccttgtgacatccccagaccctcatagtcactgtgagggtgggtgttgattgggctgagggagttctaggtgttcataatgccaaggccttggtaaccagactccagagggcccggatcctcgtagccctggggagtaacttcaaccagacgtgccccaaagatcctgcagttcctgggccctcacacaccgggctgatcccaggcctgtgcctagccagacaagagggtcatggggagtcactgtcaacccagagcaggcactgcccctgcgaccagcctggggcatcggttggggtgcaggggtctgctggtgatgctttccatctctttgctttgtcctgattgtagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcggtaggtggggaatgagggagtgagattctgggaaagccagcacaaatgctttctgaacagcctgaattcaggaggctgagctccaagctcccagctaccaaaacaaggtctggaggtttccaagcacctcctctctctctggctatgaggaggcctatggtgttcctaagagactggatgcttaggccttggctttgtgatttgactttatcattttcaaggcattgggatgatgttgctgtgctgtgaggtgatctgaataccattttaacccattatggccctggcaaggattttcaggtcccccaagtcaaaaaccttatagtcttgtttcaagaaactagagaatagctatagagacaatcaattgcataaataacactgcaaagttttctgtctcttttaaatattaaaaacacctatcttactttgttaacaaaacctcaggccatagagggttaaggaaccgctgtgtcctgtgcatttctcaggatcctgggccttgcccactctccgtgtgtgtaaggaacctcctcagcatgtctcccagggctagggttccactccacgtcaggacaagctcataagagacccgtggtcctggtaagaagtccaagctggtgcctgctttctcacagtgaggtcactgggtgacacccagcagtgcggctcatagagcttttctctacagaattgattcctcagatgagcgtgaatctgagcccaaacatctgaatttccacgtggcaagttaaaagcttccattagaactgcttgtctgtcagccttatgaacaattctgtgcaggcagggcgcggtgactcacatctgtaatcccagcactttgaaaggtcaaggtggcagatcaccggagcccaggagttcaagactagcctgggcaacattgcaaaaccctgtctctacaaaaaaaaaaaaaaaaaattagccaggtgttgtggtgcatgcctgtaattccagctactcaggaggctaaggtgggaggatcatttgatcccaggaggttgaggctgcagtgagccatgatcacaccactgcactccagcctgggtgacacagtgagaccctgtctgaaaaaacaaaagaaagaaaaatgctgtgcagagcccctagcacacaatggggagttgtcatctgctgcccagccctccccacctcctccactaacagcagcacgtccgtcccactcagcccgaggtcttggggcacagcatttcctgaggccatgcttgtccctccagccttagtcccatttacttgcagtgtgtctcctcttcgtctgttaagtattctcgccacgtggttcactggaacccagtttagaagcacagcaccctgtctgaggaaggagaaaccccatagcagttgctctcaagtcagccaggcactcagcacggttaccaccttgagcccagaatcctgtttctcaggatagcatccaccttcctgcagtcacacgtgagatccttctccacatctggttccccacccgggtgtggagagaccccttcacctcctcctgaaggtgggcctcatagactcaaggcctcctgggtacctagtccttcccggaagcccagggaccatctggcaccgatctactcaaaaaaaccttcagtgccaggccccgaatcagccctggaagacaggagacctggtccccacccagagaaggacacagtccagagactgggtcaggggagacagacagaggtaaagggaggcaggcaggacagtctgcaggtgcggcagccatggtctgcgtgggggcccttgtggctgcaggccaggacagtcgttatgtctgatggggtcaagagaggcttcggagcagagctaacacgcaaccgtggcaaggtcttggagcatcccactgtggccgtgacgagacaggtgggcaggccacttccctgccccaaccatccagtgcctttagctccatgcctctgtctagtctccactaaacaaatgccaggccctgaagtataaatggagacgggacacaggaaggacgaagccctgggttgaggccactgcaccactgtggccaagaacaggctcaacacagatggggctccaggttgggtttttacatttgcctttgagctatctcacactcagatgataataatagtaatgatagcagcctgcccttagtaggtacttattatatgctagcatgtagcattcattcagtgctcacaatagccctaagaaggagataccattattattcccatctcacagataagtaaactaaggcacactgaggtcagataacttacccaggctaacttactatagctgataatagcagaatcatgcctttggagccaagaatcaaagctgggcagtacatctgagactgtgttcccatccactactctgtacttaccatcattttcaaatccattcacaggggacctcagaattaagcaggaattggatgtcccagcagatggcccttgatgtacattcatgagaaaggggctggaacccttccaatgagggcatggaaaaagcatataaaatcgagaaatgaaggactgagaagtttcttatggccttgccatcagtgcatcatgtgttacctttggccacagctatttgagtggaataggatgcagggagagtgtgttgaaagccaggctgtggtggagtgaacaggtgatagagtggagacgaagctgagcaggagagcaggaagggaggcacagtcttgggagggagagggagacctcgaggcgaggggttgctgtcatcgtctgtgatgagtacactgctggaggaaggctcccagtgcaggcagaggggacccagcataaggtgttggggttcacatcagaggtgtagaggggcctggaaaatgggtggacaccagacccccttctgaccacagggtcagcttttactccacagggcttcaaggaagtggagtgctggctgggagaagagggcaggctttggttaaggacagaagaaagagggtgtgtgtatggttaggaagaggacccaaagggttgttcgttagtgaggatggttactcccgagggcacagtgggaaagggtgcagggaacagagcaggtaagaatgggtgagtggagaaggaacagagcaggtaagaatcggtgagtggagaaggaacagagcagtctgccccattaatggtcagtttcattaattattaaacacaaagcaggcttaaaaaacaggccgtgtttacatttgcaatggacacacaccctagcccagcgtgggcacatctgagtggcttcccagtgccctctgtgcagccctggggcctattggtgtggcactgatgggttcccagtcctgacagcaccccacggtacctggcctcagttcattatccatggccagagcccagagagataatgcggttgatcccagcctcctgcttctggctggctggagcaggcaggggatttggaatgcctgctgagcagacttgccggacgtcacccagtggtggaccaggggcagacatcgagttgtgacaagcatagcatgtcacttttgaacagtgcttcaactgtagcagactcctcaggatagctttgtagactgagtttatacattgagtgagaaaaaacgcccctgcctgggtctcagccctttctgtgaaacacatgctggttttgttcaacgagctttcaggagtcaagccaaagcatttcttccatttcagacctttcacgttatcttgagctttactgctgtcataattgtgtttccagtcttagtatcattttcattttgagtccagtcacagcaaaaacctagccatttgaaatgtagcatccactaggaaactacacagtcccattacttaagccctgaaaaatccaagcatttattcccttaacaaagtaagtggggaaagtgttgtgcctgtagggcccagtcaggagacagaaaccatggcagtaatttaaacaggaaaaatttaaagattttgtgactaattaaaggtggttaagaaggaccctgaggaatacaggaataataaatgtgggcagcagcttctacctctaaggctaagggaaagtagacaagacaggaactaagaacttggaagaggagaccccaccccacaaaacctgaggttcagcccttgttggagaatgtgcatctgtcttggtaacacactgtggatgctctggactgcagtgggtctgtaaaagcagcctgcccactgactgagacactcagtagggggtgcagatggaccagaaatggtctacacacccaccccaccaggtggccaagaatttccccagggagtgcccgcaggtaaaactgactcacaggaggcagcctctgggtggtagagaaatgtgctgaagagggagcaccctgacatcctgcacactgcgttagacacactgcaggaggaaagaaacacctgatccaggaagagaagccacttctctgcagtacctcgcttgtctctccagcgtcctctgctgagaaagcctaacgctgcactcgctgacaaaggagaaatgtttgcagggtgtagtttcagtatcatgaaacagggcaaagaaggatggatttagagccaagaggcaataaattgataactggcaagaatgtatatgacctgaatcctcaaattgctcagtttcttttcatctcaactactgccaggcatctgcttgttgatattaccttgtttcttggagaaatgcagggagccaagtgcacaggttgcttaaagagaaatggctcaaaggtgctgtagcagaccaggtttcaattccttgacttgctccaagtgtggcatacacatacgtaggatctaagttacattattttcttagcagcatgatttccagatatattgtcttggcaagcaacagcatgtccatagctccttgttccccacatgcgtctcagtttagggtgaggtctctaaagcaattcatccatgcatgacacaagtcagatcaggtcgatacagattaaatcaggtcacaatagataaacaactctggggatgaatgtcttttacaaagctcgagaaacacatccagaacacattgcctttttgtaaaagagccatgtccatcccagcctgccccacctagcccatactcactttggagaggagaattgaaagaatttgttattccaggctgggtgtggtggctcatacctgtaatcccagccctttgggaggccgaggtgggttgatcccttgaggccaggagtccaagaccagcctggccaacatggtgaaacgttgtctctactaaaaatacaaaaattagccgggcatggtggtgcgcgctgaggcaggagaattgcttgaacctgggaggtggaggttgcagtgagccgagattgcaccactgcactccagcctggatgacagaggaagactccatttcaaaaaaaaaaaaaaaggaatttattatttcaaaaatatctggagtgagaaacgaaaggcataattcaaaataggggaacagggtagactaagcacaggcagggagccagtaggattttgctgatctgaaatgtttgcagacaccatgcaccctcttcctccccagctcctgcccataaagctcagtcccggacatttttaccagtgaattatggggaattatagacctctccatccctaatactagttagtgttgaaaaggtgaggccttagccagaaggctcaggaagactgtgatccttgctgtaaggtgcgtttttcttctgcctagaaggcatttgtaagacaatgagctgccctttggtgcaccttgttactttatccagcagggtttctcagtgtcagcactattgacattttaggctggataattctttgttgtgggggggctatctcttccttatagggggttcagcagcatctccctgcctctacctactaggatttctctgtttatgataatgacaagtgtttccagacattgtcaaatgtcccccttggtttggtgggggggtggggttgcgcaaaatcacccgattgggaaccactgagctaaacccaactacataggacttccaagcaggacttcaagtgagccttaagtcttagggcaatttccaaatcagctgaacctcacaagaaaaaatgttaatgagaggagaatgatagcattgagcttcaaatttttaaaaaaggaggatgtcatccctgcctctgtgacctaggaagccacaagctcctcaagattctgacccgtggtctgaaagcccacacagctggcccaggtgttatcagcccataacacagtctatctgggctgggaggtggcccatgcacagaattatctaggcacagagaaggggaaggatgtacatgacagaaagaacacatgtgcagtagcacagagatgtaactgcatgtggctcatgggggacatgcaagtattgtcatgtgactagggcaagaggggctggaattagacacgaagtgggagatgaggctaaaaataggtccagatcgtgaaggatcttcatgccaacatccagaacatggatgttactacatagaccgcggtcaaccactaagcagtctgtaagcagtggactactgttggagggagatcacgccagtagctgtgtggttatgggggcagtgggtgtggccatgactcacagcactggttggggcagtgagaatggaggaaagcaggtaggagttgagagatggtatttaggggagtgggaactcagccgaccccagcctgtcaataccaccagaagtgcaagtttatcatccctagctcttcccactcacacccctcagcacagtcagtaatcaatcaacaagcctaggcacctccttctccatcacatctcaaatccacccactgctctccagctggcttttgttctgtgttttgagccactgtcgtctcttgcaaggattgctacagcagcctcctcccctctggctccttccctctcctcttgtctaccccattcctttctcggttggtctctttccctctctttttgtccacccacccatggaccatacacatctgtgtgcttcctgcttctgcttaaaaaccttcagtgtttctctgttgtccccaaaattggtcatactgacagtgtggaacctgacccctggcttaccctccagccttatctcttatgacttgcctgatctcactctattcctcttccatcctgagccacctgtagatgcccggatgaaccaagccctttttcaccatcaggcctttgaacagactgacccttttctctagaattattttcaaccttacctccaagccctataccggattaattactaattccccttctggtgtcatctgagatctctgaaaaaccttttctacttgtcatggctagttaggtatccctcgtaagcgtttttattctagttcctctgactcttagagcagctctcacctgtgcagaattgcctgtttgctccctttcccaaccatgctatatgcttgttgagagaggaacgatcttattctccagtgtgtgtacagtaccagcatggagcccacgtcagagcaggagctcaggaaatatttgccaagtgaataaatgaatgagtcagttgatgagattagaagaggttatttccttcttgtttgttgacgagaaggaaggcctgactcagacccctgctttcaacatatgttaagagataaggtcacttacagtaaggaccaggaggcacgtgagaaagagtagtgtaagaagtagcagaaccaaaatcaagttcagtcctagaagtcaacaagatagtttcaaacagaatgatcaagagtgttggatactcaagagagattgagaagaatgggcactcttcaaatgcctattggatggggcctggcagtagagtaattgcacagggttgagaagggagggaaaggagaagatgctgtggggtgggggtggctgtaaatgttgatggcaaagggaaggagaggtaggtatgtactttaaggaggaagggctgagggcattgatttgtgatgggcaagccccaaggaaaccatcattgcagcagcatcctgggtgagcctgtgtggcagtcatcttcctgaatgcataaggacattcccccagtctaccatgcccttccttcagcacaggtggctatgtccctccacccttctgccaagcaacatggacccactgaaggccccatcttgtgctcagcctctgcaggcttccagaatgggacaggtgcctgtcaggtgggaatttcctcgtagctccagctggcgatgctactgttttaactttgccacagttgtggacccagccttccctctgctaagccaattaatgaggccagtcgacacgattctatgaaagagttcctcctggcccttggggtcttgtgtgggatcattaggaaaagacatttcacataggcagatgaattttttatagcagaatcctatgtgcacagtagatttaaatctctcttatgctaaggaggggaatgtaccctgcctcaattttatagaattccttaccaactattgtcatcatgtagagtttgaaaagcaccaatggtaaggcattaaagggaccttatgcattttattaaagccctttatgtctcaggcattatatatgggtggatgggtgggagagagagcgagggagagagagagattcttctccctgaacactttctaacctggcctcacattaacgcagtgcccaggctgggggttgggtggggcctgaggcttccccgtggccagcatgatcgttggaaagagtagtatgggacaagatggggcttctcttgccacccagagcttgacagagagcccattatctccaaaatggtactgaatgatttgaaacaagaaaaaaagcttctaagatttttgatgttccttaaaggtatcttctctgaaggtatttttttaagcctcctctttggttgaatctcaaaaacgtttttagacaaaattccacttactggatcctctttggttgaatctcaaaaatgtttttcgacaaaaaaccacttactggataggcacagtggctcactcatcccagcactttgggaggccagagcagggggactgcatgaggccaggagtttgagaccaacctgggcaacagagccagaccccatctctaaaaaaaaaatgttttttaattagtcaggcaatgtggcatgagcctgtagtcccagctatgagggaggctgaggctggaggattggttgagcccaggatttcaaggctgaagtgagccatgattgcaccactgcattccagccagggcagtggaataagactctttctcgtatgtaaaaaaccaattccacttatgtttcctattttttgttttcttccattggctgtttttttgtataaactgtagacagaagcaaagtggctctcatttataaatgaatttgctgattcccacagaggaaccttatcttgtctgaccagtgcccaaatttcttcccctgcaaacaaactgacgcaaagaaaacactctgccaaagagccaggcaggaaaagactgtggtgcttggccctgtagggggaccttgtataatgcgtgtgtggcttccgaggagttgctcgggggcagaggctgaggttgggaatgccaagatgaggcttttcctctagcagggccagatgcctttcaagagcattcggtggaccgagagggaatcaggagcaggggcaggtgtgtcttcctcctcatgccaacaccatactgctgaggacagaccctctctcagcccacactctgcatgcaacagatatgccccttgccccccagatgcccgcaggaggcctttgtgcacagtcaccaagtgcaaggagcactccaaggcttaaagcacctagtcacctggcaggtgacctcaggaagagccatcctctctggccaagtacctgcaccattgggcaaagggctcctgtgtctcttatccactccatttatgatctgtcagccagtgagaaagacgaggatagcaaacacattccgccagctctggatggaacgtgcctttcagaagcgggaggccctccagccgcagtggttcttaggtctcacagaaccacgggatggcttttaaaggaagtgtcctgtgtgtcgaatctttcagctgaaagtggacaaagtagcgggcagttccaagggcggccctcggaagtctggtcgcagtggcaaagccagcaccatggccagcagagcggtgagcagcactcccaccagcagcccggtcagactgaagtgttccaggtaaatcgagcgagcaccgccttctcgtaggtaccggcgccttctctctgcttcctttccccctcggtctctgccgcaccaccgcctgcccgatagccgtcgtgagttctggcccagcctgggctcgagggagtccaggagtagaaagccccatcctacccagccagaaacgtcaggtgcatgtgggaaggagaaggggctgatgtagccttcgagctaagccacacaatagaggaggctgcagttggagatgcttcccagactccagagctatccagggtagaggcacaaaaccaaggccaaagggggtctctcctaagagctgcaggcacccccaggcttggctgtctgtcactggctgaccctctttcttcccaccgtagcccccaggatgtggaggacatccccacccaggcccttgctcagtgccagccttgccctggctctgctctcctctgtggttaagctcagggagagtccccgattgaggatacctgggcaccttgaaactctccattatttgagacctttctagaccatccctcgtgtctaaggcagactgtgtggctggggatggcactgctgcagccccacagagcaggcccctgccctttgtgggcttccttggctcaactttcagccagaaacattcctactggaaggcttcaaatggaggtacgagcccattaactccccttcagccatccctccaggtccttctaacaggaacccaggcacgtcctgcatgccccaggcctgccctgcaaagcaatgataggggcaggaaccacatcgtgggagggttctgagactcccaggattgcaacccctccttctcaagaatcagtgctccatataccccaccctcatcccaagcccctctcctgccggggtcagctgtgtcttcacagacaaaggcctgggactcagatgtcactcagggcagcattctgtgaatgtacaggggaacggctcacccaggccttcgcctgcctcccctgactgcagccatctcctccttcctccttctgtaaggccttgttccttgcccattctgaggccccacagcaaccctgtaaggcagaatttcctgacatggatcttcatggtcacgatgctaaaaagaattcttggccaaataagcttacgaaaaactggttaaacaaagttattgagtttctttattgcaggacgtatcagagcttttattacaccaataaggactggatttctaggaggtaggcaaagtgtgccttgtttcccaaacttatttgtccacagaattcttttctcacagagtatcacatgggctgagaattcaacagaacacatgttggggaattggctgtaagaaactaaaatagtgctattcccgttttctggatgggtcatctgaggcccagaggactggaaagacatgttgaaactgaaatctaaccattcagggattcgtccctgcgctaagataaacatggaagacaggccagccaggtctccacatacatcttccttccactccactctgcgttgcatttctcttatattttggccatctgctatctgttaggtgcaccttgcttggggccagcctggggtctccccgccagtggggttctcgtctaccctgggtccctgactcaaccttagatagacaaagggcatgtcctaatgccgtttacctgctgtcacaacagctccctggggagaacagtttccccgggtctcagacatttgaggacccttgcagagcatcccgcagaaggctggggaggacctctgggctgcccctttagggatggccatgagggtgagtgcagactgggctcctgggacatgcccagtgcacggacagaggagctgactcccctgtggctctcttttcctctcctctgcaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaacaaatggcccaggccaagtttgtaattgaaccatccttgaaacctgccctttgcattacactccctcctatgggctgtattgtgtcataatctgtaaaggatgtggcgtacattatactaaagagtgacccttttggaggtttagcttcttaggatagaaaaggaaactagggctgggcacagtggctcaggcctgtaatcccagcactttgggaggctgaggtgggaagatcactggagcccaggggtttgagaacagcttgagcaacaaagcaagaccctgtctcaaaacaaaacaaacaaaggaagctagcatatcagtcatattgcattagaaccaacagaaaataaataaacaaataataaaaggaaacacaattcttgaccgtctgtgttaggcaaggctctctagaagcttccttacaaatgctatttttgttaatacaaatctgatatgtggttactctccctggtttacagatggagaaactggaactcagagaagttaagaaaatacaggaaggaaatggcagaaccaggatattgaactcaggtctcagtccaaaaccctgtatatattgtcctattcaaacattcttcttattattttttaatccttacaaaattgttagtgttttaatatgctgatgcctctagtaaatacaattgactcttgaacaacatgggtttgaactgtgtaggtccacttacacgtggattttcttccatccacctctgccagccctgagacaggaagacctcctcttcctcctcctcctcagcctactcaacgtgaagatgacaaggatggagacctttgtgaagagccacttccacttaatgaatagtaaatatactgtctcttccttatgattttcttaacattttcttttctctagcttacttaactgtaagaatacagtatataacacatctaaaatatgtgttaattaactgttttatgttatctatattctggtcaacggtagattattagttgttaagttttaggggagtcaaaatttatacatggactttcaactgcatgaagagtaggcgtccctaacccccatgatgttcaagggtcaactgtacttacaaattctattgttcctctgccaaaagagaactttttggattctagcaaaatggcagactaaaattgttttaaaactcttccatcaaacacctagcattgctagtttttacagctttattgatctattattgacataaagtagactgcacgtatttaaagtatacataaaattctgtgaccctgagttaaatatagacttcttagatactacaccaaaagcatgatccatcaaagaataaattgacaaattagactacataaatattaaaggcatttgcttttcaaaagacactgctaagagcatgaaaagataagccactgatgggagaaaacattcacaagtcatgtatctgacaaaggactagtacctagaatatgtgaagaactcttacaatggaataaaacaaatgactcagtacaaaacaggcaaaaaatctgaacaggcacgtcaccacagaaaatatacagatggcaaataagcatgtggaaaaaactgattaccatcattagtcatcaaggaaatggaaaataaaatatacagtgactctaatatttggctaaaatgtaaaaagactgatgatagcaagtgttgcccaggatatggagcaactagaaccctcataaaggcaaaatggtacagccactttgagtaacagtttcttaggaagttaatcatccactcatcttatgacctagctttttcatacctagctatttgcccaggagaaataaaaacatatttccaaacaaagacttgaataggaatattcattgcagtttcatatgtaatagccatgagggaaaaacaacctaaatgtccatcagtaggtgagtggataaacaaattgtggtaccaccacacagtggaatactacccagcaataaaaaggaacaaagcacagatacaatcaacagcataaacagagctcgaaaacattatgcagagcaaaaaatgccaggcacaaacatacacaatgattgcacttatatgaaactctagataagacttatccaatcagaaagcagatcgttggttgctggccggaggagtaagtgggaggaggcacaagggaagtttgtgagatgatgaaaaggttctatatctttcttgtgtgatggtcacaaaggtgtatacaaatcacaaaactcatcaaacccttcatttaagatgggtacattaaattctgttgtgcataggttgtctctaaataaagttgatgtaaaaataatcacagcagtttcttgtggaatttgtcaagttgatttcaaatttcctatggaagaaaaaatgataggcagtaaattttgttgaataagatctaaaaaagaaaagaaagagggagaaagaggaagaaaaggagaaaaaagagccagcctttatcccaccggacagtgggaagctttatcattagaagtgtggggttgggccaggcatggtggctcacacctctaatcccagcactttgggaagctgagaggtaaggatcccttgagcccaggagttcaaaaccaacatcatggtgaggccccatccctacaaaaaagagatgaatggcttgagcccaggagttcgaggctacagtgagctatgatcacaccactgcactcctgactgagtgacagagtgagaccccctttctctaaaaaaaaaaaaaaagtgtaaggttagcatggagatggaaaagtagatcacagaacacaacaaagaacctagaaatccacagacattcagaaagaagcttggaagagtcagcattacaaatcacagggaccagctagacttccaatagatggtgctcgaggaaagaatgtaggaaaagaaatcttcatactctcatctcacaccctatagaaaaaataaactctacacagatgaaaacatcgcaaggctaaaggcaatatatgtaaaacatttagaaaaaatctaggagaatatattttaaaaatcaagtcttggaaggatttcttaaacccggcacaaagacaacaaacaatgaagtaaaatattgataaagtttaactcaatttaaaaaatcagcctcaaaaaatgtaacagtccattaactggtagaaaatatttgcaatttgtatacccaaaaatgtagtattcagaataaatgaaagattcctaaaagtcaatttaaaaaaatagaactcaatagaaaaatggtcaaagaatttgagttgtgagttcatagaaaatcagatggcattaaatctattagaagacgctgaacttcattgtaattaagggaaaggcaaaattaaaacaaaataaatgcttatgtcgctcagatttactacgtctgataacatgattgttactgaggatatggggagacaggaattctatttcctagctagtggaaaatagcatacttgctctgaaaaagatgacatttatcagtaccatttttccaacagcatattggaatgtcaaagatgtacaaacccatgacagtgattctaattccaactgtctgttctacaaaacgtctcacatatacacaagaagacagataaaaagatatttattgctctgtgtgtaagagtgaaaaagtggaagaaaataatctatcctttagtagagaaatgaataaattgtgatttaggtacacaaaggaatatatcgcagcacttaaataccttgttgcagatgcaaaaattctaaaaatataacattgaatttaactgctgtgcatatttttataactcaacatattaacatattttgtaaataaatagataattggtcaaagaaagaaaagaaaaataacctcattgatgctaaaaacaattctggataatgtttatccttagaagaaagacatagaatgacttgtatgattcaattccttaaaacagattaagaaagagaaaaaaaaagaggtattgactaaaaaggaacagaaaagtagctgaggcaattatggcaaaatgttaaacagctgtttcatttcggtaatgagcacgtaaaattctataatacttttctcaaaatgatgtataatggaaatatttaataattaaacagaactcagaaagcagacacttaaatctcacaactagtcaaagaaatgcaaattaaagtaacaatggcatgacatttttcaccccaatggactggcaaaagtgggaatgaatgtgaaaggattgtcttagttatttttggtaaaaatagaaatttttgcaattcattttgagagtgacgtgacaatatctattaaataaaactgtatctttgactcaactatcccatctctaataatctgtcttagcgaaataagaatgttgaatacagatatatttatagaaatatttattgccaccttattttgtaggggtggaaaactgtaaattaaggcaaagctcactgatagaagaatggatgaatacattggagaatacctacttcatgaactatcagatagcattatttcaatatattaataaataaaataaataatcagaaaattataaatgaaattaatctatgttgataaagcaaacatgaccaaaagcacattagttaggttcatgtgtgagtacatggttgtatatatacatacatatgtacatgtagaaaatgtataaagtattcagcctgggcaacattgcaagaccctgtctctacaaaaaaaaaaaaaattaattagccaggtgtggtggcacatacctagtaatcttagctactcaggaggttgaggtaggaggatcacttgagccctggagtttgaggctgcaataagccataatcatgccacagcactctagagtctaggtgacagaatgacaccttgtctcagaaaaaaaaaatgtataaaataccatattcacattaataagctgtatttggagggattgtagaagcagagaaagtaagcaaaacttaaaataaatgtgttacgtataataacattgcatttacgtgaaattatttacatatgcatttattcatttatcttgtgtatttctccaagaaaaaaaggcatatgcctttatatgtataacagatggatgaaaatcccctcatgatggtctcaacctaatgggatctgaggtgaagttcccttccatccttgtaacttttaatatgacttgttctacaaagaatatatattacttataaaatcattaaaagtaatctaaagcaaattgcctgccagaataagaagagaataaatgatcacccacagtaacttgaaatcttgaaccactatggaattttgatgccaaggagtgggaaagagaaggacacctgtgtgcaatggtagaatgcactctagctggacacacctgtggcagatgggaagctgagtggactgcagggcacgatgaggagaagaagtactgaatgaaggccaaaggacctgccatgacctaggctggtgctttacctgtagtccctctttcaatcctcaaaataaacagctaacaaaaatataccctttacatagatggaacaatataattatttttctgatttttctgatgatatacattcattgtttttaaagtgaagggtatagaaaagtatgaagaacaataatactgtattccaattcgctctttttctttttctgacagagtctcactctgctgcccaggctggagtgcagtggtgcgatctcagcttactgcaacctcctcctcccgggttcaagcaattctcctgcctcagcctcctgagtagctgggattacaggtgttcaccaccacgctcagctaatttttatatttgtttagtagagatgtgggttcatcatggtggccaggctggtcttgaactcctgaccttaggagatccacccgcctagcctcccaaagtgctgggattgcaggcataagccactgtgcctggcatcttttttgttttggagccatggtctccctctgttgcccaggctagattgcagtagcacaatcacagctcaccgcagcctcgacctcctgggctcaggtgatcctcctgccttggcctcctaaagtactgtgattacaagtacgagccaccacacttggccccaattcactcttattgatgattgggacaagtgagtaaggagaggtgagaggggtcaagagcaggggtgagggaagcactgtgtctgctcagaattcagggagtggaacaaagccgctggaagaaccagcactcattctcatgataccacctagactttactcccctctcagcctccactcccagagagaacttatttttccactgagaaaaataagcttatccccccgttaccatgttgatgcctgacaatcatgagcttctttctcctgtaaatcctttaagcatgttctctcagtaagcatttgcgtggcccccaccacctgctccatgaacagtgctggggttgaggctacacagggacgacccaggtcccactcatgaggactgcctcatcctgaggggagaggcaagcaatatgatgttctggaatgtactaaggattttggtagaggtcacctattctgcaccaacacaaaagagggaagggggagtccaggaagggctgagtatctcatgcgtttgtgattagcatgacttaagcaagaggtcccagttggggcccatcaaagatggagtctacccactgggcgcacagcttgttggctcagcttttgcagaaatcacttaacagacccccaaatccaagcccgagacccctataagtcatgaaatagctatagcctctcagcaggacaccagattaaaatgcctggaatgtagcttgcctctagttctacagccacaacctcctaattataaattactaattctttccacacattttacccagagtcaaacatatatgccaagaataaagaaatgtggcctggggctgatgaggccagaaaacatttcatcacagtgatttatcagagtgtgagcatttctcattcacaaggctcattgagtgcaggtgtgcctactcgtttttttcgcagaatccccactcctttaagtggaagctatgttttcattgcagccacaatgagtttacgttgggcccatggaatagagccatgtcagggatgatgttacatggggttcctggaaaccctcgtgatccctcataccccacctactcctaggaaaggcatggttttgagagctccctgtggaagggcacacagggccaactagttaccaactccatgaggaaccaggaccccagatgttaagaagatgccggggagcttggagtcatcctaggctcactatcagcagtcagaatgaagtgttaattcaagaacagcaggctctcttcctagtcgtcacattggggtgggaaagagttttgtccaagcccgggtgctagcacaaagagatgggctggctcccctggagacaggacagaagaagagagaaatgattcagggtgcgatgctgaggacgtgttcagtgaaggctacttcaggtttttccttcatcggtttatgccctgtacagtgcatgacactcaattaatgttcaataaattccaaagaattcgtcctactctgggtcgcaccatcattcctcaattgtctttatctataatgaattcacagtgactggttgcagctttagaaaagttttcagataggtctcagaacccccactctgtgctggctatgagcgtgcaaacttgtattttcattcctggtttgcttcaagtctatggtaaggaagcagagagctggaatggagacacagttggcatctcattgtgacaaaaattggcaggcttcaaggggacaggctggcaggagtagtcagagagaggtggcatctcatctaacctgaatccttgggttctaaaaggattcctaatgaatgacagatgggaagaattgaaaagcaatgagtaaagtacggattcctgtcacccgagtggaccctgcatgatgcctggggtcatctgatgggaacatggcatgtctcaggcagatggcctgtagataaagaaaaaatggaagagaggcaggtgatcaggcttcgtggccggggccaagatggaaatgcaggttctcactgcgtcttgtgcccaaggattctgtagatgccacagatccaggatccaagggacctgggcctccttggacattaatgaggaggttagggacacagggaaggttgagagagcatagccttgctgagcaggccacagaggtccccgggactctactcgtctgctggagagacatatggtgctgccagcaggccatgggaccctctgcctattttcatccacacctgccctctgctttcatgctcaggcacaaggatccatatcccttttttgaaagactgtccttaagctgttggatcctactttgccaaagcatgcagagccaggggttcctaggattttacatcccacagagaatagcttattaccaatgactcctgggtgcaggggcatcaatatgccagcttccttgctcctagatgggggcatctctaagttgtaacatattttctctacagcatcccagtgggattgagatacatttaccctctgcagaaactttatttgccttgcttagtcttctttcttttcaatctcaattcctggagtgagatgtctccctgagccttccctggggtttggtgacagctgagcctccttgtgtattgcatgttctgtgcaattttgtgggatggaggtggtggcagatggaatttccacatccctcccagtttttcctgggaattccttaaataaatcacttttacccaatttttctcagattccacctcggaagaactcagcctcaggcaggactattgtaataaccactaaactgcagctgcatagatagtaagaacttgtaaatgctgctatgtaaattactctcttacaaaaaaaaacaaaaaacatatgtgcttttaaaagctatagatagaggctgggtgcagtggctcatgcctgtaatcccagcactgtgggaggccgaggcgggcagatcacctgaggtcgggcactccagaccatcctggccaacatagcaaaacccctcctttactagaaatacaaaaattagtgggatgtggtggcgcacacctgtaatcccagctactcaggagtctgaggcaggagaatcacttgaacccaggaggtggatgttgcagtgagccgagatcatgccactgcattccagcctgggtgacaaagcaagactccttctcaaacaaacaaacaaacaaaacaaaacaaaaacaaaaaacaatgttatagatacaaagaaattaagtttcacttttcaatcaaaataatattttagtaatgtttcatactatagatgtgaacagtactttgtcctcaaagatcaattttttcaaggactagagagagcaacccatccctatttattaatacttagactttcccagttttggcagtgaatgtagcacattccaggaaatgcttcagtcccaggaaaactaggacatttggtgaccctaccctggatgccaatatttgttgcctgggaaggcacagccctggagaggaggaagctgataggattttataagaccacaaaagtctgaaggggatttcagtgataacggagaccaccttctcagaggaggaaaggagatccagatgttctgaagaattttattttgtttcccagaagcctcagcaagagagaaaagctcctctcagcctggactttctgcagaagcacggccagaaatcagactcacaaagatcctgtgagaagctgaggagccctctctatcaaattccactcaccaggcctgtggtgaatgacccttccacgctgacccagaaaagcctggccaagtcaagtgcatgtactctgctcaagtccacaccataaaccgaaggtgaatccaccctagtgatttacccattaaaaggaatcctgagtctttgaggctgaactttctgaagagagcaacattgcttctcccctgaggaaaaccaacataagactcccagcagcctcatcagacctataagaaccctgagaaggagggagtggctgaaactcaaagctggttccttcagcagagaaggggaaatctgggcagagaccctggagcgccaccccaagagtgcaacctccaatgcttagcctgctgctggtgcccccagtcaggagaccatttcagaaaaagcctggtgtgatggttaatatcaagtgtcaacttgatcagattgaagaaggcaaagtattgttcctgggtgtctctgtgaggttgttgccaaaggagattaacatttgagtcagtggactgggaaaggcagacccaccctcaatcccggtgggcaccatcaaatcagctgccagcacagccagaataaaagcaggcagaagaatgtggaaggactagactggtttagtcttctggcctccatgtttctcccgtgctggatgtttcctgcccttgaacatcgggctccaagttcttcagcttttggactcttggacttataccagtggtttgccaggggctctcaggcctttggccacagactgaagggtaccctgtcggcttccctacttttgaggtttggggactcagtctggcttccttgctcctcagcttgcaggtggcctatgtgggacctcaccttgtgattgtgtgagtcaatactccttaataaactccctttatatatacatctaacctatcagtcctgtccctctagagaaccctaatacacctgcatcttcatttcctcaggctgccacaacaaattgctacaaagtgtgtgacttcatagaacaaaaattatctcacagttctgaagatcaaaagcttgaaatcgagatcttggcaaggttggttccttctgaaggctccatgcctcttcctggcacctggaggctgccagcaagcctgagcatgccttggtctgcagctcaatgtaattgagatgttaattacatttgcaaaagctctctttctaaataaggtcacattcacacataccaggggttagaacttggacatatttgggtggagggcagacatcattcaaccaacttcacagacaaggggtgagggagggttccagctgccaagtcttccacagagatggacaggaatccaggtgctctgtctcagaagtgaggaggcccaaaccaaatatccaggagtgcaagaagcagttacatgcatccttgctaaagaagtgggagccaaggaaaagtacgtgccaattcccgattaagcttttggatgagcagagatgacagttgcatgagctagaacaatacatggacgggaagcaaaatcagccgacctgggagagacaacaaacagctggtcatccccaatgccagagagggaatggcttaaggaaaacttggcccatgatatttaaacctccaaaggacaataatgaagtgggaggttcagggctattctctaggaacctcctttcaggcactctcatctgccaccacccccaccccaccactgcacaggtttagaagattcaagactcatggaaggctcgggacaggtgtcctcaaccctcctcattgcaggctcagggggacgcctcgccctagatgggggaagcaatcaggacctcaagtggagagggaggctttcaggatgctgagggccagctgcactgatctctgtgattagaatatgattcactgcgaaatgggaggtgggagggaagatagtttccaaaaaggctgcccccaggtctgttgtttgtggaagcaaaaggaaaagagacaaagcaaaggcaggaattatgacttaattaaggaaatggggcaatgaagaaatctggcaggatataagcagtagtcataaatcactaaaaccaacactgccactcttgttcagcaatcctcaggcagagaaaagaacaaggcctatgtgaaagaaacaaagaaagatccaatgttctcaaaaatatgaatccacacagcttaaggctaataggttcagtgatgaagattagggaggttgttccatttttttttttttttgctttagttttgcattaaaatatattgcattcttacttctgcctggaatctatttgttaagaggacaagattgtgatctagaaatgccctagaatagacaaacttcctgggtgaaaaattgattaatgcatgtttttttttgttttgttttgctttgtttttttgtgacagggtctcattctgttgcccaggctggagtgcagtggcataatctcggctcactgcaacctccacctcccaagttcaagagattctcctgcctcagtctccaaagtagctgggattacaggcgggtgacaccacaccccagctaatttttatatttttggtagagatggggtttcaccatgttggccagactggtctcgaactcctggcctcaagtgatctgcccaccttggccttccaaagtggtgggattacaggcatgagccactgcacccggctgattaatgcgtgtttgtagattgattgaaggtgaggaaatcaatcaaaaggcaatgctggatttgccagttgaaggttctactgcatgcacctccccggcctgtatgtactggtgatgtctcacaaaaaaacacaagaacaagagggtccttaatttccaaattcaacttaatttgtaagtcttaatttccaaatgcaactttgattttgttggatttttttttttttttttaaacagactctcactctgtcacccaggctggagtgcagtggcacgatcttagctcactgcagcctctgcctcccgggttcaagcgattctcctgcctcagcctcccaagtagctgggattacaggcacctgccaccacatctggctaaattttgtatttttaatacagatagggctttgccatattgggcaggctggtcttgaactcctgacctcaggtgatctgcctgtcttggcctcccaaagtgctgggattataggcatgagccaccatactcggcaggaagagcattttgtaatttataaataaactgcatttacactgtactgaagccttagttttttaaagaaaccattttcttttgaaataattatagttttacaggaggttgcaaggaaatgtacagagaagttctgttcatccttctctctccttcacctcctttttaacaccttacacagccaagaaatttactttggtgcaatcaaagaaatcaaagaagccaagaaattgcactctagcctgggcaacagagcgagactctatcaaaaataaataaataaacaaataaataaataaaaagcactcttccaacttcctctttctttcctttgtatcctctggccaaggtgatatgaactcactttcaacactcaagaaagccaaaaggaaaccataattgttttcacagacatgtatcatgggagtagcatcaacaatgtcaaatgacaagatgacatggctgaaaagtaatttccagcctgaaaatgtccagtggctttggagcttaggagtcactggggacccaacaagtacaagtccagtggcaaggcagaggcaggagccaggggccctttatgtggggactagtcccctgaaggttattcagacgaggacccagacatcatgaagcagttacgaccttgattgccgccctagatcacaaggtaatgcctaggttttagaaacaggcttcttgggcagaacaagcagcaagatgacctgatggcggcaggaaccgagctgagcctgcaggtggaggtcaagaggtcacagcagtgggcagagagctgacagtctagtagctgggcaggctcggatggccacttttttttagagacagcatctctctgtcacccaggctggattgcagtggtgcaagcatagcttactgcagcctcacactcctgggctcaagcaatccttccacctcagcttcctgggtagctgggactacaggtgtgcaccaccaggcctggctaattcttttatctttttgtaaagatggagtccaatttgttgcccagannnnnnnnnnnnnnnnnnnnnnncacttcttactgtgtaagcaggtgttcagggtgttcaaggatcactgcacacatctaaagactccaggccaggtgtggtggctcatgcctataatcccagcactttgggaagccgaggcgggcagatcacttcaggtcaggagtttgagaccagcctggccaacgtaacaaaaccctgtctctacttaaataaataaataaataaataaataaataattagccaggcttggtggcaaacacccattatcccagctacttgggagattggggcatgaaaatcgcttgaacccagcaggcagaggttgtagtgagccaagatcgagccactgcaccccagcctgggcaacagagcaagacgctatctaaaaaataatcctaaataaataaataaagtcatctgatttaggtgctcacccagctgggcttagccttgaagaatgaggctgtggcattgtacaactgtcctaagaatgaaaaatgggacctgtgtgtgctgttcttcccccactaagtggtcactattgatctcagcaatgcagcattcattggtcccatgaggcctggaaaagaccattgcaagtttctgaccttcatttagtactagaatagattataagccactcagacctatatgtatacccactgacccattcaccctgacctgaaaatttatgatagaaaaattgctcaatagaaggaaaagcaaaatgcacaaaattcctcatttccattttatttatgtgatatggtaatgctttaatattaaactacagatgttccgttctcattattccatccttccctgcccactctctactcaggcagcagaaatagcccccacatacggtgccactagaggacagaagaaagagcctccagcaagcttgtccaacctgaacgcatgcggcccaggacggctttgaatgcggcccaacacaaattcgcaaacattcttaaaacattatggggattttttcaattcttttttagctcattagctatcgttagtgttagtgtgttttatgtgtggcccaaaacagttcttccaatgtggcccgggaaaccaaaagattggaccccccggccctaaaacaaacaagttgattgttaataaaatgttatgtgaattactttaaaaaggtagagaaacaacaagctattttgcaaaatccagcctttattgaaagttaaaaaggactttcagccaggcctggtggctcacaactgtaatcctagcactttgggaggccgaggcgggtggatcacctgaaatcaggagtttgtgaccagcctggccaacatggcgaaaccccgtctctactaaaaatacaaaaaatagctgggcttggtggcaggtacctgtaacaccagctactcaggaagctgaggcaggagaatcacttgaacctgggaggcggaggttgcagtgagctgagattgtgccactgcactccagcctgggtgacaaagcaagattctgtctcaaaaaaaaaaaaaaaaaaaaagaattttctaggcattctaggatctgaacttcaaaaataaaaagccaaacttggaggacggagtggaggttttactccccagtgagtaagaaagacttccccgtgacctcgtggtgagcttcccatccaaaacggcagcgagactttgcctgcagacaggaagacattcagaaaggagtatggatgctcatagatgctgcggtcatctcacggaatgctagccctgggtgcagtggcagatatagtcccaaaatatttgtgggtgtcgcagaccagtcaggctgtgtctccttttctcaagcacagcaaagcaattcagcccccaggcagaaggtcaaccatgtcagggtggggctgaggaggcagcaagagtccccgatcacccagggagatgcagaaatgctgacatagctggaggctggaaaaggcgtgaggttacagcaaggatgacccagggaacatgggcccttgtgaccaaagatggggaccgtagacatcagtgccaagagcagctcccggtgtccaattccaggcatgtcaagcctcagcgccacaggtgctggcgaggacaggaaacagccaagtgagaggagataacccctagggcccctggaaattagagctccttgggaaagatggaaagtggaagctaaatgaggagagtttcaaaggtggctcttgacccaaaagatgctatcataacttttaaaggagaattgagtgaaagaataagagttttctaccctctgtggaactaagtggagttcagtctcagaatcgtcacacagcaaagaggtgcagctataaattgtttttgttcttttttttttttgacagagtctcgctctgttgctaggctggagtgcagtggcacgatctcagctcactgcaacctccacctcctaggttcaagtgattcttttgcctcagcctcctgagtagctgggactacaggcacaggccaccatgcccagctaatttttgtatttttagtagaaacgggttttcaccatgttggccaggatggtctcgatctcttgacctcgtgatctacccgccttggcctcccaaagtgctggaattacaggcgtgagcggctgtaaattcttaatgggctgcaatgagaaaccaggagctgtttggcagccattaaaaggtatcaatatgacaaagatggagcaatgtgcctcaatgcgtgaggataggcgaggtgagctgaggagtgacatctgatttctgggattttcttagaagagatatcctaggctcggggagtgtctaggtgaaagggaaaggacgttttacaccgactgtcgtcatgcattcttgccaagctgcccacagtgaactgactgctggatactccctcagaatctgtcgtccagcctttgagaaaatctcgtggtcacgtatttgaccaccaagccaaagcaaaggatgcagcccctcggagcccaggcagctgtgtccagtgagaggtgccttttccaggatgccagggaggtgaggcaggacttacatgccggcttctccttctatctctccgcatcgccaggaccacattcggattcatagtgtgggcagtgggtggagggctgccaggaaacatggtgcaagtgcacgcttcacaacacctcatgccaggggccggcagaaaagggcctgcctcctgaggggtgtgtgtggcggggtgagagagagagaaacggggagaatgtgtgtgagacagagtgtgtgtgtgtgtgtgtgtctgagagacagaaagagtgtgagagaatgtgtgtgcatttgttgggggagagagtgtatgaatgtatgtgtgtgcttgcgtgtgtgaatgtgtgtgcgaggaactgtgtgtgtatgtggggggagagagtgtgaatgggtatgagagtgtgtgtgtgtgaatgcctatgaatgtgtgagtgtgtgggggagtgtgtggtgtgtgtgaatatgtgaagggagagtgtgagtgtgtatgtgtgtgtgggagtatgtgtaaatgtgtgagggagagtgtgcctgagcgtgtgtgtgtgagtttgtgtgggaaaaactgtgtgatagggtgatccttttcttggcaagaggctccggatttaggaaacaaaagctcttcccgaatgacttttgcacttggcccctaaacttagccctcccaatctcagtggaccctttgccgacagtcagccacctcttaatttatgaattttttataaagacgctgttccccgaggcggcactatccacgcgtaatgttcgcatgattggggacatggtcctgaagtagccttcggtcacgtgcatgaggggcggtttgtggtacaaggttttcttgcgcttctcttccccaacgtgtcccccgccttttctcaagatcccggctcctcattaagtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgttgagtttactacacctaacagaacctgcctttttcagttgaaagtgctgtgatggtcagaaaatcagttacattatagtagggtttgtcctcaggtttgccatacagtaggctgagtaggagtggataaagatcccagacagaggtaggagccttgaacttgagcctccagtgtcttgtctactctacatttttgaactctagtgcttagggcaacaaactactgctctaaagacgtagggagccaatgcctgtggaagacattgcatatacctgagaatccgcttcctgtcattcagaagtccgctcctttccatcaatctcagtgtttaaaacacatcttcctctgttttacctacaacacctacaagtgttgaatttgatcgagattaagtaggcttcctgatggaagcaatttttcctcccctggcagacttaaatgagggccccttgaattcaaaatgcaaatggctcacatttgaactttgcatgcagcacaactcaagcatgtctggcttccctttcattgtcaagatcggtagaaactcctgttacacacacacacacacacacacacacacacacacacacacacatgcctttactactagctccactctagggcatttgaagcctgcctatacaacttcctactaaatcagcaaacattaagcgacccccaatgaggacaagatcccagacagatcacgaggactgctgagggagacgagaagtggtcctcgtcatcctggtaccccatcattccctcggcagcctctaagcaccaatcctatcccttctagctcatcctccacatcgtggcacacaaagtatctatttaaaaatgcaagtcggattggcccatatctcataaaacccttcgtggctcctttgtatgagagtccatgctcttttgaatgacattcctttaaggccccacccatctctccaacttcattgccagctactcccttcctcactccccagacttcactcagctactcctccaggcaccacagtgtccctggccttcgtgcctctgaccatgcagtaactctgcttctgatgcccagaaaactcagttgagacatgacccctccaggaagtcttcaacaacacccagcctgggtgagacatttctcttccatacatggtgtcatggccactttgcactgaaacggccatcaagtatttgtcactggaggatccccttaagggcagcggtggtgtccaattcatctctgtatcttcaaagtctcattcagtgcttagcactctgtgggagaactggatttaaatgaattcaagcaattggcatccctgccaaagttaagctgatgttaacatcagcttgtctggacagcagctgatagatcctatggttgataaaaatctccctggctggcagctaaactgttaagccagcaagcccagaacttcagaaactaccagaaaggggaaatgtgacagaagctggtattcgttactcaccaccgacatttgttttccagccaaacgggtttcttaattaatggttttgtaaaatgttcaggaaaaaaaattaatatgatgttctctgattctcagatccctgccaaacatcatctgtaacatattgccatcttggcatctgaagagcgtccctcctctttgcccaaccctcttgaattgtgggggcaaattcaacaacccggtttgaggcaatcatgctgatgaggcacacattgatgtcactcatcttgggagggtacacacacaggacagtcaccatctgcctgaaggctggtacataatccaagagagctgttttatttattttttcatttcctctattccctgccttgaaatagttttgcaactcgggaagaaaaacaaagaagagaaaaattttcctaccaagttttggactcaagtgatgtacatagcaattagcaaccaataatgtgttataataaatgtacaacaacaacatctatcacttgttgacattaactctaatttagccttcatagtatctcggtgaggtaagaactatctgtaaaaccacactttacagatataggagctgaagttcatcttaaccaactttaccaaatggctagtaagtgacagagccgtgatatgaacttcagctttgacttcaacattatgctcttagctactgtattcagtgtttgtatctcctcactctgccccttgatccattagttccctgactcatataattctagcacccagaggtccttgatataaccatatttctaactgctcacagcatttctgttgaagcacacagtccattgcctcccaaaacagcttgttccagatcggctcagcaaaaattctgagccaggtctttcccaggctaaatttaaatccactattggtctacctactggtactagttctgacccctggaactgcacaaaaccattcttccacaagatggctcttgatgtgtataaagaaaatatccctaggcttgagctgtaccaggattcaggactgagcccaggggctagaaaagaagccagcacagaagctgaattttgaggaaagactaattgtgagtatattgatggtacccagcattgctgcttctccacataaaatcttgcttgaaccaacatctaaattctccatcagtcaagtttttcttaaatgaagcagaacttgagcctttttctcctcttgggactaggataggaatggctactctcatcatggtggtccaaatatgcactgagtgatcaggcagggctctaacatggtgacaagctacaacagaggttcaatggagacagtcactgggaatgcccatcccctccctgcatccagagtgtgcctcacggaaacacagtggccaggcctaaccgtggattccaaaccctgctcctaacctgcaatactaggttccccaccttgaaagtgatgcttgtggtttggctttcccatcccctgctcctttcttctcttctcttgctgctgcattttgtggaaaagagtttaagacagaggacagcaaaccttatgcaaagaaccagagagtaaatattttaggctttgcgggccacacagtctctgatgcaactactcaactggaaagcagccatagctgtagacataggtgaatggatgcggaggtgttccaatgaaactttttttatggaagcaagcttgaattttatatgattttaatttgtcacaaaggattattttttgattttttaaaaacatgtaaaaactttaagagcatgcttaccttgacagccatacaataacagacaaaaggccatagtttttaggcccttgctctaaaatgtttactgaatctgagtgacagaccctggtctacaggatctcccaagggcattgacccctggactataaatctgggccatatgagacttaacatctttgatgactcttctggaaataatgtgtatcctgaccctgcgtggtttcttctccagcagctccactcctctactcatggctgtgccaagctcagtggcaatcacttcgtcacatccatttgtgtcttcactttgtggtgtcattccttggaaggcttggcctgtacgagaggaatatttgacaactgagttttgactcactactgcaaaaggataaatgctcgaaaattgatttcctggggaaagaaacatgactaagaggaaacctgaaagtttacgaacaatagcaccttaacgggaaatgaggcatttggggaagctggcatgaaccaagagttaggatgaaccattgagttggaccagttgagggaaaagtagtttttccttgagctaaaactagtattttccaaccttaaaaacatttcttaaactcagcttctaacagccttattttttttttattttttattttttggtgctgtaatgagagggagagggttttttgttattgtttttttgttttttgtgttttttttgaaaaatgagagctacttttaaatattgtaagttgtttgcagcaagttgttttcttaatctggaaatgggagttttgcattctgctaaatattgttctttctttaaatcctttgtttttcttaggaaagtcccagggctcttgttcccgtttgtatgttggctttctccccaaatcttctcagttgaactctgtttttccccattttatgggctgcctggaaaaaggaagactacatggttggagtgtaaataatggagatctgagtcagaagatagaagctgtcactaaccagcaggtcaatagactcttcgccactgttacatgcccaagaataggtatatatctccccagtgtccattgtattgagggcactgtggcatgaagatggggtgagaggtataaagcaaattcaagtggcaagtcttactgttaacaaaaaaatgtccagggtattatgccagttatgttctgacccatgtgtctgcagaaggaatgagacaatctcccaagttgtcagcaaaatgatcacataaaccagaagttagctccactgtaaacatatattaattcacaaattatgggaaatgttgaaaagctcacagaacatatgtccatttacaatgcagaatgcattcaaataattagattttaaaagtaatgctttcatgattatataataaatgttaaaacacagaagaacaaaaagataataatgaatttaaaattattcattgatcaaaaaattaagcacagaattaccatataatccagaaattctactttggggtatatacccctaagaattaaaagcagggactcaaagagatatttgtagacctatgttcacaataaccaaaaagtggaaataaaccaagtgttgacagatgaatggataaacatgttgtacataatattattcaggcttaaaaaggaatgaaattttgacatatgctacaacataagtaaaccttgaagacattattctaagtgaataagccagacacgaaaggacaaatattgtacaattttatgtacatgtggtacctagagtaatcaaactcacagagacagaaagtaggttggtagttgccaggggctgggggaaagagggaatggtgagttattgtttaatgagtatggcgtttcactttggaaaaatgaagatattctgggcatgtatagtggtgatggttgcatagcagtgcacttaatgccactgaactgtgcagttaaaatggttaaaatggtaaattttatgttatttatatttcaccacaattaaaaattcttcactaacaaaagaggtacaaaacttataatccaaaaactacaaaacattgttaaaagaaatagaaaacctaaataaattgaaagacatcccatgttcatggatcagaagacttaagatggcaatactctccaaattgttaagatgccaatactccacaaattggtctatagattaagcacaattcctatcaaaatcccagctggcttctttgcataaattgacaagttgattctaaaatttacatcaaaattcaaagactcagaatggccaaaacatcttgaaaaaggacaaagatagaggactcatactttcctatttcaaacctattacaaagctatagtaataaaagtgtggtactggcataggatagacatatagaccaatgaaataaaacttagagtccagaaataaccccccacatttatggtcagtttattttccacaagaatatcacaacaatttagacaattcaacagggaaagaatagtcttttcaacaaatggtactgggacaattggatatccacatgcaaagggaaaaaaaatgaacccctaccccacaccatatccaaatgcaaaatgcatcaaagacctaaatataaaagctaaaactaaactctcatatactgctggtgggactgttaaatagtgccaatacttagaaaaacactctggcagttcttcaatgacatagagttgccatatgatccagcaattccactcctaagaatataccggagagaaatgcaaatatgtaccttcacaaatacttgtacaagaacttataacagcccaaagtggaaacaacccaagggtccaccaaccaaagaattgataaattaaatgtgatatgtttacacaatgtaatattcaatcataaaaggaatgatatactgatgcatgctacaacatggatacaacttgaaagcattataagcgaaagaagccagtcacaaaaggccacatattatatgattccatttacataaaatgtagagtatagacaaacctatagagacagaaagattagctgttgccttgggctgggggtggggggtgagaaacggcaagtgactgctaatgggtacagggtttcttttgggatgataaaaatgctctaaagttgactatggtgatggttgcacagctctgtgaatatactaaaataattgaattgcatactttggatgaatggtatggtatgtgaattatctcaaaagactgttataaaaaaaaactatccgtatcattgttagcattttggtatatgtgtttatatcctttttttcttcaaatgtttatagattattaaatagaattaagattgtaatgttttatagtctatatttttatttaactatatagttccatgccattaatattgtacagaattattttattttatttcattttacggatggactatcgattatttaaacaatatcctatagtcagacttttgttttcaactacttgcacttttaaataacatcatgatgaacatccttgcaggtgaatttcttagccatccataattattccttggaataaattctggaatcaggtattacggtcaaattacatgcacatttaatggcctttgaaaggtattactaaactgctttccaaaaaggatgtatctcgtatatgaaaagatgctcagtattattagtcattagaaaaatgcaaatcaaaatcataatgaaatcccacttcacacccactaagatggctataataagaaagacagacaatatgtaaggtggaggttgcagtgaactgagatcgcaccactgcactccagcctgggtaacagagtgagatcctatctcaaaaaaaaaaggcaataataaatgttggcaaaaatgagggaaaattggaaccattgtacattttgacagttcctttaaaatttaaacatagttacagaatgacccagtaattccattcctaggtatatccccaagggaattgaaaacatatacacaaaaactagtggatgaatgttcatataaacattatttatcacagccaaaaagtggaaacaacccagatgtccatcaactaatgaacgaaatgtggtctattcatacaataaaatattattcagccatgagcagtaatgaagtgctgatgcatgctacagcatggatgaaccttgaaaacattatgctgagtgaaagaatccagacacaaaaggccacatcttacaggtttcacttacatacaatgttcagaacatgtagatctatagagatggaaagtatagtctgggtgcagtggctcacgactgtaattccagcactttgggaggccgaggcaggaggatcacttgagcccaagaattcgagaccagcctgggcaagagggagagaccttgtctctacaaaactttaaaaattagacaagtgtggtggtgtgcacctatagtcccagctacttgggaggctaaagcgggaggatggcttaagctcaggaattcaagatggcagtgagctatgatcaggctactgcactccagcttgcatgacaaaggtagaccctgtctctattttttaaaaaactgaaagtatattactagccgcatcaggggctagaggaaggaagaaatggaagtgactgctaagaagtactggagttttttcaggggtaatgaaaatgtctggaattacattgtggtgatgatctataactggaattaggtgaaaatgagccggaattagattgcggtggtgagcacaactttgtgaatactaaagccactgagctgtatactttaaaagggtaaatttgtggtatataaattacactttgcttaagaaaaaaaaaaaaagctatagctctttttactcccaaaaaagcaaagtttgagtgtgactagttccttctagctcgtgtattttttatttttcctaatttgataaacaaaaaatgtcttttcttaggtgttttaacttgcatttctttgataatcaaggaaattgcactactttttatgtttatcaactatttgcattttatctttgtgaattacttgttcatagcttctgcccatttgttttggggttttcattctttcttttattatttcacaagactttttattaaagtttttaatctgtaatcttttaccatatagttgcttaatttactttttcatttattccttcaaccagtatttatggatacctaagtgtcactaagtaagccttttgacttagtgttgataagaatatttatgtagtcattgcatccctttttctgctttctgcctgttcatatacttagaaaagacatcagtacattttttcaacctaattttctcttaggatttctttggttttcatgtttacctgcagcttctgaatttgtatggaatgcttttgctgaaggatgtgagaagtgcagtgcccatcacagggggccctgcaaggctggggcctctgcgcctccaaaccagatccctagatgcttgggacaccattcctgctgacttcctaacaccactatgcctggctaattcccagtcttgcatactttttcatcctccttccacctcctttctctgctctcaaaaggcttccgaagtgctggggattgggtaggggtgccagcctcgttcattttgcttcccaactcactgtcttacaacagagaatattgattacctgccaatccctgtgctaagttcttttttatgcaccaggtcacttaagcttcagtcagtcctacatgtctgttttacacatggggaaactgaggattaggagatttaagtagttgtccaacgatgcacagaaatctgtctccagcccctgcccttctagatattgctgtgaatatggaaagaacaggaacctagagagaaggctctgcccaactccgagatgcaatggcatatatcatccactcaatgggcaagtacatactgaaatcctgccctgtgcaggccctgggtatgggtgctgtgggcagagaggggtaataatacaagacccctgccttcagggatgtgacatctggttagctccctagagaatacacttcacaccattttgccttctccctttttctttctttcttttcttccaactttctttcctttctttcttctttctttcttcttttctttctttttctctctttccctcccttccttccttcttccttccttcctttctctttcctctttctctttctttcttctttctttttctttttctctctttccctccctccctctttctttctttctttttctttcctaccttccttccttccttccttccttccttccttccttccctctctctctttctctctttcccctgcctgcttgcctgcctgcctgcttgccttccttccttcctttcttcctttgttttctgagacaggatctcgctctattgctcaggcaggagtacagtggcatgatcactgctcactgcagcctcgacctgctggactcaagcaatcctcccaccttggcctcccaagtagctaagactacaggcatgcaccactatgcctgactaattttttcatttttctatagcaacggtaatgtggtttggctctgtgtcctcacccaaatctcatcttgaattgtaatctccgcatgtcgagggagggacttggtgggaggtgactggatcatgcgggcggtttcccccatgctgttctcatgatagtgagggagttctcatgagatctgatggtttaaaagtggtagtttcccatgcatgtgctctctctcttctgctaccatgtaagacgtgccttgcttccccttcaccttccaccatgattgtaagcttcctgaggcctctccagccaagaggaactgtgagtcaattaaaaccttttattttataaattacccagtctcaggtagtacctttatagcagtgtgaaaacagactaatacaaatgaggtctcactgtgttgcccaggctgctcttgaactcctgggctcaagtaattctcctgcctcagcctcccaaagtgctgggattacaggtgtgagcaaccatgcctagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcacaccactgcactcctgggcaacagagtgagaccttgtttccaaaaaaagtaaatatgtgtgtgtgtgtgtgtgtgtgtgtgtaagatctatctatctatctttatacgtatatatcttcttggttctgtttctctggaaaactctaacatagcttctgactccttagcctttggatatgagggctaacgaagctgtctccctttgtctagcctcagtcttcattcctccagatcccagcttaccaataactggccagtctccatggtgactgaggtaaggaaattgtgactgccttgagtgagctggtaatggctttcagactgatagctctgctgcctgctcccttgcccacccccctcaccttttgccctgaaagtgcggtggggaactgaggaatcacagactgctggagggggtgcagagcctcccacagcatcctcaagatgagagcactgccccaggcacctgccattcatcatgcttgccaccctctggcaaggtattactactggtgacaagggtgagggcagactgacttcaaccttgcctggcccagcctgcaaaaggaagctaatgaggacctgaggctggcatatttttaatctcaaagttagagtccctggactggcagccttagcatcacctgggaacttgttagaagggcaagttcttaggccccatcctaagatctaccgaatcaggaattggtggtgggttggggacagcgatctgtgttttaccaagccttccaggctatcctgatgcaagtttaagcccaaaaaccattgttcccaagcagtggatcccaaatttgtctgcactttgggattactagggagcttcaaaaaactactgatgcctgtcccagtagtgaactggagttggtttgtaccagctcaccacagctaatgttttaaatttcagaaattttgtgagtcgggtatttaacacagtcactatttaaaattaaattatatacatataaacttacaatgaactaattatattaaaaataaaagtaataaatattcaaaacccatcacctctaaattacatttaactattgtctatgctcttgagattatttatattttgtttgtttgcttttgtttgagacaaggtctcaagtgcagtgatcgtgactcactgtagctttgacctcctgggctgaagcgatcctcccatcttagtctccccagtagctggaaccccagacgtgcaccaccatacccagctaatttttctttttatagagacaaggcctcactctgttgccaagctggtctcgaactcctggcctcaagcaatccttccaccttggcctgccaaagaactgggattacaagcatgagccactgtacccaaccttatttacatgttctttctgcatgatgaaaacactatgtcatggtttgctgctgagcatctcttttcagctctgcattcagtgaaggcacatttgtagctggaaatcaaccatgacgggaatatttacacctcggtaatcagcaaatgttacaggtcagggcttttcctcccaaagagcctgttgttaagcatttgccgcatactactactcatgttccaccccagaagttgtaatttaatgggtctgggatgtggctgggctttggaattaaaaaaaaaaatccccaggtaattctaatgtgcaccaactctgggaaccaccattctaaagaaagtcagctcactgcagaccccccgcgggagtgcttagtggggtagttcacccgtaggcccctgcgctcaacaggcccgactgtgttgtgtgatgacgtgggaaggagtcctcttacttctcacaaactcagtttgagggggcaggtagttaaagtagataagtgaagagagtgaaggaggtgacacagtggccaacccgagggttcacaccccatttgcacctcacccatgagctgtcagccccagccaggagttgccacatgtggaatgctggctcaaggctaccagagcttctgattgtttttagataaactacaattctggatatttcagtgaaatcttcccatctttaggaaatcacaaaggccacacaaaaacacacctgctaaccagcttcagctagcaagctactgatttgaaacccttatctagcaagggtggacctcacacaggatacatgagagtatggccacattgcaagtaagtgaaaatgactcgatagtgctgctggggcccctcatcagaagggtggaccccacatggtcactggattcctcctcaaagcccaggtggtaagttggttccaggggtcctggaaaagcaggggggtggcatttcagatttcacctcatatagtttagtagtctccaaatacaagaagagaggaaaaagaacagcaaatactgatcacaaaccccctaccccagaacgtcctgtaaactgacatttaatcattgaaaatgatgtggggaaatgagtgtggccatccacattcccacagctatttctggaggtcagcaaaacagacctccaagcacatcaccttcaggtgagaccctggacacctcactgccaatccctgtcttaagttttggatgaaaatttttcagatcctggacactttaggcattgggttagtctaatcaccgtcaaatcgcggccatggagaaattagaaccttcctacagtgctggtggaaatataaaatggcatggcagctttggaaagcagcctggcaattcctcaaaagcttaagatagagttaccgtgtgacccagcaattctaattctagatatatattcaaaagaattgaaagcatattcacacaaaaacttgctcatgaatgttcatagcagcatgatgcatactagtcaaaaagtgacaagaacccaaatgtctatcaattaacgaatggacaaacaaaatgtggtcttgccatacgatgaaacattattcagccattaaaaggaatgaagtactgatacatgccacaacatggatgtaagttaaaaacattatgctaagtcgggcagggcatggtggctcacacctgtaatcccagcattttgggaggccgaggcaggcagatcacttgtggtcaggagttcgagagcagcctggccaacatggcaaaaccctgtctctactaaaaatacaataattagccgggcatggtggtgcatgcctgtaatcccagctactcaggaggctgaggcaggagaatcacttgaacctgggaagcggaggttgtagtgagccaagatctcaccacagcacttcagcctgggcaacagagtgagactccgtctcaaaaaaaaaaaaaaaaaaaaaagccaaaaaacccattatgctaagtgaaagaagtcagtcacaaaaggccacacattgtatgatttataagagatgtccatccaagataggcaaatagataaaaacagaaaataaattaacggttgccaggggctgagagcaggagaaataaggactggctgcaaatggggctgggtttccttttggagtaatgaaaataattggcattggataatagttatggttgtataaccttgcgaatatactaaaaactactgaattgtatacttcaaagtgtgcaattttaaaaattgtggctacatatctaagcagacagcttgtactttggcaaaaaatatgtaaacatcccattcatctcattgtggagtgaatcaggaagggaagaaacacagtgagagtccctctgataacaactgatattacagaggccacaatgcaggctgtaaccaacatttatcccaccatggccaaggaggagatggacctgaagacaccttctatgtaatttaaacacattgcaagtgcagaatgtgaaaatgcagaggaaaagcccacagaacaggcccctcgtgtttagaatcctgcccagccatgctccaaggtgggaaactcagctgcccagaggccctcttcagggattctgcctgctttgctgtatgacagccattagtctcatgcagctaagttctaattgaggctgtagtgacatgacttgaaattcacaagattaatttttgcaaaccatgaagggattcatttattcttagtttatggagatgactctgcagaggggcagttgattgtgctatgaaagcccaacagggctaagcccagccacagtcaacctgtccatagttctcacaagaaagggagggatatgagaggacacaccccccaacaagaggaatcttcttcagtcacagaattattttcatatgaaaacatatgtgggaacaatgtctaggtaagtgctcagggctgttatggaactacagcaggaaggcatgttgatcaatgtccagtcagggaaacaaaagtcacatcatgttttccaaatacagagaagtgaagacagagagttagttacaaactcactgggaaggccagaggagcagaaggagagagatcagattagccataaactagaactacaggaaaccagatcacccttaggcaagagagctgacagggatacagtgttgcctagagttgagaacctagaaattgggaggctgtagctgttggactcttgcagctgacatcttgatgctccaggaagtcagagcctacactcctgctgctgctgttggaaccaggtacccagatcacacctgccagcctgaccccacctgagcctcagcccacaaaccaccatgctgttgaggctgctgatgtacccactgccattgccactgcacctgagcaggagcctaggagtccacactctgcaatgctgcggcagacagaaaggctaggaagggcttcactctttctccccatcttccagtctcctgccactgctctgccatggacaaaatctaaccggtatgcagaatctagatgcagtgtgcaggctcccagccccctaccatacagagcagagcacagaggagtgggaatggagctgaggggcaaaatggccagcatggagtgagtgggggtgcctttcacagcctgagatagctaaacaggggcagaaagtacctaatttctaccccaggcagagcttcagcttggagaaaattggccttaccaaatacagacagatttattggtctattttttattcactcatgcattcacacatcagttcattgggttaaacagtaatgcagcaaatagtgagtgccaataatagtatctgctctccttcccttttttacaccctacagatctctaaggtctttgtggacttctagaattccctataataatttttccttatcagagattagagccaacatcaacagaaaaggtataacgggaatgaggaggctccggtccaagcacacaaaaagatgctccctggagactgtgagggcaccaggaggctggtgctggaatccctccaattttgtcattactgctggttcggcgtgcctggggttcacatcattctttttattaaaaagtgcaccttttccttgaggggacaggactttctctggcacataattcttttcttcttttaacttttattttaggttcagggacacgtgtgcaggtgtgttataataggtaaacttgtgtcatgggggtttggtgtacagattattgaatcacccaggtgctaagcatagtacctggtaggcatttttttctgatcctctcccttttcccaccctactccctcaagtaggccccagtgaattctaaagggactttgtcacatggagttttctatgatacgctatgatattatgagacactgcacagcatccttgctcccattgtcccagggagcccagagcagaatctacatgactgcttctactggagccaacagagaaaaaccaaggagctaaccagagtcatgcctgctggctgcaatggcccctgcaagtacctgggagtttggaggaagcacacgtgttctggaggaacaagtctcagtgccctcagacctcagctcttgccactttgaagagccttgggctagctgttgatatgggtggtggatgggtggaccagggagggttgtgactctactcagttgcttcctgaggttgcattgctcctgctgggggaaggaaaggctgatgatcataagaaaatggcccttttccttggctaagcaaacgatcctctttcaaaatcaactttttagctcttctggcaagggccttaaacagagtcagagaaaacctctttgtgagtagagaaaatctgaaagaagagagtgaagacacttgaagaagaagttgtcctgcaggtcacagtggccccagtgaatgaggcactgcaggccttggaggagggagttccagagaaaaggttctgatgtagccaaacaggtcctgatgagctagacccaggtggggtaggcatggaagcaaggaaatatcccaggctgggtcacaaggagaaagcaaaagatagaagtgggatctgaagggaagggtcaaaaatggtgagtaggtaatacagagtaagagggttcagaaggcaggccgtgaaaagatccgagagtcaaatggggaaagaagatgtgcaagggcacagaaggagatacaagatcatggagttcatttctacactaccctttttttttctggtgtccccatggatatggtgtggcagtggtggaaacaccctgtggaggtgcttcagatcccagaggcaggttcccaccagcactcagcagatgtactctcctggtgagctaggtactgagccggccgtggtactctgaggagtgcctgacttgcatttcccgtttctgcatctccagcgcaagctgctggcacacagtagtgggacaaaacaaggagcagggagagatgggattcatgcacacatgacttacaacagctggctcatttctgcataagcaagtacagcacatatctctcccacttaaatgagccaaggctgcgcagcacactactgctgttcttggctgcagagtggcctgtgctctgtggccagagtgaccatgatgcacactcagcaggactggggggaggccataattgagtgatggtttattgatccttctggtgggaggagttcaataaggtatatgagaattctttgaaggtcaagttgataatctcatggtgttccatagatatggcaatgaacatatttcacatcctagttggtagatgtcattttgccatctggagttaccaacaactgagtagaccttggtggagccttcttccaaatccaggagtccaacaggctgtctgagagcacgggtatggaaggtcagttcatggaaggaagagcatctcagtgatcatgaagtagaccatagatggaggagctatggtctactcctccaggaactaaccattctggtgagaggaactaccagagggtcctgagcacagtgagatagatgagatggatgggagatcaagtctaggtgagacgggttcccaaaagtatcatgccccaaggatctcacctttctctacgtgctgcttagtggagccagggctaagaacctgcaaactacatttcttagatccctagacaatggcctattttaggtttgccaaaaggaggcgttagagagaaactgaaaggggagcagaggggaggagggatgcccctcccgtttttcctgttcctgcttgtatcgcttcagcaggagcagttggcttcagcttccagcttctcttggcactcccagaaccagccttgcctgctgaatgccagttctgaagcggatatcaagatactgtctaagaaggtctagaatggcatccaaaatgtgttcatcgggttctgaaagaggatcagggcaccatatggccaaatgttatcataaggagtaaggcatgtccagaaagccactttcctctgtactatctctctggatacagaggagaaaggactcaaagaggcacttcagagaataaactacaaattgctaaaaattaaaaaattcatctaaacaaaacaaaaaaccgaccgtggtggtggctcacacctgtaatctcagtactttgagaggccaaggtggcagatcacttgagcccaggagttcaagacttgcttgggtgacagagcaagatcctgcctcaaaaaaaaaaaaaaaaaaaaaattgtataaccatgcacatacacaaaacttcaacttcaccagtaattaaaaaaaaaaagaaataaaaatcaatattgatatttgccactttctactcacattgacaaaattatgtgagaatgataaacactgattctcaggaaaaaattattgatgagcacaaaatagattatatgatggattgtttgttagggtgttatttatgatggtgaggaaagttaagttacataccaaacaatagaatgatattaataagtataaatccataatataaaatattatttagatatttaaataatcctataaataaacatatactgccacataaaatgtgtgtagaatattacttaataaagtaatttaaatagataatatattcatctagtaagatcccatttatattaaatgtatgaatgtatatgtatatatgtgcatgtacacatacacatatatacaatcatgcatctattaatgataagggtaagtttggagaaagatgttgttagattatctcatcattgtgtcaacatcagagtgcgcttacacaaacctagatggtacagcctactacacacccaggctgtatcgtatagcttattgctcctaagctatgaacctgtgcagcatgttacactgctgagtactgcaggcaattttaatacaatgctaagtatttgtgtatctaagcatatcaaaacatagaaaaggtacagtaaaaaatacagtattataatctctctgttgttgactgaaacattgttaggtggttcatactgcatatgaaagaggtatttgtaaaaggaaagatttttaaagtcctgatgccgaggccatacacaagccaatgaaatcataataatttgtcgagtgggacccagccctcagtttttaaagcacttcaggtgattacaatgtatagccacgattgcaaatcactgatctaagcacatcccaccttattctatacactctccttttcacctccaatattaaacttctatttttatatatgtttcccaatctatttcttttggtaacatttggccctcaggaaaatagagaatcccaatgttggtttgctacaaagaagcctggagcaggctgggcacaatggctcacgcctataatcccagcactttgggaggccgaggcaggaggatcacttgagagccctggagttcgagaccagcctgggcaacatggtgaaacccagtctctacaaaaattagctagatgtggtggcatgtgcctatagtcctagctactcaggaggctgaagtggaaggattccttgagcccaggaggtcaaggctcctgtgagctgtgatcacaccactgcactccagcctgggcagcacagagagatcctgtctcagaaaaaagaaacctcacgcattttcctggtcagggagtctggacggtcttgggagccagtctgactctgctcgagtgaatcatccacagatatcacagatatcaggtagaatcttctaaaagtcattctgagcagaagcctgaaaaagaaacacacaagcacatacacagcagaagccagggctgactccccatctggccaggaagagttgcagaatatttgatgtttataacattaactctctttcattagtgacctttcattaagttgaatcatttcctttggaaataaaagaaaatgcctcaattgtttttgacaagttctcttcatctttgaaaatattttgcaaaatgacttcttgcatttgcaacctcagacttcctctagattttctctctattgacctaagcagacaattacaaaatattgttgggcaaagtcttaatctagcagggaaaattttcacattggaattgagggatctcttagacttcaccgtctgcaaccccctctgccattttatagcttgggagctgaaacctaaatgccttggttggggttagccagaatattaatagctgagctgggaatgggaccaactgtttgccacctcccttagcatgatttttgccagatcacactgtgtgggccataagtatttcattgcaactttctctagtgccaccagattgctgcctcgttcagcagtaaagtgcatggcctcttagtgtcaacatgccccaggttcaaatcctggctcaactaggtattagctgtgagaattttgtcaatttacttaacctctctgtgtctcagttttctcatctataaaatggggattcacaggattctcataaggcctaaatgagttaattcatgaaaggaatgtagaacagcggtggccatagttacagccatttttacctccatgaggcactttatcctgttgtgaggcactgacctcactcttgcttcactttggccttagatgcccctcatggtgttccatttcccacgctgagccttgaaagtctgtgtcctgtaccagatatgaggggcccctcacatgcaaacagcgggaaaagctgctcagcttgtagtgaagagggaggatggaaggcttgggacgtgggagcagacaaagggctttcaggaccagaggtttcagagcacttttgttcaaagcattgttcattcagcccttcatcaacacctcctgactaagccacttggtataattaccttgctccaataagaatcattagcattttcacagctaaaaatgctaagaaccttcatatatatcgctggccacttgcactggagggtggagactgtgttgcagccctgctcggcctttgaggtctggcgtgggcttgggctagatctctcccttccctgtgcctgcctccacctttgcccagtggacgcaagatggcttccaccagtcatcaaacgctatagccttttcttactgggtcctcataatacctggtagtgagagcagatgttttgccccattttatgaatgaggaagcctagtctcagaaagacttggcaaggctatgggtaagtgcatggaagaggtccctgggtccacaacttctgttcgctactccacattcttctggactctacccatgttcttgcacctgccaccatggcctgcctctcactaccctcatccttttcctcaaccatctatatccattcactctgggcttctctccgcagacactcatattccatcaaaatctatctcctttccttctcccacctcttccagggcctggtttgaggctagacccttagtcaaagtgattctgcctgagacaatgatggtccaaaatggggtcacgagttactactttcaggaaatgaaactcatatttagcatgccttcctcaaatcaaaatgccatccccaaagggaatgactcatggatgatggaaatttctggtaccttggcaggccagagtgacagctgctgcccttggtgaagctagcctatggagaagcagacagagacctgagtaagcctagtggctgagtcaccttgggctcatcactcccctcactgaccctcagtgaagttcctctgaccctccggtgaaggggtgaaccagattctggctgagataaactccaatccatgttccatcttctcgaaagtcccagcacacacagtcttgggtctgtggatcttcctcaaaatttactggtattttgccttcatctctcctaccttccttatgaggagtttcaaattacctagaaaagtcccacttgatcatctcccttccaatagctttaagatgtatcaggtttgtttttttgttttttttaccttaccttggcttccattttcctgtttgcttcttgcagacagagaagccagaaagagggaatcaagaaagtgttgaattcaatgaatacttctttagtaacaattatctgtcaggtacatggagcaaataagaaggagcatgggtcatgatttttgccctcaggaccccaaactacagtccagtctgaggtggggccagatgaggaccataggagaggaatgaagcaagagctgagcgggggttgggagaagatttgctgagcatggagttgctcagcaaggtaagaggggcagccccactaaagacagaaaagtgagtctgcatagggtgttgtctttcttttgcatttattacacaaacaaacagcaacgatggaaatcatgggggaagaaatcatcacaatcctccccgctaacacatcagatgtttttatttttccaagtgcttttccaggccctggtgacatttatgcaaaaatgttatgttgtggtaaacacagcacgagcccagttccgcatccagctgttctcacttagccaagcatgtctctgtgttgctacacaaacttcatcggtttaacagctgcacaatatttcaccgggtgcttccaccaataccaccaacaatgaatggatgtgccggcttcctgaaatgtgtgtactgattagtgctgctattattattattattattattattattattattattattattttaaatgtttattcatttgttaaacatagaattgttatattttctgtatttccttgataagtagaagggttgaacatgtatcagttcttttgtttgctaattatagctcctcttgttggaatgatctgtttgggttctttagtttccctggacctgctacggtgtacatagggtgagtaacagccctggtttgctcaggactgaggtgggttccctgggcatagggctttcagggagccctcctgaaaacccaggataagttggtcaccctatttttatataataggcacagcaattgtgcagttagttcttgatgaattccattccacgctcccaaataagccttcctttcttcttcatctgtaatagtcataagagtcattataagaaatacatgaaataggccaggcgcggtggctcacgcctgtaatcctagcactttgggaggccgaggcaggcggatcatgaggtcaggaaatcgagaccaacatggctaacacagtgaaaccccgtctctactaaaaatacaaaaaaattagcagggcatgatggcgggcgcctgtagtcccagctgctcgggaggctgaggcaggagaatggcgtgaacccgggaggcggagcttgcagtcagccgaaatctctccactgcactccagcactccagcctgggcaacagagcgagactccgtctcaaaaaaaaaaaaaaagaaaaaaagaaggaaatgaaataacatagttcaggcgcttagaacagtgcttggaacatagtacttaataaatttagaggaagagggtatagcatattgattaagattttgtcacgtagaatcacactgcctgcattcagatcctgcctgcttggtttcctcctctgcaaaactgagataataattacctgtgtcatacttcttatgaagattaaatgagctaatttaagcaaaatacgtggaatagggtcaggcaaattgtaagcccccggatgttagcttctctttatggtagtagaaatggcagtcatatgtaccagtaactgccattattgatcatctactacatcaggcactgctaaggtgaccagctgtcccagtttgtctggattagtatgggtttagcactgatggcctcatatcccaggaatctttccattccaggcaaattgggatagctgggcatccaggtactgtgagaattttattttattttatttttaatttttattttttgagatgtagtttcactcttgttgccagtctggagttcaatggtgcgatctcagctcactgcaacctctgcctcctgggttccagtaattctcctgcttcagcctcccgagtagctgggactacaggcatgtgccaccatggctggttaatttttatatttttagtagtgatgggatttcaccatgttggccaggctggtcttgaagccctggcctcaagtgatctgcccacttcagcctcccaaactgctgagattccaggcataagccaccgctcctggccaggtactgtaagaattttaaatgatctcatcttgtcacccaacatcccttcacttttacacatacagaaacagggactccaagcagttaagaagtttgcccaggtgacacaggtggtgaggaccagagccggctggccccagaagcagaagttgcctcacttcatgagcagcatcttcactgggaaggggctggatactgcccggaggctgactcatggtcaccagagatcatctttttctttttaattgtggtgaaatatgcataacgttaaattgaccactttattttgaagtgtctatttcagtggcatgaagtacattcgcaatgttgtgcaaccatcaccaccatttcctgacattatccttttacaattttttaatttggtcatgtgctgactctttctacatttataccaccctcaccgtgtgcgcaggaaacagagggttttcactcccaggaaagccctgtgagccaccagtcatcctgatgtaagccgaacatcatctgcttgcagttacacaagtgccagtaatactgagtctgtggctatggccacatatgcctcacctctcccatctcctcttcctcctctaagtgtgtccactgaggtaccacaaaggactcagcaagctgagatcaggaatgaagggatcagcattgtttcatggaaagtatttgaaagagtgatgagtctgcactgcatctgggcagatgcttttgttcagggaggtgatgcctccggcctctctgtccaggagaccataagacccagcactgggaaatcctccatcacgctgtgactaaaaccaaacctgaagcatgtgagtttagcccagttaagatgctcctgagaacacggcccatcagtccctgcacattaaggctgctcagggaccggcaggcagcctccgggttcccgtgagggtgcaaggctccgagagagctgcaccagcagtggggttgggccaggagtgagggctgtcttccttcccccgagtttctaccacccaccctttctttgaactctcttcagatctttatcccattcatcttttgccttctatagaccatggactcctggagggcaggaacaccatctcactgccgcctgtgcttgagcgtgcaggcgctcaatcacctgcattgcctcagagaagagcaggtgtcttaggggtttggtcctgtgctaactatggcaaaggactaagaatatgaaaataataatactaagcactttctctcttttcttttctttttttaagacagggtctcataaaagacaggtcttttgggctggagtgcagtacacaaccatggctcactgcaggcttcaactcctgggctcgagcaatcctcccgcctcagcctcccaagtgcatcaccaagcctggctaattttttatttttttatagagagggtggtctcactacattgccaaggctggtcttgaactcctgagcacaagcgatccttctgcctcagcctcccaaagtgctgggattacaggcgtgaggaaccacttcctgcctaaatactttctgtgtgccaaactctgtgccaatgctttccatcaagtgtcctcaccacgaccctatgaggaggttcatgcccttttttaaccatagaaaaactggagtgagttcagaggagtgtgacaagggacatgagtggcctttggggtgagcttactgggtgataagagaggcctcccgagggcaggatgcccactcaggcaggctctgaaagggaaaggctacaagaactgcaggggcctgcggaggagaatgtgcaataaacagaggcctatagaaaataattattcttgcaagggctgtgggggatgaggcgcagaactcaaggcgctcaaattcgattcagaacagaggctgggagaccaggcatggtggctcatgcctataatcccagcactttgagaggccaaggtgggtggttcatttgaggccaggagttcgagaccagcctgaccaacatggtgaaaccccatctctacgaaaaatactaaaattagctgggcctggtggtgcgtgcctgtaatcccagctactcgggaggctgaggcaggagaatcgcttgaaccttggaggcggaggttgcagtgagcccacattgcaccactgtactctagcctgggtgacagagtggaaaaaaaaacccaaagaacacaagttggcaaggtggcagcctctggagaaggcattggttgggaggtgagctgcacccccaagatgttgttctgctctataattctgggctgggctgaggatgtggtcagaaagcaccatcacccagagggagctcagaggatgagcaaagaaagaacagcttcccgaagaacatttcctctgtttactcactatagcttaagcagaaggtgtctgctgtggtggctttgcctggagtaatttgtaattgacacagttttcacgaccttctctgggtttcctctcatttattttttttttcggttaacagaatagtgatgagtaattttatctgacttcactgtgacatcaactggcacatctcctaaagtagccttttgtctactgactgcccttcagggggatatatttatatttatgtctcatttattctcctcctctgtggattgtggttttctgggagagaagtaaactccactttaggggaacatggaaaatccaattgtttaatagatgataaatcgcatttcctttctcttttttcaaaagatgagctgttaagaatcacatgttaggaacggttgtcatgctagaaatacatggctcccaatgtttacaccttatgagtttctggggtattggctgccatttttacccattttttattttatttatgttaatactctgtgccatttggtccactacacctgaacatgaatttatgtccatctgcattcattgatcactcggctctttacaaacagggccctgttcatgcagtcgctttccatcctcatgcattctgcttcagaggtactggatcacttaccactgtccaggtgctctgggctgtctcccctactatgtctttgccatgccatcaccattgcaaaaaagaagaagaagaaaaaagccttcccacttattatctgccttgatcatgcctataaatctatttggtaccagttcagccctgcacctttctcctggagaccttcacaagcctctcgtctagttatagcaccctccattcccctctgtcacatgctatcatgatggtgcttgtgtgggatctccttgaaggcaaagacctgactttgtatcttattcattcttatatccagggccattgcattgcatagtgtgtggcatgacataatttctcaataaatccatattaagtaaaaacaaaacaaatatctctgtaggaaaggattcaattcactatgccacgttctccatgaagacttctttgatccttccaacctggaagacatttctacctgtgggctcctgctcactccacctgtgcctccctttgaacctgatacctttctgattttccattctaccagcaaaccgccaggaacgcaggaggcgctaagtggtcaccaaatgaaagttagttgaaaacggaactgaatttgctcacagtcacaccgagataatcattctggaatactcttgcatccatgcagtttttccctcacattgtgaaaacaacattcctaggaatccagagaagaacttcaatcctgaaacagaatattctgtgtgagtagtatctccatctttccctgactgtagaggtacatggaatttattgttgtcgttgttgtcttgaggttctcagaattttaaaggtctacagttgggctttaaggaacttgaaaggtcacctagccctttaaagccactttatcggccagcctcggcctcccgaggtgccgggattgcacacagaatctcgctcactcagtgctcaatgttgcccaggctggagtgcagtggcgtgatctcggctcgctacaacctccacctcccagccgcctgccttggcctcccaaagtgccgagattgcagcctctacccggccgccaccccgtctaagaagtgaggagcatctctgcccggccgcccatcatctgggatgtgaggagcccctcctcccggccgcccagtctgggaagtgaggagcacctcttccaggccgtcatcccgtctaggaagtgaggagcgtctctgcccggctgcccatcgtctgggatgtggggagcgcctctgccccgccgccaccccgtctgggaggtgaggagtgtctctgaccggccgccccgtctgggaagtgaggagcccctccgcccggcagctgccctgtctgggaggggaggaacatctccgcccggcagccaccccatccaggaggtggggggcagcccccgcccggccagccgccccatcctggaggtgggtggcagactccgcccggccaggcgcccagtccgggaggtgaggggcgcctctgccgggccgccccgtctgggaagtgaggagcccctctgcccggccgccaccccgtctgggaggtgtacccaacagctcattaagagcgggccatgatgacgatggcggttttgtcgaatagaaaggggggaagtgtggggaaaagaaagagagatcggattgttactgtgtctgtgtggaaa

SEQ ID NO: 12758 - DNA, 88490 bp, Human
atatttgttacctttcctctgaaacttgatgtctctattcctgaatatatcattactttgattcatcaacatttttggacaagtaacattagtaataaaagctatctaagtactttcccattgtcctgcttttttttttttaaataaaaaaggtgactatgttttacacatgatagttttttccatgttcttctggttaaagagcagatagaaaaaaaaaacttaaaacacggcaaggctgtaacatgccaaaggtcacataacctgtaggtacagccagatttcctaattattaatctattgaaatattttacagttcactagattactaaatccggttatcaattaatgatgcacctgacatacacccttctagtttcataaaaatcacctcattaggccgggcgtggtggctcacgcctgtaatcccagcaatttgggaggcccagggggtgcagatccctcgaaaccagcctgggcaacctggcgaaaccccgtctctaccaaaaatacaaaaaaaaaaaaaaaaaaaagcaggtgctggctgaggtgggaggatcaccggggcccctgagttcaaggctgcagtaagccgtgatcgcgccactgcacttcagcctgggcgacagagtgagaccctttctcaaaacgaacacacacaacaacacagtaacaacacaccaacccccaaaacatcttattaaactctgtggatctactccatttaaacctaattgtttcaggaaatagtctaaaaacatttttttgtcctggaatggaatgtgtatgtagcctcagggaataactcagtttatcaggttcttggctgtttttccacaggtccaaaaggataaatggataaagtgatgctgaaataacttagagaacccgtattccaacgcttctattttaaaacagtgaagcagtttttaaaatagaaaagtatctacagttttgctttcaagcaaatagcgttaacggaatcattgctattcaaaactatttttgaagtatcggtgtacatttaaaaaaaataatttttaaaaaagaaagctgtcgtattctggattccgcaacccccccaccccgcctcgccactcgtcgccctccctccacctccaccctcccatggcttaagtcgcatagctgaaaggattttgctcattttttccaaaacacttcacgtctgggtagtagccaatcatggaaagtttcaagcaaatgttacatttgggagagggatgaagcttgtccggggctgctctcggaggagtcgccagacgccctgacctgggggccagatgcgagctgggatcggctgagttccgacagctcggccagactcagccctgccaaacctgctgacctcactgccctcggctgcgggggatctcgcccatgagtctccccaacagctcgaattcccagagtggaggagcccactgcttcataaatgcgagaacccagagcccctagtacccaactaggctagcctcggagttggcacggcgtgcagaaagtggctactgagcagccgggcctggctcacccgcttcacacgtcagtttgactcctctccccgccccccaccaatcccccgccctactctccgcgcacccagagccgagagaaatttgactgccctaatcgccaatcaaaagagaggtcgaggatttgagccaatcgcagcgggcgaaaggggcgggccgtcggcgagcgctgaaggtctctagccctcccctgcgctttagcctcagtgcggagccttaggcggagcgaagagaaccggtcgcggcaatcctagcgcgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaagtgagtgtctccgcgaggcgcaggaggcctcgttcctttcggggcccgggctcaggctgtgtggggccctgcggtggggcgggataggagccgagggtctagaaaagagaaagaaagaggtgccgggcggcctgcgccgtctgcgccatgtgattaggcccggccccgcccgcgccttccccgcccgcaaccctccgccaggcacccacttcccttctccgcccccggcgggggtcgccctggtggggccgcggtggggcctgatgggctcgcctggcgtccccagcgccagagaggccgctcccctgcccgcgctgcgtgctcagctccctggcttgcggctgcagcgcctggccgcccgccccagccattcgtgggcgatgctgcacgaacatctccaccgagtgacatttaggagttgggcgttcagcagagcctttaccttcctgacttgtcgcttttcctggctcgtttccgctctgcctgccctcccttggtttctgccatcatccggttggaagccagatgtgacagagagctctttatatttcgggagtggctacctcaggcacgtgtagagccatctggggcaccggaaacaatgtttcagaagtgagattaggaggaatccggtcatgtggccgagaagatggggcacgcagtatagaccacctgtttgcataagggaccagctttggcttgtcaggtcttccgtgagatggggagatttttagaaataaaagttaaatagccaagatgaaatgtgacgtaatacactaactcagtgaaaaatctgagttgagtaggttttgtgacttcattgtgataggatgttgactcatcctgtatgtgtacggcacagtagtttagtcttaaagcaaaactggtttttcttaaacaatatgcaaagcagtctcctatatatttttgtcttgtgtaatacaaatggaccactttgttttcccaaaatgggtaaaaatttacggatctgctttcattataccttactctttttctggctttgtacgctgacactctaacctgttttgcttcccttttatttctgctgctatttccagctctagagttccttaagtcaaactgaaagtgagaacattgttataatttcaatctcacgcctgcttgatgttttcctgtaattgaagttgggaccttccagaaacttttctaaagttcttctcccagactgaaaaagattatttgaaaaaaatcacttgatgatgggcgaaatttgtggtattttgtgatgttggttttgtgccacaaaatagcgtcctgaccatggacaggttatttaatatcttgggttagatgacttaaatcctttcaagttctaaaaagctatacttctgttaaatttgtacttctctcatgttttagggactagaatgataatttaatctcatctgggactcacttttactttaacatcatccggtttaccaaggaagtaacgagtttacatgcaagtgcccaaggtacagaattgcaaaatgcagtcacaaccgtttaaaagttcatcttaaaggctacaagatgggaactgcattctagtaaaattatgtcttcaggtctgtgtctctgcagtggctctagtgcctctcttttttttcctcttttgtcaaacaggaaattgagcttcttctgtgattcacttgtccagaagtttctggtttcattgcctttttaataaaaaatcaccttttagcaagggcctcaaggttgtgaagaaagttttttaatttggttaaagtttctatttccttaatgatctggtttccaaatgtagctttccctctttggctcctttcattttgcctttatgtgacaaacatttctcttatcctgggaggtaagctcccagttgatcctgttatcctttctaatgcttagcctgcaaagcataggtcatccctcagtcagcagtccacctggtatgctagcactcactcaggactgtgccagattttatgtagtattattaaaagaaataaccatgagaaaattaaattaacattttgtaaaaggcttagaacaatatttggcgtgtgttaaatgacacataactatttattaaataaatgagaaaacattgcttcttcattattgtaaagcctgttaaagagattggccttggaatttcaggcttgcacatgaaggtttttaatttttttagtttccacaaaaatgtttatcttgagaaattgctatacatctgtcttatatgaaactatgtgagttgcactgtttaccttttgctctgctgataaataagttcagagtaaatttaatgcttaaccacaccaatttcatcagttcacatggctgggatatctgcgtttcctcctttccttggtcctgagtttatattttatttactttatattctggaaggaggcgtgatataagcaagttactttacctttttttcacaaactctttgaactaatgtcactttagactatgctgtttccatcacgcaactttagtgtggtttaggatacgaacgtcttaatatcacatagaaaaatttaatgatctttgctcagttttgtctttagtgatcttatttaattttgttatggttcattctgttatcttgaaaaccaactttgcttgcctctcttcgttttcaaaattgttctctcttctttcctagttctttttgaatttcctcactgggtaaaaaccctgaggctgaggcctttgtccctttcccacttgtctgccttctcaacagcgtatcccttctttcagctttgactctcatctttgtgtaggtaatacttcacctcttaatccaaagctctgttcttaaatttgtcgccacatattcaatgacttcaaattttaagtctgtaccctgatattcattcttttctccaattcaacctattttgcgtactgttatgagagtaattttagagttttaatttgaaaatagcactctcttccagaaaaccagcaggatctggaatgagcattatattaaagtcacaaactatgttatggtttatgccagcacttgcccatatggacatttttatcatacttttctctgttaagctggttatacttatttccataaagtccagaagtatgtatcctatcttagtgaatggtccctaggaagagtcagagggatagaggtaaggggcattattaagtttttttatttggacatttattttttaatgagaaaggaaaagagatacataacagaaattgggctggaaaaataccagcatatgtatgctgttagaaaatagataattcatacaggatgcaatattgaaagtattctgttaaaacaacaatgaggtcactttccccttctcagattggcagatgttaaatcaagtaattgggaaaataggaactctagcattgctagtagaagtataaattattagttcagttactttaggcagtttggtagtttctgttaaaaactgcatagctgtgatgtggtagttggatgtttgcatatctacatgaagtcgtggcattcagaaatatttgtaattacacaaataagcatgctttaaaatatatttatatttaaaagtaaaaatgcaagcaaaaatgatttcagctagctttagttagtatggatttatgttttgatagttcagctttatgttttgatagttatggacaatgaagggcaaagaaaatcatcgaggtgtatactctgaaaattgaattttttttttttgagatggagtctcgctctgtcacacaggctggagtgcagtggtgtgatctcggttcactgcaacctctgcctcccgggttcaagccattctcctgcctcagcctcccgagtagctgggattacaggcacccgccaccatgcgtggctaatttttgtttttagtagagatggggtttcaccatgttggctgggctggtcttgaactcctgacctcagatgatctgcccgctgtggccacccaaagtgctgggattacaggcgtgagccaccgcacctggtctgaacattgaatttcaaagtaagatgaaatgcttatgaatttcagcgaacattgaattgggtagattgaacaatactagtaaggaagttgagttagtatttggcagatataaatattaagttttagaactgaatgacaaaacctctgttaaaatgggggcacatgtttttatgatccttcagtattgcatttggttttaattttaaaagctaacatatttacaattcacttaagctaaaatcaaggtggaaagtatgtttaattttttcctttgggcttctcaggcagccccttagttatttttgatttcttcattattaaaaatttttttctaggtgatgattatcagtgagttttagtttttttttttaaattttatttttatttatttatttatttttgaggtggagtctcactctgtcacccaggttggagtgcagtggtgtgatctcagctcaatgcaacctctgcctcctgggttcaagtcgttctcctgcctcagccccccatgtagctgggacttacaggcacgtgccaccacacctggctaatttttgtatttttagtaagatgggaatttaccatgtcagccaggatggtctcgacctcctgaccttgtgatacgcctgcttcggcctcccaaattgctgggattacaggcgtgagccactgcacccagcccagttttgtttttttaaaagcaagtgaaaaaggtaccaataactatatgtcataacatttttgtgacctaatatttatattgaaatgtgcatcagtcattgataactttgtccatgatctgtaattaacaaactcatgctgttaatttatagttttattaatatttggatgaaattcactgaaagaacaagaattagattctgaggggtttagtctcctggacttttagctgcatatttccagaccttactcttttatagagaagtctacctacctcaaagtcagctaatccatgaaatgactaccaaatagaattcagccttttttatgaggcaatatgtaggccagctaaaagggagggggggcactattttagtccaaagataaatgtcactttgaaagaaatttgctgaagatatttgtgggtttctttgagttttaaaaagttatttaaaagaaatcaggctgggcgtggtggctcatgcccgtaatcccagcactttgggaggccaaagcaggtggatcagttgaggtcaggagcttgagaccagcctggccaacatggtgaaacactgtctctactaaaaatacaaaaattagccaggagtggtggcgggcacctgtaatcccagctactcgggaggctgaggcaggagaatcgcttgaacccaggaggtggaggttgcagtgagccgagatcatgccgctgcactccagcctgggtgacagagcgagactcttgtctcaaaaaaaaaaaaaaaagaaagtaatagtaaaaggctgtactacttccttcttgtgatatttgaaatgaagaaaaattatgaccatataagctgaaagcctaattatagaatttgtgtgagggagctcaatcatgttaaatcctatataaattaaggttatattttatagttgcctgtctgtgccttttcacctttaagtcatttgctagtaagagaaatgcttaagaaaggtgagtaaacagatgtatttataaaaatagttattaattactgatatctctcagtgaggtacatagctttcacatagagatactgttagtacagttttaccctgaaatctactcaggtgcaaaattgctttggttatgaaacacattacttgtgagtcatcactgcacttagtgattttctgaccccctacaacgtagtagaagcaaaatgttaatgtaccttgacttccatttgggagtgtcctctgcttgatatgttaaattcattataaagaaatgtttatagtaaaagcattactttcgaaacatagaactgtagatgttgcataatgaataaaactgatagctttcaggattaagaaatatatttttgcctatttatttctggtacaggcttctaaaaaagatttttaaaattgtcttcttgatgaggatattttgagtgacatagacacgtccttcaattcttgatggtaaactttctgaagagcaatttttaagctctatgaggaacttacaaagtattcatacctttttaggaatctaagttcacaaaataaactgaagtgttagaaagatttatttcctattatttttggtacagtgttatgcatactagagaaaaatggagaaaaacgcatgttcaacattagtgggatagttaagtaaattgtggtacattcatatgagggtctcttatttagtcatttaaaatgtttgcaggtactttttaggatataaggtaatgttataacggccaaaagttagaatacagaattttctatgcagtatgatctcaagctatttaaaaagctcagaaaaagtaatagaaggaaataagccaaaatgacattagcagttgtggtttatgagaacgagcattgtttttcctgcctccttttgttacttttaagatttcccccccattataagtgggaaacgtctaaaacagtaaaaaacattccatagttttgaaaatcaaaggaaccacatctgttaagttttgaacttgtaaatctctactgtctactcttctaatatcctgattctggttgtataagaacagtaagcaccattacattgaaagaaaagtatgaaaataggttatgtatgaatttgcacagctcctgtttatcagcattgtctaatcatattcactggtacccttaaacatcaaactttaaaaatttaaaactatgcttgatatatctccctagtaaatgttacatatttctctgccatattaaaacattgtaatcaatagagtttaacatttcttgttcaacttatgtgtattttaaggatgcattattatactgcactgtaatacagtgatgctgtaagacaagtgctggcacactttccctgaaaggccaaatagtaaatattttcagcttttggggttctctagtcactactacaacttctcagttcagtggtggtagcaaaatagctgcaaacaataggtaaatagatgtggcagtcttccaataaaactttatttacaaaaagaggaggtccctgctgtagtttgcgtagccctacactaaaatatatttattggtaagttctctcatgccttgattggttctgctttaaccagtactcttaagggtgggtttgttcttttgtggatttttgtatcttgtatcagttgactgttcttcatgtctctactttagctatcctccttcactcttaccttctgtatccagttctgcttagctttttcaaaaaattgtggttaaatatacataacataaaaattaccactttaaccatttttaagttccctagttcagtggcattaaatacttctgttagttttagaacccagatgaatatgctaatgtgtaaaataaaagtatgtaagttgtgagtgaataaagtttatgatctcactttagtgtagtgatttggaggacatctatttttagcaactcaaaaactgagaattaagcttggaagtaactttaaagaacatttaattccagctcattttacgtattatataagctgcccgcagatattaaatgacctaaacaagttcagacagtattaggacttgttttgattttttatttttcatctattagcagcaaactaattcaatttatagagttaatttttttagattgaggattataagagatcttacaaacccttctccccagctgctgctttcttctcttctgttacatactccctataggttgttgttattcatctctacctgaatactgccttcacaagggagttcactcccttagaaggcagcccattccgttttcatagctgtttcatttttccttatgtgtggctgaagtttttcattaacttctacctatatatgttagttattctgaacaagttgtctatagtggtatcagagtgattgcagtgacagaattcatatagtatctgtattattccatctagactgatatattaaaggatacttggctgaagaaatgagttattggaaaaactaacagagttggatgttatagacttgatctccccagatcctagtcttcccacccgagacagccagactgccttttgggtcaaacttctgaagttgtgcaaacgtatggacaaattaccatgagctgacaggggcagcctgaccatttcctcacataaagtggcttttgtgctttttactttggtgtgctattaaatgaatttgtgctataaagtccagtcaaaacagcagcactaattgaatataatctcatctttgctttgacaggatgcagttttatcaaggcagaccagtttagttctcttatgtgcattttggttagaaatttattattgtttaagaattacagatattattcctaaaatagagtgctaaccactgagagcatgaggtggcagagcaggaagagtctggaactgggaacaaaggacgagctttgtaggactaattctggtccagccacttaagatttatgtgacattggacattctgcttgacttggatactcttaaaacaaaattttttttaaatttaaaatttaaattaacattttctttctttttttagaaatggaatcttgctgtgtcacccaggctggagtacattggtgccattatagctcactgcagccttgaactcctgggctcaagcagtcctcttgcctcagtctcccaagtagctgggactgtaggtgcatgccaccacactcttctaggactctcttttatctgtacactggggacaattaacccaccttaatttacctcatagggttttaatatgatagaaagtgagagtccttttttagcagtaaagccttaaaagatgtaagtttttatttttaaattcaaccaatgattagccttggggcaaaatcacttggatgataactagaatttgtcaatttgttagacttaacattcattctcatatgctattttactatatggtcagccaccatcaattcaactttctatctaacaggtttattaatctgccagtttgctggtgttgatagacggttgttatcagtcagctcactataaattcaaaatgatacactgattttaaaacaaccctgaattatcatctgaaggatcattattcttaaatgaaggcataaagactagcaaatccttttgtattgtgttattattaggcctcattttttttaatcccacttgaaaagacagtttttcattgtctcataggtttaccatactatactatgtgttttaagagttatgcgaaaaaaaaattaagaaagacttgaccccagccttgaagctttatagtttggggaggttaggtaatatgaaatgttatttaacaaaataagaccatacagttggtttcaattattttcctctgttcattttgtagttcttagtaaggatttttttttttattttcttcctttcatttgatagttttttatttataagatttttgaactgatgaagatgagtttgccttgttgctcctaattacagattagaaactttcttgatttcccctaccgattaaggcaaaattaaatacttcatctgtacttgctaataaaatactttttgaaaaacacttctaccatagtatttgtctcatggctttagtcatatttctcctagaccacaaccttactttagggatctttattgctattgcttggcatataataagtggtacaagaaaaggacaaaacttagtgataccagagaatgctaaagagtatagagaatctggtgggggcaaagtcctgtgaaacaattgaaatgatcattgatagcttaagatttagggagaggaaggttttacacagaaggcatgataggttaaaaaaaaaaaagatgagatagcacttatttacaggtcattgagtctagtcaattacattggggaattataaggattaagttaggaataaatagtgtaaaactaatttatagagaactgcataccagactgaggagtatgaattccccctttggtatggggaaactaatttggtcagtggggtaagcaaagacagttcctcttttcgtgttgcagaagttggccctgcatttaaacttaatgtagattttggaaggtagtctcctcatttacctcagatatatatattcagaatatatatattctcaacactaaaaaattaagtattcatataatagcctataggtagaaacaggcaccttaattcacacattctgtgctctagctgttttttgttctttataaacactaagtgaatgcttactttcatccctttggtctgtttgccagaaatctttttctgttgccatgcttccagctcttacccatctttcaggtttagctcagattccacctcatctaaaaaaaagcttgaccttattagaccacagtgaagtagttttccaaagtctggatgtcatagatctattcttgtaattcctcattttatgtacatgtctcctacttcttctagactgtaaatgatgtctaacatgatgtcatacatggcatgggatttttcttctttttcattaagaaattattttttaagacagttaaaggctaaagtaggggaaggaatgggtaaaagaagaaacaatatgatggtaagatgatcttaaaggcagcatttagaaaggaaacgagagagacagtataagttggagaagaagtaaaaaggtgagaaataaggattttccttcagattatcttctgttatatcctatttgaattgctgaatatcataaccattttatgtttttctcttcaggggaatctggaggattcatttgggttattaataattgttgatgataagatttgaaagattgctataatcctatttgtcattaaaacttaaatacttctctcaaggatttcctagttactatatagttaccaaaagctatagtttttagcttttgaattttaatgaaaaatacattattgtgaagaattaccagaaagaattaatttagggagagaaaaggggggttaaggcatgaatgatcttgagtagtttctgccttgtggaaagtttgaggagaatatttgagtatgtttgttcgccagactgttgaagcgaattcattctcagatcaaaatctgaggtttcaaatgctgaaataggtagtaatttctttttatcagttttgacagcttattttgtgagcttattttttagggctggcttaaattctttcccctatagataaaaattaatttcttgtttaaaagcaagtaaacatttgtctttttttgctagctttggcaataacgtggtcattttaattttttttcactatgtgccataagctaaaaaagtgtatattttacgttatttacatagcttttaggcaaagcaaataccatttacttgtgtgataaatacatagaaagcttattctgcagttttttaaagtgacaaactaccactatctgaagtttatttgaccaaccatttgctgtaaataattggtatgttattatccactgattttttgacagctggttcagttttttctttgaatattaggtggtgagtattgttaagctgtgtttaatggtattaggtcaggataagacctagaaaacttgtttgtaccttataaaagtaataacaagctagtaagttagagagccagtataatgtagcagtagtttggattcagaaaaatccatctttgccattgtgtaaccttggaaagcttcttaacctctgagcctctgtttcctaatctgtgaaatggggacagaggtagtcatttttttgaacaaataacaaatttgttgagcttctaagtatgtaccagaaatcatactatgttttggataacagtagtacctctgtcataaaatccttggaggattaagttagaatgcatgtaaaacacttagcacagtgtgtagaatataagtaagtgatcaatatattgtagttattattactaaaacatcccaaatgtattttttttggagacagagtctcgctctgttacccactctggagtgtggtggcacgatcttggctcactgcaacctccacctcccgggttcaagctattctcctgcctcagcctcccaagtagccgggattcaggcgcctgccacaacgtctggctagtttttctatttttagtagagatggggtttcaccgtgttggccaggctgatctcgaactcctgacctcaagtgatcctcctgcctcagcctcccaaagtgctgggattataggcgtgagctgccacgcccagcttcaaatgcatttttagaagttgtctaagagcaaaaacagtttcagggaataattatgtatcaggatatgtcattaaatattttaatgataaagctatgtgtttttaaaaaacatttgtgtgacattcagtatttaaaagtttggttaatcatagcattttagtgttacactagtttagttaattaagatttttaatgcatacttattggtaacgtttttcttttaatagtctttatgatttgtagaatttgatgtatacagtcttgccttgtccttctgtatatgttaagagattggttccaggtcccccacagctcaagtctcttatgtaaaatggcataatatttgcctataacctacatatatcctcccatatattttaaatcatctctagattacttataatacctaataaaatgtaaatgctatgtaaataagtcttatactatcttttgaatgtacgttttttattttttttctgaatattttttatccgtgttggttgaatctatggatgcaaagggctgactaggatatgtaaacctagatcactttagaaataataactacaactactgtcagtggagtcttactctctgccagacatgttctaaagatattgaatgtattgagtcaactgatcctcaccacaaccctatgagggaggcactgttttattccctttctcagatgaggaaactggatcacagaaaggttaattaatttacccaaggttacacaactatagtattacagccaggattcaagaacttgtgcacttgatcttaactactgtgtagtagttaattgctatctctcccagattttataatcaggttaactatttgaataatatgtaaatatagtcatcatatttagaaaatccccaaaacaactgaacagagtgttgagtcttatcggaacgtttgctgaactctataatttgtattggatgattgtactggggtgtataggaaggcatcaccataacggatggctgggcattagcacaactagagttgatgatcagggtttcaaaacctgggattaaaaaatgtgttaatgatttttttctacttgtttttcagtgtggtttatagtggtactgatttgattttggtaaatcaacatttattatgactgtagtcttgagtatatgagctcagctgtagtctagtttagtggttatttaacaatggatttagttaaaaatccagtagaatgttcatacaaggattaattttgtgttctttctacctctttagtaaaataaaacagggtctgttacctagcttggaagatttgctgttctatacaattgctgaaggacaagagaaaatacctgttcataaatttattacagtaagtttttatatttttctatcttaacttaaaaaaatcaataataataaatatatacagtattattgaaatatagtcttaaaggtcgtctgacatgtagattctgactgacaatatttctcttattatgttttcaaatttttgtcatgctcatttcaaggtaatcagtgaaagaaaaagaaagaaacaatgagaaacttgtccagaaagtgggtaatagtgacactaagatgccatattcatgttcaagtgttgggtagaagtttttatatacaggaataaaatcttatagttggtataagcatatacattatttgcactatatatttacaaactcttatttttttaaaaacaggcactcaaatctacaggattgcgaacgtctgatcccaggttgaaagagtgtatggatatgttaagattaactcttcaaacaacatcagatggtgtcatgctagacaaagatctttttaaaaagtaaaagtttctgccaaacctttaatggtgatttgctatgctatacggtgattctgcttttaaaacaaaattgcatctttgaaggccactgcttcctgtgtaatggaaaaaggggatttataaacatcatttgtttgaagaacttggtacatattaggttctataatacaccgggctaagagtattctttctttaaatctgttctaagcaaatttagccaccgatgtttccagtttacagtacttggagattgcattcagtttgagtagagcacatcctttgtcctgtcattgcttatattgatccccaattcatctgcatgacttgcacgctttctcagcatggtctctagttcttttccacaaggtgatttaggtgacatcataaaatgagagggcttcagacagacctgtgttcctcacatttacatacctgcattgtctgctcctctcctctcttcagacatattgatacataggcttttggctattttcattttcttcaaaacagtaaagaactaaaggcaactttggcgattaaagccttgatttggttgaatgagaatttttactttgatgttcctgtatttgcatatatttattatttatcttcattaatgtgtttctattagtttgattacttaaagatttaatggacatgtgtgtaatggatcccaaagaatcaaatagtattttaaactactactatttaagtagaaactagtataaaactgtaaatactactataagacattggctttttccagacatggatccaaaaaatttctgcatctactttgaaagtttgttatgtatggttgtatttacttttgttttatcttcttttgggggttgggtgatttgttctagatgtctcctggagtatgaagtcatctgaaggtataagtatttaactgtggttctctgaagtttcctggcatgctgtgaagcactgctgacagcttgggtttcttatcttttcacgaggaggttcttgtttctgttaacttagctgaccttaaagtgtagactttaggtccgtgttgcagttggtattaggaattttgacttccagaacctgctttttaagagacagaaaaacatcatttctaaatttatttgtgtctttgcggtaaggattatttttcgtgttcatgaactgtctgcacaatattctgattaaagtgctttctgtgggcattattttgttgtatctgtgaatgaagttgttagagtaatggttggtagatctgttgataatcagtaggggaactgctttggaattttaagtggaagcagtattttacactttttttttttaagagacagagtctcattctgtcgcccaggctggagtgtagtgacatgatcttggctcactacaacctctgcctcccgggttcaagtgattctcccacctaaattcccaagtatctgggattaagggcgcctgccaccatgcctggcttttttgtatttttagtgagacggggtttcaccacgttgtccaggctggtctcgaactcctgacctcaggtaatccatccgcctcggcctcctaaagttacacggttttaatacttgaaaaaatatttatgttttgtaaacatgttgttatgtttaaatatgaaattaaaaacaatttaaatcctctgattattaagccagggaactgcaaacattaaattttctgcctgcaattaagagatagtaattattgttttaaacactaatccaatttttaaaaatctatgcttgtaatacaggcagtttccaacttgacaaatgttttatggtctatatgagcaaccagtagaaaagtacaagtctctagggcataattatttctctttattcttagaatgaggtggttcaaaacctccaactgttaaccttttaatagctttcagtcacctggaaaggtgattgcttcagagatgttcttttctctgttttcaaatataagaagttacctagttagtgttgccagaaataaacttctccctttcatgcagctagggaggagatgttaaaacatgggattcatttttccccagagaaataatttataaaggtgggtaggtttggttgaagcagtgtgttaatattttacctaaaatacattgtagattaatatttttagactttttcggtaatctgagaaaactattatgtgtgactttttttaacttgggaaaatacgttctaagcatactttttggagtaaaacctgttcgaaagttggagactgcctgtacccaggttgatagtcaattgtttttaatgctagtaaatcttaacactaatacaagtaaaaatatttgtgtggaaaactaatcctttctttattcgtgcatttttaactttataggtattaaaactttctttgtatgatcataattttttgatctttttgttttgcaagaaagtgaatggtagcctttcatttgtatgtttgattttcttaaaaatttcatatttattatgttattttacaaatgaaaaattatttgtgagaaatgttttgtcaatcattgtgcattagtttttagttataaacacttaaggaaagaaaatgattattcccggcttacagataagaaaactgaacaaaggacagagatatatataacttgctgaaaagcataagcacctcctcagagttcattttatatgacttctcatttcctagttagactcatggtatctatattaaaataactcccaagaaaaaccttactgtttggaatggtgatcggtatgcagttagatactctcctgagaggcaaaattggctttgtcagcctgttaatattaccagtgaaggctgttggaacagctttaccagcaccttctgctagagcagaacatttgtaaagtttcactgagtgtataattttgttaattataaatcctttttttttgagatggagttttgctcttgttgcccaggctggagtgcaatggcgcgatcttggctcaccgcaacctccgcctcccaggttcaagcaattctcctgcctcagcctcccgactagctgggattacaggcatgcaccaccacgcccggctaattttgtatttttagtagagacagggtttctccatgttgaggctggtctcgaactcctgacctcaggtgatctgcctgcctcagcctcccaaagtgctgggattataggcgtgagccaccgtgcctggctaattataaattcttttaaaggtactgattaaaatagttaaatggtagtaggttaataatttaaatttgttcagcagctctcatttttgcatttataacttcttgaaaaatgaggaagtgcatttgatttgttgtagatataaatactggtttaagatcaggaattctatttttctttcctctgagaaaggtgttctttgatgtacatctcttgcaactctgatacttggaagttggattttagaagctatttgaaacattaaaaatattaaaataatggtaatacttttgagattaatattgaaactatctgaaaatgattgcttattgaagtaaatatttcttagctctggggtgtcaatactatataagttatggaaattaggactgtaatttttttaatgttgtaatagggagatccttatgactgaaacaatagtcatttctattaggattttatttttaaactgttaattttatattgaacaaatgagtatatattattctgaattcttattaatagttaaactgtgaaacctggcttttagctttaatttggtttcatctagaacaacttgaattaaaatattgacatttaaaaatttctcatttattacagactaaacaagaaatactgagagtatcttactcttaagatttattatcgttggtattatggcttaacaccgtgtttagcaagtcttcctttgttaattaaatattaattaaatattctattactgcattacagagacttaagaagctcagaatatacaattggctgtaatccatttgcaaaacgttttaaaggctacgttaatatactgattttctggcttaaattctttttagcaaaaagcagaatacagttcaaattattagatttcagaatatcatgctctcccatccacttggtttactatatttttaaaatacttttttaacagtgaaacatttttattctgcattatatttacatatcttacattaaatagcatattgtaatataacatttttggtgactcaaataatataaaattaattattacactacttcatatgaaattttatttcaaattagagattatttttacaagcatatcaagacatttcatttaagacataaattaatctgactaaacaaagttgatataattaaggaaaatatgttataatgcaaaatgtttaatttttgaatgaaatgctagtaatagttatataagaactaagagatgtatttctgagattacttggtaaataaacaagatctcaaccttggcagtctgaattttgttaaccagatgtcgtcatgctgaatgttaccaactctgattgagtaagaagcttgtttcagatggtcttaatacttaaacctggtggaacgccttgtcttaatttgtgacacaattttaggcacatccagattaatctcttacacgttcaacagcttacaagcaactacttgaaagactgctagaaggaaagataatgtagaaagcataatttatagaatttagttgtataaaatgataaatttatctattatttaaatagtgtcctaattattactgttattaccaagttctgatatttgaaatgtacccagtttattaattatctttttacattctacagatgtgttcagagcaacattgttttgttgacacaagcatttagaagaaagtttgtgattcctgactttatgtcttttacctcacacattgatgagttatatgaaagtgctaaaaagcagtctggaggaaaggtaatgcttttgatgtacatattttcataaccgaatcacttaataaattcagcttaatttgaggtctagagagtaaattgtgtagttgtgttttgctaaagaaaacactttagcttcgcttaagaaatttaagtgaagccactggatttagtgtttttacggtattttaaatatttaactttgttattctggttaaagagaaatctaagggtaagaattttttattttcagatgatggtgatggattttaaatttttaagttaaaaaatcttattcagaatttctgcagatctgatatccttcagtattaaacgaaatgtttctagtttttaaaatcctgtaaataatactaggaactatttgattttcatatagaaagttttcattttcttttgttttaactttgggtagctttagtataatccagttggcccttgaacaaagcaggggttagggatgccaaacccacacgcagtcaaaaatctgagtataacttttgactcccttaaaacttaactacttataactactgttataagcgttaccgataacataaatagtctattaacacattttgtatatttattatataccgaattcttacaataaagaggataaaaaatggtattgagatcataaggaaaatatatttactgtttattaagtggaagtggatcaccatgaaagttttcattgtcatcatcttcatgtttagactgaagaagaagaggagggattggtcttgtgtcttgggggtggcggaagcagaaaagaatctgcatataattgcactgtttgaagtttaaatccatgttcaagattcaagtgtataacaacttcagtgtaaatacttactacttacttttaaatacttgattcctaatgttttagtgaaaccctactagcacccatgaccctgattaaataaatttacttttttcctgcttaaaaaaaaaaaaagttcaagttcctctgctagactctcctgctaaacatgagaaagaaagaatgcattggaaaataagaaataatagagactgagaaaagtcactttagatctcataattctcaagtctgttttgcctttagttttcatgagcattgttacagaagatagactatgaagccactgagtgttgtagaataactagtcattggtagaaggtaaaatgagataagaaatttgttggtggaagaaaatacattatttgtcaatattatatctattcatttctttccaatcttttggataggttgcagattatattcctcaactggccaaattcagtcccgatttgtggggtgtgtctgtttgtacagtagatggacagaggtaagtttatttcaaattcatgaaaaccaactctaagccttaacttttgtataatggtgagaatgacatggagaagatcatcttttataatggaaattagtcctaacaggatataatttcaaaaggtaaataaatttaaattttaatgtaatttttaaaaactcaaacagtaacattatattaagttttatgagacatctattttattcacagttgtagtcttgttttttgagtattattcaaatacctgcagttaccaatttgtttcagaaaagcaggcttgtcaaaacatgacactattctctaatgaactgactactaataaaattagtccctatttctcaacttaacattggtaacccatctgtcgttgtctttgttccttgtgttcctgataaaattagcatgagaattaagacagtgcaacataacgtatcccaaagttaaaagtcagttgcaaaacatgtaggatttcatgaagtccatgaaagcagcatttgggaattgcttacattgcaggcacagctgctgacagatgaggaacttgcagaattataaaaaggatagtgatgtgagggcgctttagaaagaatgatttgatttaaaaatcaaagaattaagagaggcccttggaaaatggtaaagttctagaatattttttcaagaatgaccgtgttcattgtgctgggaattagacataaagattgttatcatcttataatttggttttattagaaaattacgccaaagagaaaaatcaatattcttttttcactcatttttaaagacttagctcagagatatattcctttgttttttgtttttttattaaagtatttctgttttatcaaaatagaacttacataagatgtacaacttgtaagtgaacacagcttgaaaagtttatatcagagttgtaattttacctaaatttcgttaaaactactaaaagccgtttaacctagtaattttagattttacttttcaagataatgttgcaattaaaaaccttttttccttttatgaaaatttgatcttttatgttgcccaggttagttttgaactcttggcctcaagtgatcttcctgccttggcatcccaaagtgctgggattataggcatgagcccctgccccccagccaaaaatctgtgactcgtaaggaccttcattttaggtgattttaatttttttttactaattatcctcaagtacttacagtaaaaaatatatgggttagcccattcattttgaaagtaaggaatctgaggaccatagttgacatgatattggcaaaggtgaaatgaacacctaggtctcttaacttctagtctattttttctttcattattatatgcctttatcctcatttgggtcagtaaaatgtactgagcagtcaccatgtgttgaattaaatgttgtgtgctatgaagggacacaatgaaatgaaaaggcatggtgactttatcccttgaagcaaattccggtagggaatggtattcctgtttttgcattttaggaaataatttatcaagtaatggaagtctttgaatttgaagaaaattattatcatgtaatattgaatatgatttttctcttcttaaacattctctatgtctcttagtttttttatctagagaattcagaaagttgacttcagaactagaacatatgtatttttaaatccaaaggtagtaagacaagctcttaatcattttttagaatgattgtcaagtttgaagtaacaatcttatatagtataactatatagtttaagattatagttacacatgaataaatttgataggaaaaaaatatagtgcccagtttcattatgaatgactttcactatgaatgaatgctttgtgatgtgttgggacattgttcagggaacctgggaggtatcagtaagtaaatcaaagatctctgcctttgtgaagcttacattataattgggttggccagaactttttcattcccaaatcttttctctacttcatgtacttctcagtttggtggtaatataaagctttctttttgctctgttatttatctgcatggtaatgatgactgcctactgaacttagtgccagctctgtcatgtttataaaactggatgcttttttttttaatggggcccaggattgtgagtggatgtggcttgcaatatgaggcatttgtagacagggtcccagagaatagtattgaatctaaactgagttctgtttaactttttaaccatggtttagtcacagcttacagctctgagttgaaaaaaaggtgaataatttctaaaagggctagtttattttatgtgattgaatacacgtgggagtaaggaggagcatgctcttactctcttgccctcagaggaaaatttccacattacatatttattatctactttaaaaccattattctgttacgtgaatactttcatgcttttgctttttttcacagtatttctcttaaaataaacataggtcaattctgtatccatggggtctgcacccatggattccaccaaccacagatcgaaaatatttgagccaaaaaagatggatagttgtggctgtagtaaacatgtacagacattttttccttgtcattattccctaaataatacagtacacctatttatatggcatttacattgtatttggtattataagtaatctagagatgatttaaaacacatgggaagatgtgtgtaggttatatgcaaatgctatatcattgtatataagggacttgagtgtccatggagtttggtatcacagggattcctggaatccacctcccacagatatcaaaggatgactgtacttaaatttattctgtaattttgacataaacttgtggttgaattatgggaaaatttttgttggaattgttaacatgtaaaaagaataattccaactatgcagttacatttttttcccagttgatgttattttttaaaaatctccttttaaataggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatggtaagaattacataaacattggttgaaaaaagaaatgtctcattttcctatgtaaatctaagtcgttttaaacattttttgattaaaattaaaagtatttgtcatgtgatttctatataatccattgagagagtttcatcacctacttttaaaaatgattattttaggcatctcataccactgggaagtgggctagggagaacatgaacttctctcttcataaccacctttagggaaatatagcgaaatctcaaaatacatgagatttgctttaaaataatttagttaaggcagctgggagtgctgggtatgattattactatatgttggtaattattgcagctaaatgataggtgcatgggtgtttgtatattattctatctattatattgtatatagtagttgaaagttttattgtggccctggttgagatagtgaggattattatttttcagtgagtgtttttactttttatccttataacattaaaaaatttgaaagaaatgctttgtgtttaatgcttggttaacaaatctttttacaggaattcaaaagaaaaggggaggacaaaagtagttagtttgatctgatagagattttaagtctaaacatcatttagctgagtgcaaactaagttaaactagtcccatggtttggtttctgttttttaatcttctaagcatatgctgtgtttctgattgatgagttaagatatagaattgaagaaagtgagagcgaagtttgtagtaatggctgtgagagatacacttttgtactttttttttctgctgtataaaaaatgaaatgtgccttatactcattattttattagtttgtaagatgaagtcataagactggtattttcttatgcttctcatcctatttattttgagagcagttacattttctttcccattttaccgtaacctttttattctgatgctacgtttggttttatggacattactgtaaattaacaacttcaataaggacatcatatgcagaagcactttatttactaagctcattgacatctagatttaatattgaaagaattaatactgttattctaaaaataccaaatattttaaaagaaaaatttaatacttttccatgaacagcaaaggagaatagacatgtctagtgaattgatggatttcgagggagatatttaagaaaaaacaaatatagtaatttgaatgtttagaggatttcagaaacaaaaaaacaaaatgggcttggagcaaatgaaattaacagtataagtaatgaatttttttgccatatatatttatggttttaggaatcatgaattattgatactgtattctatataagaaaaaatgacaaatcagagatttagaattgtttataataagaataaaacataaagtttaacaagagattttgcctcgatattcatagacgttttctaagcctgagccaacaccctgagtcttgaaagtaacagtaaatacaggcttcactatattacaccttcctgaattctgattagagcctgtgctcttgagtcctgatttagtttagcccagcaaaaacaatttgaagatctcgttcatatttaaaattgcaagggtagatttttggtgaaaccatacactttttgtgtgtgtatgtatatatgtgtgtatctaaaataataaatttttaaaaaataaatatattactgttacaccagctttataagattgtgatgatttattaagactaatagggatatggtaaatagagaaattgtagtagttttttttttttttttgagatggtgtctggctctgtcccccaggctggagtgcagtggcatgatctcggcttactgcaagctctgccccccgggttcacgccattcccctgcctcagcgagtagctgggactacaggcacccgccagcacgcctggctaattttttgtatttttagtagagatggggtttcactgtgttagccaggatggtctcgatctcctgacctcgtgatctgcccgcctcggcctcccaaagtgctgggattacaggcttgagccactgcacccggcagtagtttttaataacagtagttttttttttttttttgagacggagtttcactcttgttgcccaggctggagtgcaatggcgcaatctcggctcggcgcaatctcggctcaccgcaacctccgcctcccgggttcaagcgattctcctgcctcagcctcccgagtagctgggattacaggcatgtgccaccaccctggctaattttgtattttcagtagagacggggtttctccatgttggtcaggctggtcgcgaactcccaacctcaggtgatctgcctgcctcagcctcccaaagtgctgggattacaggcgtgagccaccacacctggcaataacagtagttttaaaatgtttgcaacatagaaagttttggtaggaggtggctgatattttttatcattattaataagtgagcaaacaagttactttatggagatgtcagttttgcaaactaccatctcccagggaagtctttttctaccttgtagtgatcgggttaatcaacaaattatttatatagctttccttgtctgtattgttaacagctctggagggtacatgggccttgcttcttggaataacttttctgactacaggatacagaaggcaattacatatttctaatacataatgggagaagacatacttaagcattgaatactgttagttgtattatcttacaagtatgtaattgacaggtgccaaaatgtatgtgctgattatatgtgtggaggattgagaaaaaagaggagttgagttaatttacatgaggatgacaggactgaattgataggatgaattgtggatggttgggaagaatgtgagagggcactgcacattttttccaaccatcctcaatgggcactgcacattcttcgtaaccatatatatcccaaccagatggagaatattttctctatatctagagaatatattgtaaatgtgtgtaatgtcagataattgagtttccttaactccagtttttatttggcactgtaaaattccaatataataccgaaaatataaatatccaaattaaattggaaatcctttttaatatttttcgttctttagtatatgtattagcaaactttgcctcagcctcacctgtgaacaaaacccttgtaaggttcatatgcttagcagcttgaaaagcttcttttgatataatatgaaagaatgctgtgtattttattgcctttggggaaaataaatacttgttaaaattgatctttttttgcattatagtttaaagcatgttcataaatttcagatgtcacccatgtccattttgtcagtataacacgctctgatatttcgttactttaaatgatagcctttattagtgttgtaggttatttctgccattcaaaacttttttaaattaaaaattctaaattaaacccatcaactccatcttaccttaagacagagcagggaagcaagaaaatttcacggtcataggtcttaggccgaggttttatactgcagttaggctggtggtgtgttacattctctctggcgggtttccggatgttcagatgtctggcttttgagccaaaggcagaatgagcaattacatacatctgaaaattgggctgtcatgccttaaaatgatttagtgttctttaagacatcttgagtgtagtatatgtagcatttgcagagtatttatcatttggaaaatatttaatactcacatttatgtgataccatttggagtacatagattagcagtcttctaggactgtagagtctaagcctgataatgtcaaaagctctgaaatgacagataataaacatccatacaaataaaagtataaactaatttatactaatttaaactaatttaaactaatttgggataggcaaatcttgattgtaataatcagatataacacaaagattttattttaacttttgaaacttggcattatgaatacacccaaaatgtaggatatttttctttttatttatttatttttaattgacagataaaaattgtgtatatggtatacaacatagtgatttgaaatatatatgcattgtggaatggctaaatcaaagtaacatacattacttcatatatttatttgtaatgagaagacaaagtatgctttcttaacaattttcaagtacatataatacttgttattaattatatcatgttataaaatagatctcttgaacttattccccctgtgtaactgaaattatgtgtcctttgaccaacatctggcaatcccttctcccccctcccccacttctggtaaccaccaggtagataaattaagatgttgaggttcgcttgtaaatagatgttttcactgtccccaagattttatttttggtgcttgtgtcatgcagtgaatgagaatataatcagttgagttttgaaattcttatttattgtaagaattaggagaagaaataggagtttggattaatgtaaagttttaagtaactttaaaattatataagaaatacaaatatacctttattgtcaggaaatacagaaagcctaaaaatatcccctataggctgtgcatggtggctcatgcctataatcccagcactttgggaggccaaggcgggaggattgcttgagtcctggagtttgagtccagcctgggcaacatagggagatcctgtctctacagaaaataaaacattagccaggtgtggtatgtgcctgtggtcccagcttctttggagtctgaggctggaggatcacttaagcctgggaggtcaaggcttcagtgagccatgattgtgccactgcacttcagcctgggcgacagtctgaaactttggctcttaaaaaaaaaatcccttataattttattattctatgtaaatcacttgtttgtgttttgaaatccttctgtgtatgtgcttgtatataaagataaaaataaagcactaagaaaaaagcaaaattgagtacgttagctgtgctttttccaaggtcatttttagtatagtaatattactcaagtgtttaagtatttgaaataatggtattgcttttatattttacagataaaccacataatcctatggtaaatgctggagcaattgttgtgacttcactaataaaggtaaaatgttgatgtttcattttaacctagtaaaactttttttttttaacagctaaggcataaagatgaatctgggattatttatgtagaattatgaaaaattttctcttggtgttaagaaatttgtcttatggtatagtgttaggatctttatttcaaaataaatgatgtagtcatttcaaggcaaaattaaaacagatgactcattgtaaattccaacagtcatttactcttgacttgaagatctggaaaatatttaaagtctgctgaagaaaggcatagaggctttttttttttttttaaagttttgatatttttcctttcgtttccttttggttcttccagaatgaacagttataaatagaattaaaggcattttactgtatatttgttattagtatatgtgggaacaaatgttctggtacttaagacaaagtacatttaccctcaaatattctcaagtctttgatactctcatgagctgaaatcacagtttttattggaacttgtttcatttggttttacttaaatcatgccataattaaaataaataaggcttattccaattatggagttatattttcttatgctttgaaatttgcattgtaagggttttttttttttttagtgtttggtttgcgttaataattggaagatctagtattttaaaataagtatttgaaaatggttcctgtgtgatagatttttaaatctaccacacgattttagatgtttcagatttttaatttctaattataaattttatttatatttaaataaattttatttatgtttggaacatttgtatacttctttggtaaatctgtgcctatctattccaagttagaggaaagcataactacatggccttgtaaatgcattactgtggataaggtaccctggttacatgaaggatatttgagtataaatgatacccttggcccagttcacaaaatttcatctaacttgtatactagaaagcctttcttaacttttaagagttttatatctgtgagaaaaagcttttaaaatagaaggctggtatcttaagaatctatatgtttacttgttacttcaaggcaaattctttgaaagtattggcccatttaattcttataactctaatgaagtagatgttatagccaagtgtttttaaaatgtaactaattgtaataggatatggagaaagctgtcagtttgagctgaaagaaacttgaaaatgcgattatttgcaaggcacagtcctagctttaggtagcttactttgtagtgtgggatatgcaaaagtaaatgggtccttataagaaaattcaataaatgctgtgatgagagaaaagcctcattaataattgcttagatttgaacaagtaacttaaagtagaaataaggaaacacatactataatgtatgtgttaatgcttgatgacaaaaacaccaaaagtgtttcttcccagaaaaatatccacataccataattttacataaactttcaggtgttcactactcttcgaggctgatccatgggtcctagtttaagaacttttaaactgaagagagattaacatacactacgcatagtctcaaaagggcttatgtaaataattaatagaagacttccttcactgcacacagttaaaaatctttcatttaatgattcatgggtttaacagactacaccgaaatgctgcatgtgggaattgcatgtctggttatcatatcacactatcatttcattagtttcacttgccatgtttagtcatgagtcataaactatacattgagctgcattttagtatgagtgattataaacaaagttaaaagatacatacaacataagtgtggttcagtgttcaacagtgcaaaaatttaattgagtcatcttgtacctacaaatttgatcagtgattttcataaaaatttaaatttacaggcaaagttggaaatgaggcttcaggatatggtttatatttaaggtcactttctcctgagtttttgttttgtttttagcatgtgtttcacaagtgctttttttttttttttttttttatgaagttcatacaaatcttggagagcaaagcctgatataaccctatgtaaaattgaatgccccagaatatgtaatatttttcttaggatcttttagggaaaggattaaattcatataaatatctataatgtgatctctgcaaattgtatgatcacataatatttataaattggtattggtttgaaatttaggtaataaaaccatagccaaaaggccttaaaagttgtcaaacccagttctcttactttatataacggaggaaactgagaacctggcaaggttgtaacagcagtagaattggacttgaactaaatctcctgatactcaatgtgctgttcattacaattcactctgccatatttaacgtaggtgtttgccatttctcttgatgacatctttaattttagttagcatagttatattgccccaaatgcagaagtactatttccttaatttgaactggttcaaacgataacaatttattggtttaaaagttgtatctcatttgatagcaagtgttacgtagtcattcttcggacattagtcagtaaagaaacaggcccttttccaagatgcttgcatctgagtacccaaagccacggatatttcaccatggctactagaggtgaattctgtttttagctcttttaattgatgaccttaaggctatttgtgattttttttttctttcaaaattcaggaatttatcatggtgccattaaaatcattttcttcatgttaatccccccaccccaaaattaagtagagtctttagtaagactcttgatttcataattttgtagtattgatattttttccttgtaggattggtggtgatcctcaggaaatgggggaagaggcagagcaaatgttcaaaaggattagcagattgtggaaaaaaggagaatttggacagaaggagcctgttgcataaattcttaactactaagcttataggaaaactccaatatttaaaattttaaacaaagctatataggtaaatacctttttaaaaacaaatgtaattttatacttaaaatgcacataatttttaaaaatcataagggtattatacttcctctctttttctctgtggtagctactaactttaaaggaatactttttgttgtaatctgttttatttgggattgtgataatgtgtgattgcttgattaaaaggaaagaacaaaaataaatttgaaaggaacagttatttttatatgatgtagcagtatccttacgtatttgttttcttttcactggtaaaaatttcacgtagttttagtttaaaagttaagatctggtgataacttaagggttaggataggaaaatgaggacaacatactgcaaaataattgccacacttaatgctttttcatgttagaaatagtaaaagttacactgtcttctatgtttttacctctcagagttttttgttttttgttttttagagacaaggtctctctctgttgcccagtctaagtgcagtggtacagtcataacccactgcagcctcaaactcctgtgctcaagtgatcctgccacctcagactccagagtagctgagaccacaggcacaggctaccatgcagggctaattctttataaagctagggtcttgccatattgcccaggctggtcccaaactcctggcctaaagtgatcctccaagtttggcctcccaaaatgctgggatgacaggcattagccactctacttggcatgcctcattctagtggtagtttccagtttttgtcatttaaagaagttcaattttctttttaatcaaaagtatttttgaattttaaaaattagggttttttttctttctctttaaacaatttgtaatcatactcattgaaaatcaagacaagcttagttaatgtatatgtgatgttcagtttggttatgttagcaataacctgttaggcatgcttataagacaggtttttaaagtagtttgtgactctcagagtaatgcatgatgccttggacttgcaacattcagaagacaggattatattggtttatttacttcttgtttatatcagtttatgctttagttttttttttttaatgaaaggtagagcatttattgtcaactgaaaattgttctgttactttatttttagggttgatctatgaaaatactagatctagaaaaacattcttttttacctggagtgtcttattttttattttcctaatactctttagctttaaaccattttctatcataagactaaattaagagtatttcacaaaatcgtttttagttacctctttttgcctttttcctctatgatctctaatttttaattggcttgcacctccatactttatgaatggaatcaagtgcgatacttacaaaataactctgatgcattgattttaaatgagccattttattattaaatttattggcagatgtccttgttaacagtgtttttcacctgttataaagtataatacatgaatcaattcataaatatgttgtaaaaactataaaacattgcaatatagttacattaattttttaatagataatgttaaaactcagtgcctctatcaaattttcattcatacagtattcttcaaaggaatgtaaattctgtaacttgacaggcatatttacagaaaaattttataatttactttttttttttgagacgaagtcttgcttgtcgcccaggctggagtgcagttctgcctcccaggttcacgccattctcctgcctcagcctcccgagtagctgggactacaggcgcccgccactgtgcctggctaattttttttttttttttgtatttttagtagagacagggtttcaccatgttagccaggatggtctccatctcctgacctcatgatctgcctccctcagcctcccaaagtgctgggattacagacgtgagccaccgcgcccggcctaaatttgtataattttctggtaccagaatctgattacccttttcaaacaacccatatgggtttgttttttaaaaatcatttggtgagtggattagaaattttgataagtatatttcttccaatttggtttattttaaaaatgtttctactgtatttactacaaatgattatagctttttcaaaaataatacagtatctaataatgcttgtacagtgatcttcaaactgggataaatatatctttggattccatacttggaattctttccaaggaataaaggggcattgacagttttaagataagtcagtttcaaaatctgtttctagatgcgccttttaaaaaattaatctgcctttagtccaggtgtcctcctattttccaaaagaaagacatagtctcatgtctttcaaattttagtacagtgcactgcttcacattgtaaaaacctcagcccaccagcaaaagaggacattttgaaatattagagtcagtgttattaagggtgtgaaccattgtaataactggtaataagtcctgttatatactaggttgtttccagttctttggtttcagcaaaatcgaaagggaatcttaagttgtcagtcaataggagcattagcataatttttgaggctagagtactgtatgacttttggcatgtaatgagctggaggcatataaagaactgagtaacattgctataataaaacttttaaaatttcaatctacttgtctattataagcaattcacacctctgtaaaaattaaaaatcggaagagaattagtcctgagttcattctagcaatagaagatatccactgatatatgaactaaaaatcaattactgtttcaaatgggaaagaaaaatactcaaaaggaaaatcttacaaattagtatgggaaattattagcaaataaatatttttcctttaattttttattgtgaaaaaattcaaacatacaaaatacacgagtatgaccagctctcatttatgcatgcctagcttttatttttgttaacatctgtttctccacccagctcaccccactactccataatgataaagataatggattttttatcatttttagttttgattttgcattgggggtggtttactctcttttgtatatgtaggcatgtgcttttcctaagagctttgcaaataaactttttactgtaactttttcagaattaatatgacatgttaatgattattagatctcatctatccttggggtacatggagtcgttccaagagatacacaagcagatatagtttattgacttaagttaaatgccatttccagggtaaataatatgaacaaacaataatcaaatgcctttacatttaaatgaggaagtatgggggagaaacattctttagtcaatgcaattattcaatacaggcatacctcagagatattgcagatcacctaactaaagtgaagattgcaaaaaagcaagtcataccaattttttcgttaaccaatgcatacggaagttgtgtttatactatagtaagtgtgcagtagtattgcatctaaaaaaaaacagtgtgaataccttaattaaaaaatattttataggtaagaaatgctaaggatcatcggagccttcagtgagttctaatctttttgctggtggaaggtcttgtcttgatgttgatgactactgactgataatggtggtggttgctgaagattgcggtggctgtggcaatttcttaaaataagacgacaatgaagttgccacatcaattgactcttacttttatgaaagatttctctgtagcatgcaatgctgtttgacagcattttactcagagtagaacttctttaaaaattggagtcagtcctccaaaactctgccactgctttatgaactaagtttatggaatgttctaactcctttgttgtatttcaatgatcttcagagcatctttaccagaagtagttttcatctcaagaaaccactttcttagttcactcatgagaagcaactcctcatccgttgaagttttatcatgagattgcagcaattcagtcatatcttcaggctctacttttaattctagttctcttgatatttccatcacatgtgtggttacttcctccacttggacccctcagtcatccatgaggattggaatcaacttcatttgaactcctgttaatattgatatttcgaccacctatgatcatgaaagttcttaatgatatttagaatggtgaatcttttccagaagattttcagtttactttgcccagatccattagacaaatcactattattgcagctattgccttatgaactgtgtttcttaaatagtaagacttgaaagttgaagttactccttgatccatgggctgcagaatggatgttgtgttagcaggcatgaaaacaacattatgctccttgtacgtctctatcagaactcttgggtgactggtgtgttgttagtgaacagtagtattttgaaagaaatattttttttttttctggctggtcatggtggctcacacctgtaatctcagcactttgggaggttgaggtaagaggattgcttgagcccaggagttcaaaccagtctgctcaatatagtgagactcccatctctattaaaaaacaaaatctttttgagccgtaggtttcaacagtgggcttaaaatattcaataaacaaggttgtaaaccgatgtggtcttatctaggcttgttataagcccaggcagggtagatttagcataattcttaaggactctagggtttttggaatgatgaatgagcattggcttcaacttaaggttacaagctgccttagcccctaacaggtcaggctgtcctctgaaaccagacattaacttcttttggctatgaaagtcatagatgtcatctttcaataaaaggctgtttcatctacatttaaaacctgttgttagtgtagtcaccttcatcactgaagttaggtagatcttctgggtaacttgctgcaccttctgcatcagcccttgccattgtttcaccttgtacttttatgttatggagacggcttctttccttaaacctcatgaatcaacctctgctagctgcaaacccttttccgcagcttcctcaattccctcagcctttatagaattgaagagagttagggccttgttctgaattaggccttggcctaagggaaattgtagctagtttcattttttttttatctagaccacacaaattttctccatgttaccggttatgctgttttgttttccatcatttgcgtgttcattgaagttccatttttaatttccttcaagaacttcaagaaatgcaaaggaaacttcatttacaacttggctaactttggtgcaagaggctcaacttttggtctgttttggctttcaacatgcctttcttactaagcttaataatcattctagctttttaaaagtgagagatatacaactcttcctttcacttgaacatttagaggccatagtagggttattaattggcctgttttcaatattgttgtgtctcagggaataggggtccccaaggagagggagagagatgggaatgaacaatcagtgaagcagtcagaacatatacaacatttataggttaagttggccatcttatatggacatggcttgtggtaccccaaaacaagtgtaatagagcaaaaatgactgatcacagatccccataagacatctaataattatcaaaatgtgacacagagacacaaaatgagcacatactgttggaaaaatggtgccagtagacttacttgatgcagggttatcacaaaccttcaatttcttaaaaaatgcactatctgtgaaacacaatgaagtgaagctcaataaaatgaggtgtgcctgtattttcttttgctctatttacataatctgtctagagaatgttgagtacccaaaatgttatactgtataatgctagacattggtaaataccagttgtttcttaaaaacaacgttaagagcaaaacttaattgtgctttaatttagtaagtcacaaaatagaccaattatgtgaccatagtctagagttgaatggtttttatttttgtgtattaaacatgacagcccaatgaagaaaacttgtaagagttttatagggtacagtttaggtcacagaatgaagttcaacataacttgtttattttacattgattgtttaaccagtaattatccatatgacatcccaatgcaaatgctgacatccatttccaaaagagttgtttttttgtgctttttctaaggttacaaaggtttttgtggtttaaatgttgttacatattttacagcattaggatctatggaatattttgacaactgcaacagttcaatgaagttggtaatttcttcttttaattatttttcattgaacagctttggagttacatttctacattttgatttctggtatattataaggaaagaaaaaattatgtcaaaggatactttagagaaaatacatagatagtgattacaatatggctgtaattaaattatccttaatcttgttgaagttttgttagtgcctaattttgatgaaatagtatggtgttccttccagctactgattgtatatatgtgattgcacatctttcttaaaaaagtggatttgtaggttttcacatattgtcagccacactctaatcctcttgtaaagaatgaacctggctttattcaattaaataattctctggtacaggttttcctcccgtaatattttaaagtacaatgttttgggttttttgagggtaaagtaaaagaaaatatgttttaaaaactttagttgtcaaattattttattttaagcctattttagaaattagagatgtattgtttcttttgggtgcatatcaccaattaatacgtttgatttcagatctacaacttactgctttgtaaacttcgccgaggtaaaatgaaaccatttggctacttgaactgatctacattacatagatttttcctattgacatttgcagtagataacatgtcagaaatgaaagtgatgaaacaatacatcttccatattctgaattggcataatgctaaatacaacagaagctaattttttagagactgtgaaatataattttttttagttcaagtatattatagcaagtgagagctattaagaatagagctttctctgcagtagtaaaatgcaaccagaatgtttgcatatactggaattaaaagattagttttgcaacataattcatttttctaactctgatattagtttaaggatttaataaaatataagtagattgttcttaattgaaatattttatatatacttaattcttttcgaagggtgaaactttattttaagtttttttaaatataagattaaataaataacacattttagcaaattatgtgctgtcatgaaagataagggaattcatggtaacttgtatttaaaattctgtaactttgggttgggtaaagatatacttaaaataaagcattccctttgtaattctaatgcattctcaacatatgggtattaaataacatgaaaaaaagtttatataaatgttaaattactttagaactatttcctagatttaaaaatactaatgcagtatattataatagtagctttgaaattttgatattggcttgaaacttaactgtagtggtacctatattaacgtatttatgtctcttatttttttgcagcaaggagtaaataatgctgaaaaatttgactatgtaagtgcaacatgtcattcagttttcatgccacattctctatatatttgttttttgattactaatattccctacttttggtttctaggtcatgcagtttttgaataagatggctggtaatgaatatgttggattcagtaatgcaacgtgagtgttttaaatactgttttgttacgtaaaaacacacaactgtatttagaattgatccactctcttttcattggagggaaatgaatgatttctaaattacctgacagaaacacttaaaaatactttaaatagttttgacaaatttcttacaggtaatcatacaatcagaagagaccccaagtttatctcaaattactggtgcttattcagttttatctttgcttgtaatacctgtcttacctctcttctatttctgttccaggctatctggatttttaccccaattttttattttaaaatttgtgagtctatagaaaagttgaaaaaataaatatctggaatcttttacttatattttctaatattttgtcttacttgctttttctcaatctctgtctctttagatagataaaaaatatgtatgtatacctctaaacacaaatatgtaaatatatatgtacatagattttttttccctaaaccatttcaaattaagttgcaggcatcatacttcacccttagataagaaagcacatacagtctaagaataaggacattctcctacataaccacaataccattaacacatgtaagaacgttaacgttaattttaaaatatcatgacattaatcaatatgtaaatgtccccatctcttccccaaatgtcttttacaacttttattattattttttagattcaggaacaaatcaaggttcttacattgtatttattacgatgtctgttttgtctctttacttagaacagtccccgtgcccttgctttcacaaattttattaaatggcttttatttttaaagagtgcaggctgcttgttttatagaccaggggttgctgactttttctttgaaggaccagacagtaaatattttaagcttgtgtaccatacggtctgtgttgtaacttctcagttctgccgtttagtagaaaacagccatagacaatatgagggtgtgttataaaaaactttataaaaacaggcagcaggccgtatagtggatgtttcccattttgtatttgtctggttccttgtcattagaaacactataatgttaaacgttatcgtaatattattatgttaaacagttttagcatgtatactactattttattcttattttgcacttcctgcttcgcatttcaggggtaaacattttcaggttgcatggcttcccaacattaattcatcagcttaagtatcttttccaggaagtattccatgaatctcaacttgcctcttttctgtgctcttctgttaccatattttatcaaacttattacatgtctctctttgccccataaccaccattagactctgccctccttaagacctagatggaatgttgtgtcttccagttcatttctgtatccctgttatctggcagataataggcacttgagatagtgttgaagaactatgtgtcagtcactgtgataactgctgactagttagtcatttatctaaactatgttgatgttttttttaaaagtacggcaaattgataagaatttgaaatgttaaaatgtgcaattagaaggggctgtccacctcagtgatataaagaacattaaccacagttcctctaatatcagcagcccttttagacttgtagggcaattctcaaatataccgcaaattaaatctgtctaaatcaaaactcattctctttctttccaaactgctctttgctctagagatagatccctgtatcagttaatattattatcctctcaggctatgttagaaattcaggctttgtatcagtctttactctgcctctcctttttctcatcaggttggaagattatccaactacttgcatatttgatcatacctctccttccattcctatcacagctgcctaaattcaggcttttgtagctctcattacagtattctcttaatagatcagtcatcacttctttttcccctttttcaaactgatgtcagagttatctttccaaaatgcagatctgattaggtaacttctttgtaagccctcaggcttttgttttgtgggtagtcaggagctattaattatttggcatctattggttttgataatttggtcccagtctcctttgtttgtttgatgttttcccactcctctccatgtgccattccccagttacatcagaatatttgccattcttcagtggagccctgtctatatacttttctaacccgttcatgatgcatggaatttgccagtgcctaggcctcaccctgaaatctattagtccattgagtcctgcaagatccattttgtgtttcccactctcagtgaaagttccatgattatgtcaagttccctgattatgtcaattaaaatggactcttattgtacttttgggtagccagaggattctgcagtttttcagtgtattttaatggtagaagatttgagaattttaaaattagcatttttgtttacaaaatatgaagactagaaaggacctgaattcgtttcagtcattttatagccaagaaaatgaagattgaaagaattaccacttaaatgacttgtccaaagtcacacaaatagcctattgacagaattgattggaactctgtagtcctgaatcttagttcagtgttctttatgctgtacattgctatgcaaatgaaattatgaacaatcacacttttaaagaaagtacatagagcaaatgtttttttttcttcttccaggtttcagtctgaaagagaaagtggagatcgaaattttgcaataggatattacttaaaagaaaagaaggtttttaaatttttgtttctatttcaaattattctttcatttaataaaatacatgaagatgtatgctaagaattcaacaatagcctttaagcaactacctattactatttaaggtgcagaagtttttgcagagtgctcgtgagtcagtgttatcaaattgttaatgttattgttaatttgatttgtatctggcagcatttaaatatttgactcatattatttattaatacaaattttgtttgaggtttagtctattttttcaaaagcatgatgcctgattactgttaactactcttgatttttttaagtggctggtctagtaacttgatttataaatcatgaatcattttatcattgtcagttaaactagtatctagaaacttacatgatgtgataaaattttgcttttttatttcatgtttatactcttttagaagttacatgctattttattaattaaaatgaaacacttgtgtacatttgaaatttttcatatatttctctacttatgtgcattcctgtgtgcctgaatttttaattgcctttctggtttttttagtgttttccagaaggcacagacatggttggtatattagacttctacttccaggtaatctaattatgtaaatcgtatatataaatggatgtgtcggctgggcacggtggctcacgcctgtaatcccagcactttgggaggccagggcaggtggatcatgaggtcaagagatagaggtcatcctggccaacatggtgaaaccccatctctactaaaaatacaaaaattattcgggtgtggtagtgtgtgcctgtagtcccagttacttgtgaggctgaggcaggagaatcccttgaacctggaaggccgaggttgcagtgagccgagatcacgccactgcattccagcctggcgacacagtgagactccgtctcaaaataaataaatggatgtgtcacattatgcaaaatatagatgtctcagaaatcttggttctaggccatgagaaaatacattttccattgactttcaaaaatgtcttcataaaaggcagtctcatgtccatgcatgttgcctaaaaattcatgcctcaaaatgtaatggggacaattttttctgtaaacatatttaagaattgtcaaaaataatgaacactcccagaaattggcactcttaattataaactgggctctaaatttttcgtagcttttacattttgtttgggaaaagctttattttttatttttttattttttaaatcagagggctcttattcagcatttaaaagtgtcagtgtctcagctgacttggtatcttgtaatttctttgttactactctatcctggcttaactggtgctagttcatttctgcagtgtcatatgtcgggctttcttgtaagttagagtagctctcaatattgagggggtggggttgagcgagagggaccgtgttacgcacaatgggctatggtatagaactcaatttagaatagccttcctggagatctcttctttcacccacattttcagctcaatttattcttacagatttaacacagttggtgccactgatggggctgtaatgtgaagccacataggaggctacattattgttaatttctagttcaccttacatttgcctgtctttactattaaaggttccttaattttaacctttcagtaatcttagagaatatataagggaggttgataatgagttagattttgatagatgtccaggttgcagcttttcatcggcccaatgtgaaaaaccgtaaattgggaatccagaccatcaatataaaatttaaggtctagcctggccacttattagccatgtgacctaattttagttactgatccctagtttccttatgtgtagtatatgcgtcacctgccttgccatattatgtggaagataacatgagatgatatgtgaaattcctttgaaactagccttttttttccccctggtctgtatgaattttttccgtaagtttcttttcctttggaatacatatttaaatttggctgttatagaatctactgtaatgtgacatttctatacttcattgcaaaaatcaagaaacagccatagaagtggtactgacttttttggagaagggctgcatcaaattgaacggccattgagattagcaggagagtacccgagttggcatttggcaaattaagaatgtgctgccttatgacaaacaaaattccaattaatgttaagtataaattaggaaatgatcattggaattcagaaagccttgcatgattaagtcgaccttatcacaaatctttgctatctggggcagtattgcaagtcgattctgtcgtttttgagaaatagggaagagattttttatataaataggcaatgtagtcaaagttaaacacacaatgttctaattcactgtacttagttttcctccttgctatttccaaacccctttgtgcctcttgtagatcttggagtatggctgaggaaaatttataagttgaactcattcttctcctatccactttattttttgaccccgtctcatcccaattttgcttactattagctaaaaataaaatgtggaaaaatttattttcattttatgggtaaatttgggtttggtacggtgaactattttcattattttgattgtatttaaatgcaaaaattttatcctagagggtattcttagcacccatagtaaatatcaaataaatattaataaatggtctaaaggataacattttggtttaggcttacagagcatctgagacagatctgctttatatttttcttcccctttttcctttgcctgttaccatatagatggggatgccgaactttgttatgggtgaaatgtcaggcactgtagcatttttttctaaaatggtgatttctcatgtagacactatcataatcttcatgtatggtgctttatcttaaaaatatttcatggctctttttttttctgttgagttaaaagtaattatgcttgtgtattccacagaaagtattaatatttaagcaaatttgaatatcacatgggataataacaaatcttagtgtttagaggctggcacttcctagtctagttctgccattaaaagactgagtatctttggccaaatcagggtaaatcttaaaagtgggtaggacttcggtcaactaaaatcttcagaatgtcctcaagtttatattaaagtaatctctttggaagaaatatttcagatctgtatgaaataccaaataaaatagattatcttaaaagtgaacagtaatattaaaagtagtatgagaattctgctttttctttgtgttagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgtaagtaattgtttaatcttattttctctggcaagaaactagtctgaactggttcttttaaaaatgcagtttgaactttgcttctaaagctgtatattaatttttgagagagaggcttgttttcaaggttaatttgttacaagattagtaaggaatagagataaggtctaccagatgttcttaagaacttggaagtttgatttatagaacctcatcccttctgcttttaaggcaatccagtgtacaaggttagtacagtctttctttactttttgtttttaatgtttagcattatgattatgtatcttaagaattctctaagttcagaaagattgcaaagatgtgacgtttcacatctttggttacggccatagctgttttaaggactaaaagtgtattaaagttaaaacttaacaaaaatgtactgctttaagctctgttgtgcatttgccacttgtaaagtatatagactttttttatttcattctgctcatgtcaagtcataatgcccttctaaaagctttttttattttggaaattttcaaacatgtaaaacgagagagagagagagatacatttaatgttatccatcactcagcttcattaattatgaatacattactaatcttgtttcatctgtatgtgcatctgtttcccctatccttgtcatatttcagtatgtaattctaaataaggatccttaacaaaacataacaataatacagtttttacatataaaaattaaatattacatatcaaaactttaatatcattattaatatcaatattaaattgaatatcaaaatatttagttagtgtttagatttcctggattatcttgtaaattattatttctttttttttttttttgagacggagtttcactttgttgcccagactggagtgcagtggcacgatcttggctcactgcaacctctgcctcctgagttccagcgattctcctgcctcagcctcccgagtagctgggattacaggcgcctgccactgcacctggctaatttttgtatttttagtagagatggggttttgccatgttggccaggctgttctcgaactcctgacctcaaataatgcacctgcctcagcctcccaaattgctgggattacaggtgtgagccattgcacctggcctattatattattttatagtttgtttgacttaggatacagatgaggtgcatacattatgattgggttttgtctcctttttttttttttttaaatctattggtcttcttttgacctgtctctctttttttcttgttatttttggttggaaaaactgggtaatttagtctatacagttttccactgtctctacattgctgattacctctgttccattgtcccttgtatttcctataaatttgtagatccaattcaggtgtgttttttttttttttttttttttttttggtctgcttgttttgtttagttttgtgtaaaagtactttattggtatacttcttttatttttgtttgtttatttatttatttattttgagacagagtctcactgtgtcgcccaggctggagtgcagtggcgtgatctcggctcactgcaacctccatcgcctgggttctagcaattctcctatccagaggtactgactgactgaatgttagtaagcaattaatgaacactgctctaatgacattaatttttttttttatcatttgtcaagttttgctaatgtaacttaaattttttgaggaggagtaatttaaattaccattttagaaaatcttttaagaatatataactttttattgttttctagttgtaaaatatttttaaaaaataatttgttatatttaaaaacaatacgtttatcttagaacaattagaaaatatagtcaggaagaataaaagcatccatagcctcacaatttagatgtaactgctataattccttagaatgtatctttaaacaatttttctatattcatatctatcccaaactgtttcataatttttttttttttgagatggagtcttgcttcgtcacccaggctggagtgcagtggtgcgatcttggctcactgcaacctctgcctcccaggttcaagcgattctcctgccgcagcctcccgagtagctgggattacaggtgcctgccaccacacgcggctaagttttgtattttttgtggagacggagttttgccatgttgcccagggtggtcttgaactcctgacctcaggtgatctgcccacctcggcctcccagagtgctgggattacaggcatgagccaccgcacccggccttataactttatttataaacatgttgataaaaatttatctacaatatttttaatgttgaaattctatggtatgtatatatatatattttttttttcgagagggagtctcactctgttgcccaggctggagtgcagtggcatgatctcagctcattgcaatctctgcctcccgggttcacctttctcctgcctcagcctcccgagtagttgggactacaggcgtgcactttgggaggctgaggcgggcggatcacaaggtcaggagataatttttaatttttaaaccaatttcccaattgtgttttttttttttttgaaactggatcttgctctgtcatccaggctggagtgcagtggtgcgatcatggctcactgtagccttgacctcctgaggtcatgtaatcctcccacatcatcctccagagtagctgtgactactggtgtgcacttccatgtctcactgttttttgtagagacgagatctccctgtgttacccagcctagcctccaactcctgggctcaagtgatctgcttgccttggcctcccaaagtgctgagattacaggagtgagccatggtgcccagccccagtttccctattgttgaacataacatttcttattttaaaatgtttacctgaatactcttttactgaattatttttaggttggtcttcctgcaaaatctggagttgctgggggcattcttttagttgtccccaatgttatgggtatgatgtgctggtctcctcctctggataagatgggcaacagtgttaagggaattcacttttgtcacgtaagcatattttcttaatgtaaataatggtgttacaagttgagccatccaatgattcttttttttaacccattttccatagttcattaactcttggccctccgcctatagtgtgccagttactagggagccgtggaaatactcccagaggagcttcaagttgtctctgtcagacagctcccatttaattattcccacagattatatttgttagatgctaatattttaattttcatggttataattagtatcaattttcaaaagctcaacaaaaggtattaaacttggagaagtaatttaaaagccagtatatcttaagaattattttggtttattatatctttaatctgcatggttaaatatctttatccattgactacctttaaacatttttttgaggaaataagcactgaaaattaaaaaaagattaaaccatttttaaactgttactgctcttgatagttctgtattttgttgttacccagttcctgctaatgtttgagcttctagttttagttacattgattacttgcttgagttcatattaagtaccatactcaattaaaattgttttattttccagtcttttatattttacaaaaactagagtatgaccttggagtgcatataaaatatagtagattgtaaccagagtacttatttatattttaatgtggctttacacttatttgatagaagaattctttcatggggccggttataaaccctattttgtagaagatgaaagatgatttgattggctgagccctaggatcatgttagtaagcagtgttcttaaaacttatatccatatcttactctgattttagttctcttcttgatgcattatactactttattagcatgtagtgatgatttctaggctggacgatataagcagagtttgttaaaatatggatatatataaccaatgaatagccaatttcttatacctgctctgtataactgtttacaggatcttgtttctctgtgtaatttccataactatgataatttgagacactttgcaaaaaaacttgatcctcgaagagaaggtggtgatcaaagggtaagcaaaattcttatttagataagtatataaaatttttaagaagagaaaaagtgagatttgcctgtataaataaaatcttagtttgttagtggcctcgggtctttgctaatcataaatgagtgtaaacaaattgttgacatataaatccgggatcaccagtattaaatacttaaagattgtttaatagatagttaatagatacagatatttaaatattgctgttttgttatttaaattgaaactagttagcctagtgtcagggatttccccttccattttctgctattttaagcaagatttttagaattgattctgttaaaaaaagaacaaaacaaaacattggaatgtgctgcatgctataaagaaagcatcgttttaatatttgttcgtcctaaattgaagtttaacttcttgcatactgtgtagatggatatgtaaatggaaaaggattatcatattagtgagagaccgtatgaagcctcaaaagttttataagtcactgtagatgaaatatttttttccaccgtgtttaatgcaatattcctaataatcttacggtcctatttgtttgttacgagtttatttggcttcatactattgtacacatatattcctttttttagaagtagtattaagagtcaggacttaacttttttggtctatatagtttttcactgtaccaaggggcttgtgctgagaattttgattcagtttctttgcgtaccatattgaaaatgtttgtagtaaaattacctaattagacctcaagataatatgaagaacttctaagtagaaaatatttttaatacatactaagtacattttctgtagtgctaaactaaatttttgttagtttttatcaaattaatttctgttactatgtaagaattatgcaaaaccaacagaatagaaacttccatgggagtcgacctgagtaacatgaagcaaaatgtcagaggtggtggtttaaaatgttaacattttaataatgctcattgaaaaataccattttatagcttggacctttcttcactcaagtgcactaataaattatgtatgttgcttgaacaactagcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagttttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctgattttattgttttttttgttttgttttgttttgtttttataaaagcaacttcaacattttaagtacaaatacagttgggattttaacttagaaaaaattattctttatgaagatactgttaaagtgtttgctattctgaagctgcctcaaagtaaactagaaatattcaaaagggctttatttgattttttaaaatgcaatatagcattagtggtttttttgggaggaggacttttcttattggttgtactagaagtatttgaataaaaacttttctctcaatttttttggtggtttttccatttggtaactttaaaaaaagtgcaaccctatttgtaggttatttctgctttctgaggaggaatattgttgttattcactatgtaactctcattttatctgttgttgcctaaataataggaaaaacattgctaaaccaaatgaagagtatcatcatattgctttagaataaaactgttaatctcagtagaatttatattaaacagaatgacagtgatacagaaattcaccttaactggtttctgaggggattacattttcagaaggaattttgtatatttccacagcatgatccaaattatagtacaaattatagaggctccatgtattgtaggtcaaatatagtactttacatttttatgtttaattaaatctgccattcatattctggagattcctgaatatattgtagaagttttaaaactatttgaaaggggaaatactgttgtttacatgaatttgtattaatctgtgggatttttaaatgaagttcttttagaattagttaataaggagttccagtataatgatatattcaatatatgtaacagtttatgattacttgcttttaaagatttttttaaaaaatttatttgaagtaaagagagaggagacttaaaatacctggtgatcttgatctgacagtgtatatttaataggcatatatttatgtggaaagaactgctgaaatatactgatatgtcagcctatatcctgataatttatatataatgtgtgggttgcatatgtttgtgcatatgtatatacgtttgtgcatacatatatatgatttccttatctatgtaccttaatctacccattcatattctgaaaatgatgagcagttcttttcacattgtgtactatgtataaattattcattgatctattcctgttccaagctttgacacaaaagaacccctaaaatttttgctgccctagaattggtaaagtataacatactttacttcttcaatttgactttaaagatttgtggtttctgttaccattcccattcactaccaggactgccagggtaagagagtaactaacaatattgggggaactctggaaaagtgaaaccaagaatattagatttcatgtggaatttaaagcactttccaaaatgtattataaggaaggattgtattttttaaattgtttttgacttaaaagaagtaatgcacttatattgagcagtttatggaacagttttatttagttactgtggtacagtttttagttttaagaatctgttttactattcatctgtaaaaagtttggtttttctcctacatggccttgaaaatgctagaaagcattttttaaaggtatacgatcagaatacttaacgtgtgatttcttctcaattacttctctaccattttatatttaatgttgtatttgcattgtgtaataaaaccaaaaccagatgttggagatgtagcataaatggaaatttgttaccatgcatgatggccttatgctcagattttcatttagacttactgagaatggactttaccttactcggtcttttctctgtcatgtagttcaagggcaaaattatacataaacatacactcaagtatatccaagttcaactatttttcttttatttcaaattgtaacaaagttaaaaacctttgtttgttaacattgcttagaaatggaaggaatttaattagaaatggaaggaatttaattgggttgggggaagttcttttattttataccccaacctccagctagtagtttattaatctgaataccataaaatgcacatgactttgagaaatttagaaaactactctaagaggatctgaggcaatatttatccaacatgaaacagcgggcaaaatgtgatgtttcgtagagttcttaactttttaaatagtaatagaaaaggtacttatttttaaaatagtatgttaagtagactgattataaatgcttatttaacaaagtgattctgttactatggtcttaaaatgttttctattttatgaacataggagaggaagagaatttaagttgactttgtttgccatttctattttgtagattgtagatctactttagtaatttttgtaagttgtagctaatagagattttttaaatatgccatgtatagaaaacctgttttcataaaaaactttataatggcttcctgatccattaacccttaaccaaaatgaataggatactaattagcacttggattgcattgcttttttggcggaatctgtgggtttttttttttttttttgtaaatttcattcaccagtaaattacagaatacttattattgaaaaccatcatgtattgctttaaaacaaaagttataatcttgccctcaaaaggcaagcgttagaaacaggtgagctggtgccaactgcttctgtcggttaatcttgtaacatttttactatacatttaactctaaatctcatttactaattatggaatttttttaaagaaaaattatataccacatctcaatggcaaagaataattcattgtatttatttttaagccatatttcaatatctgaggatatgatttttctgtacatagtatgattaaaaataatggtattttttcattaggtatttaccttgctgaaacactttcaggccttaaaaccacagataattaaaattatctatttggaaggcttagcttttgaaagaaaaaattcttacccaaagtagtttttaaatttctattttcatattatgtttctggtgatttatgtttatataatgaaaatctcctctgcacagcaattatatttggaatcctgagctataattaaatttatattctgtaaaacagccgaaggctttcttttgtttttaaaacatagtccaacctttctagaattttgatgtacttttatttaccataatcttatatattttttagaatcacagatttgaatttgaaagtaatcttaaatgttacctggtacagactcccaccccactcagcccccttttccaggtttcctagcactttgctttttctattagcatatttagatttttttctcttgagggggttggtctgttttgtgttttgttaggatggactttctgtttgtagatgtttctgtttgtggtttagttttaatgagagaagcataattggcagtagttaatgtgactataagttatttggcagatggtaccatcagcatttattaaaactaattgtatttttctagtaagcagtcttatgtcccagttgttaaaaattagtaaagttagaagtaaatgttaaagttacacagtagttctaaaaataaaacattaccctgcaatctttgaaagaaaactgtagcagaaatgtaaatctaaaaataaatgttacatcactggctttttaaaataaattcctttgaggttagattaaatatataagtaaaacgattttaaataaatagaagactagtcaagttctaaacaaatggtttcttaagaaaaatttgttttctttgcatgttagctcttggaaaacatgcaaaatatctagctacttcccttgtttattttagacatttggatctgtgagtggcccccaagtttcctaatttgtctgtttatttactctgtctatagtacatgttgtcttcagtatcaatctccatttcatagttctggagttttaatatttatgaaggactgtgtgtattgagttcttgaaatatgttaacttttgaaaggctttgttgacttacaaaatgttaaaacttaaatattgttgctctcaaaatattatagtattggtttcttaattctgaaaatttaaactgcctgagtagctcttctccctacaagtttcagtataaactcattcaatataaagtctgcttgcttttatattatgcattccaaaataaaaatgatgaaatattagtatcagttacacaaatgtaactactcacatttgaaccattttattgtaaaattcaactttcaattatgataatcagtctcttgctgaactttttagatctagatgagaattataaatttttgttattttatatgtgttatatgtgtttatatatgttttatattgtgttatttcacaaatcatcacaaaagggcaatttcaaagattcttttgagaggacagcttaaagcttaatccttaaggcttgactttcttctattaaatgagattgatacctaaaatcatggtataaattattaattgaattccacccaagttctgttgttttgttctttctcacagtcattccaaattaaagattttagttgaaaaactcagaatatattatctaaatttcaaatattctattttttattgtttcatattataatttattttgggccaaaatgaggtaatttaaaaaattatatcaaagttactcaggaaatgggttttcagttccgtatctttatatatgttcacttccaaatcttttgatgttgacatttgccattgtagtttaattttctttaaaaagttcgaaagaaaaccacacatgaaatgtaaaagtccaaatttctcttcttcagtataatatagcttattctttatttattattttacttagatccttgaagtatatgcatcattgatccaggtctatgcacaagatttataatgtaaataaagaatgaactaaataatactgtttgagatgaatatttgaattgagatgaataaacgttgcatctaatgcacaatgaaacttcattgacatctgatgaaattacagtacaagtgattttgttaacattctatggtgactaatactattaatcctttttaatcataccaataaaatatttctgccttaatgtctctttttactggactatgaagaaacaattctgctgttaaaggataaccaaaaaaataacttccacctatctgaatgcccttattctggcaaattagcagttttattgtagacgtacccactttaagttgctctgcttctcttctagaattgcttttgtaataagtgtaaatttgtagtcagataactcattgcttttatgaagttgctttcccacttgtgtgaccttaagaaagtggctgaagtccaggattcttctggcttcctggtttccatttcaatattttcaatccctgttttacttagttagcaaacttttttttttttttaatgccttctaaataggaattttgttctcctcatgttgttttcttctcttcatttctggtacccaaccaatatccaagattagatccctctatataaatgaaaatgtataacctttaaaattattttcttttggtctttttttctaccaagtaagaactaaaaaagattaccatccccctcagcatttcactagtttttgttcaaacagcacacaaacagaattatttcaagatatttagctaattaaatttgattgtgcaattcagatctatataaattaaccttagcattattcctgtgctttattattcactgataggttcttattcaactaatgtttatttcttgcctaatatgtgccagaaaccgtgaagtgtttaggatatgcagtgagtggttaatgagacaagtatgatccaacttgtgtttgcaattaagcagggatacaggtactgaataaatactgaaaataattaaaatggtaataagtgatttgttaatactgatgcatgtagatctaattcattttaaatgttacaaaataagttacaaaatggtatatgccatatgatgctatttttgtacatctataataaactttatgagacacaaatatgcaatgtagttactaataaaactataagaacatgaacaccaatctttagataaagcttactgccaggagggaatggaatggatgcagagagcatggttagctgtatctttaatgtttcatttctttaaaaaatatttcagcaaatataatgataatgatagaaaagtaaaaaaatgctaggagagggtacaataagaagaccttgttttgtctgggtggttaaatatggttggttttcactggaaggtaatacagtgtgtaagttttgaaggagtcagaggaaatatggaatagtgttaataggctagtctgacttgaaggccccagaacaggaaggagtttagcacatttgagaaggggaaagaaggcaaatgcgctgaagaagagtgaggtgaggtggatggagattggctgtggatgactcctaagagatggggccatattatgtagagtgggccttctcatatttcgatgtacatcagaattgttagagtgtcttaattttaaaatacagctagcttcctggggcccattcctacagttggattcaaaaatctaaatgtttaatgtgcaccccaggtgcttctgctgtaggttgtcctcaggacacagtttgggagacatttctgaaaggtcttatatgctatattaagaattttggactttattcagagtttagtgtgaaactttgaagacttttttttttttttttttttttttttttttgagacggagtcttgctctgtctcccaggctggagtgcagtggagtgatcttggctcactgcaagctccgcctcccgggttcacaccattctcctgcctcagcctcccgagtagctgggattacaggggcctgcctccacgcctggctaattttttgtattttttagtagagacggggtttcaccatgttagccaagatggtctcgatctcctgacctcgtgatccgcccgcctcggtctcccaaaatgctgggattacaggcgtgagccaccacacccggctgaaactttgaagactttaaaaaaggggagagaatgatttggtttttaaatactgctctgcggagaatggattaaagagagagaaagttgaagttttggactcgagatgtgttggtggcttggactagaggtgagagaaataggtaaataagagatgtgtttaagaaataggattggcagcacttggtgatcgtttttggtgggtgaaaaggaatgcgatatcaagctgactaccaggtttatagtatgagcaacagggccaaagctgctgcattaactaagatggagaacactggaaaagcaaaccttgggagtatgggaagaaattagtttaactttggctattgtgacaatgaaggatctgtttgattgtggatatcaggaggttgattgacagtgctttaaacatatgggggttatttttctaatataacagaaagtctcagggactatcagggaaaccaaccagggctagtgccattagtaaggtaaacttctgttacacaagccttaagtgtgttgatcttagaaatcacgcctatcaacttagagttgcaaggtggctgtttcatctttagcctcacctgtatggccaaagtgggagaaaaagaaaagagtgatatctaaatctaaagaaagaagctttactggaaactcacctgacgctcattgaccagactaactgcaagggaatctgggaaagtgtttttaattggacacaatactacctttaacaaatagaggttctgttagtatggaaggggtgggtagtggataatggttagacaactatcagtatgtagaagctagctaatgtttgagatatttgtgagatatctaagtagtgatgttgagtaagcagtcagatttaggcctaaaacttagagcagtgtaagttggagctataattttgtgagtggtcagtatgaagagtagtatttgaagctggggtggtgtgtgagattgcttaaggtgatagtataaagtgataaggaaagtgtatcaaagacagaaccctaagaaaccatcattttaaaggtaagatagagtaggagaggcttccactagggaaaggtggccagagaagagaaaatccagcatagtgcaatatcagcagtcaaggaaagagtattttaaggagtttggagcattgaactgtatgaaagcatagataatttagtaagatgagggttttatatttacatgatgtcctttctaaattttttttagatagaacaattgctttattttttagtgtcttaaaatatgcttttctccagcaattttctgtattatatgttggaggagcctgctatgtaatttgaataataaagtggctatgaaagtgctttgaaaagttacagcattagagaaacatactgttattacacctcttctgtgagtatgctccataaagcacacatgttgaacgtttcacaatagaaatgtgaaataaacattgaagaatatagggagttaagtaaggctctggagaccagtgaaaatgagggatttcttttctaacattaaagcaattagtaaagattgtgttagtattgtgggttggaataactatagaaaactcaagtccatgtgcctggcttcgttatagtagcaggatttgaggcatgctaagagaaataggaccttaaactctgaattgaaaccataattcttcctgtatgaatgctaaaaccgtgttgtttcacagcaggaagagaacctcatctattttcagggaccttgtttgtatttatttatttttaatttacacaaaatggtgtctttgtaagaatagtttgattccaatggcctggattttttttttttgtttaatatgtgtatttggtgatgaatgtcttctcttcctgtcttaaattcgcttttaagttctttgacttttgggttttatgtacttgttttttaaatatagcactttatcattccagaaatgtggaaccttgtcctctatcctaacacactaatgtaatattcactaatgttcatgaacttttacaaaaacttgtttgtataatagtgggagaagaccagaaagatagtgaatgagaaactttgatagttgtctgtgcaatacagatatgcttaaggtctgcagttttgttctttggaggagtagctgtctttgtctttgctcattgctatttttcttctcttctgctttctggcttattgattaggagtgctgtttttcagaccacacaaagatatattgttagctacttttataattggatatataaagagggatgcttatgacctcattggtatctttttagaccattcattggtgtttactggaataatatgccactgagaaaagaagttatttatttgctgccagtagcgtaacagtcatatttgcttttattcacattcacccaactcacatttcatttttaaagttttaaatgcaaagaataaaggtaataactttttctatttgtcgtttgtgatattatcaaattgaattatttcttttgttcttttattttcccttcatttaaaaaacacctttgggtagcacctcaatataaaattaatatctctgatttttctataaattgtttctttgttgctattttctgatttcctatcacaacatatttctgtcttggtattgtattattgaggaagtcccaggttttgttaggaaattgcttgacccagtagatagttagagttgcaagcactggccctggcatcttccagactgggtttgagcccttgttcttccacttaccagctctgataccttgctgaagttgtttaaatgtttcctgtcctttaataacagaaataacatttggagcacttagctgagtcgagagagtaggtgcttcatattaactattttgttgtaagtaatatataatctttaattttttgtcttcataggttgtcagattttttgacatgattatgactttttagtttacaaatgagtgaaattatttcagattaaactggtcattgaaaaattttgaggctaggcatggtggctcacacatgtaatcccagcactttgggagggtgtcaggaggattgcttgagcccagtagtttgagaccagcctgggcaacatagtgagaccccgtctctacaaaaaaataacaaagaaatcatccaggtttggtggcacatgcttgtggtcccagctgttcaggaggctgagttgggaggatcagttgagcttgggaggtcaaggctgcagtgagccatgattgcagcacggcactccagtctaggcaacagagcgagagcctgtctcaaaaaaaaaaaagaaaaaaaaattgaaaattgtatgcttttaagggagtttattacttagcaaagtcaagaacagaatgcagttcttggaggtaccattttgaggttgtatttttaaagtgaaatttctgtaaaacagagcttctttcctttatagtaaaatttgctatttgatttattcctctctattgaaattactatatgagaacctcctgcatttgtgtaagtttggaaatatgggcatgaatttattgaattgctattcctataaaagattttttccccaaccctccgaatcatatcagtttggattagttttgtctatatatagtatattaataactgtgtctcagtaaatctttggaaagcttaggaatatgtggcctcatactcagactgtctaattacaaaagtagtataatttttttttacacatccttaaaaatattaaataagctcagtagtaaaggaaagaggaaatatcttcaatcacatacacaatacacaggtttacttttacccttgggcaaggtgattaatttacatatgatggcaacttaaaatttttctttagccacagtataataggtagtatgcctcaatttgaccttaagaaaatataaaagcaggctgaaagcttattttcatttaaagactataatctgccaagttggagtgaagcctttaaaacaaaattggatctggagtcatgatggtttatttaacagttgaagaaaagtatctattccatgacaacagatactgtactgagctggaaatgagagcagcttatctcaaactagaggtggtagaaacagaaggatgttttttcagttacctgcttttttttttcattatagcagttccaaacaggctgaattcatgtttatatgaagacagaaactaaagatgaaaaacagaggaaattttggtttggcagttggtaatggagttagaaattaaatagttgaagtaaagtgtaaaaccagtgaaccaatttttcctccgtctctccctccctccatcttctccctttcttccttttctcccctcccgctttggtcccatctaggcttccttccaatattgagtaaagaacttttatggattagagctaaattgatatttaatccgttggtttccttctgtgctttggataacaatctgagatctattaaggactcacatcatcatggtctagttgtacagaattgggaatccagatacctgagttctactcaagctccatcactaattcatatgctgtgtgaccttgagccagggtccttaatctcagtggtagtaataaataaaatatatctatcaacatattttataaccagcctgtcagggatttttaaaaacaactataactgtttaaaatgttgaatgttttagggtcatccactatataaatacagagtaatgtgagtatataattctaataattgctacttactcataagtacagaattattagggcatttacagaagtcacacaactcaacctttaaacaagctcaaactgagtaggataatgataggattaaagacttaggaatgccatgttttagatgtgtaaaactgatacactccccacctgcttctagctgttttggaaaaaagtgagatttgctatgccaagcatgccagtgttaagtgaactcatgtgaactgtaacattttttgtcccactgttgtcatgactttgtacaaataaactaagataagattgtctggttcgggcagattctgataaagagacttgataagaaaaatgcagtagtgctggaaaatctacaagatgaaggggaaactgttaacagttaatttataaattttaatggctctctgcccaggtgcagtgtctctttgccatggggaggtatacattaaacatcagagcccttaatttaatagctattattgcggctgtgtatagtctgtttctttatagtaaggaattatttatcaaaacatagcttccatgcctctggcatttactgttaacccattattttctggactttggcctccttgacaggtattttaaaatcaatgtaactcaagtatccagtggggaaataggggaatgagctttgatcaatggttagcacacctacatcctttgcaagtattggtgtggaggtggatgactgatcttctagagtgcccctctccttcagtttgtttgctatgataggcattccagagggtgtgtcagcttagttggaaatactcgtggcgctctttaacagaccaggaagcagactgtccctaaatgaaatactccatctgttgtctcaaaagtgttaaactagtttcattttcttttgtggcattctacccacagctcatttcataatttatgtaaacttaaaagtatagggggctgttgatgctagaaagaagaggaatttgtggttttgcttttaaatagtgcctgtgcatgggctgcctcctagtgcttttctgttttggagagaattacactcactttgtgttcaagcacctatcttctggtttggactaaatccagctccatagctagccttttgttttcatgggaagaataccaaacttccatgttagtctttaataattttgttaaggcgagctagtgtttttcccttctgattagttacaaagcctttgtacattaaagtttcctgatttttttttctcatgcttttgaataacaatatactctgaataaaccaagtatattctaaaatcttctattttgggccttattaataagaaatggacttttagaacgtttgaaatgttgaataatgaagtgactaagtgctacacacatactataataaaatctcttcaaacgagcatggtctaaattcaaaattttaaaggggaatgtgtagttcttatatccagtcactgaaacagatgaggctttattgcttagaagtaccaacatagttttaaaaataataactgggtaattaatatattaatggtatatacaggggaatttggatttttcttagtggtgggggaagtaagacacacaaatgctccatgtggtcatgtgttatagtgccatagtgcagcaaaggtagacggagattacttttgatttaagagattggagcagagttcacaggaatgggtaagaataacatatcagtgagaaatgggtggggaaaaatgatttcaggagaatagtatgcactgtgggaggaagcaggaggtagatccagggttgtggtgggagtggaggtatctaattgactctgtccctagcacatgctgtcacagggcactgtgtgggcagctggcaataagctacatagataatgaatgctgggctgggatggcctggggaagactgacagcaaggaagggactttcgggctagtctttgagggaagggaaggatttgattaggaatctgggtgttcttaagagcatagacaccaagacaaaaacaagggcagtaagaccaattttgctctattgaggttgagaagaaaaattaagttagctggactgaagaaccttgaatacaaggctgaagaacttaaatgttatcaggaatgattttgggtttcttgatactccgctgcttagaaacctgtagtgattagagcaatgttttgagaatatgattagaagtatgtggagaggttttggagggtggaagaaggaccagaagcagaggcatcagttaatgattgaataaatcttgtaatgatattcaaagatgtaaaagttaaggtagatgggctgggcacaggggctcacacctgtaatccctacactttgggaggctgaggcaggcagatcgcttgaggtcgggagtttgggaccagcctggccaacctagtgaaaccccgtctctaccaaaaactacaaaaattagattagtggtggcacatgcctgtaatcccagctactccagaggctgaggtgggagaatcacttgaacccgagaggcgaaggttgtatgagccgagatcttgccactgcactccagcctgggtgacagagcgagaccttgtctcaaaaaaaataaaatgcagggttgggggccgatagaggaattaattttgcaatttaatacccaaaattgaatatttgatgccttgagggagaatattcacttagtcaatagatatttaatgagcacctattatgtgtgatagacactgagtttacggtggggaacagaaagacaagtggtctctgcccacatggagcctatatttaatgagagagacaaaaaacaagtatatataaaaatatatatactttatatatagttatatataacaaatatagttaaaaaggatatagttaacaatacaatatatatatatatatgaaggggaaaagcaaggtaagggataaggagtgatgaaaagaggggagtgttttagagtcttgagagaacatttgaatggagacctacccaaagggagggggagagggagcctcctgacagcctggggaaagagcatctctagcagccagttgtaggccttgagtgcctgagaccagccagatgttctgaatggagtagagctggaaagggaagagtggtaggaatgatatgtgcagtgtaaccaggaatagagcctttagggtcctgaaagccatggtaaagagtttgattttcctttagatatgatggaaaggcacgggagttccttgatgtttttaaaagatccctatggcagcagaggtgataaggtggtggttcagatgaggcctaaggcaatagtgatagaggtggtgagaagtgataggattccaaacatattttgcaggaaagaggatttattgatgagctagatgtgggctgtgagagaaagaatagaatcaaggactaccccccatggtctgtatggtgaatttgtctgaattagaaaaagctaattctgtctctggccagaagcagaagcacttctcagcaccactgggtaaagaagctcccttcctcccagcacatgtacctgggtgctaggacaccttggtgggaagagcgtgggctggtaacccgtgttggccctgtggccaggcatccttgtgaaggactcaacctgcataagtgaatgcagcagcactggatgactcctgagtttgtggcctgagcaagtgggtgaattgtagtgtcatccccaaactggggagactagaagaggagctgactgtgagtggcagaagacagggcaaagcaaattccattttgggtataagtctgagatgcccattaaaagtcctggaagcaatgtcaagtaggcagatggctatgaactggagccagggtgagaagccggcaggactgttgctgtttttgagtttgaagtgactatcaagtggagctgtaggactggagcttaggagaaagatttagattaaagatggggaagtcagtgtgcccagaggaatagatgaattctttgagggacattatattgaaaaacaagaagattggactgccttgggagtattatttggcagtggaaagtgggtaatgaatctgcaaagcagcaaacaggaggaagattagggtgatggagcagcatggaaggcaagtcgtgagagggtggagggtgctggggggatctgaaggaatcagggcttaggaagctgctggagctttggagagcgctgtttagaggtaacaatgagtgtgaaggtaattttcagggaattaaaaatatactttcaggaaataagcgctgaagggagaacaatagggtcaagtgttgctttttaaaaataggatgaaattgtgtctgttttaaggtaaactgagagaaccaatgaaagaggaaaagttaaagatgctagaaacaaaggggatcagtgagggaacaagaacagggcatctagaggataagtgtttgaaggaatagataaaaagtagtctcaaaaatgaggaagctttttactttgagcgatgaaaacagtttttatctttttagcaaagttgtagttaggatcttctgtctgtttttaggggtctccactggtattaaaggcctgaagaaagtatggcgggaaccaacaagaaaaaaaaattgtcaagcagtaatgagagaccaggtggaaatatggagaataatctgtaatagccagtcagtattctgtggtccaagagcaaaaagggaattgagaattcagagttgaccccattaaaaaagaaagacattaaggacacctgaaacagtggtttataacccagaaaagtgcatatcaaagtcacctggagactttaaacaaaattatgggctgagcatgttggctcatgcctgtaatcccaacagtttgggaggccaaggcagaaggattgcttaaggcccggagttcaagaccagcctggccaacatagtgagaccccatctctataaaaaacaacaaactctatgcatttacctcctttccctaaaatgtatcggattgaggtgtaggagtaggacaacaagaaatgggagagatgtttatgtatgtttttagaacattctgggtgatgttcttcagttctttgttccacccccattccccattaagaaaactgttctggactctgggcaggaatagaaaaggatggctggaagggaagctaaaggactaagtggaaagttttttgaagtggtatcaacacaaatagtaatagtagtattttgggggtgtgctcagctagttaagttcctgtactgcagacctttacagagtctttcatatgctcatgaatctccaagagggggattgaatattttaagatcatatacaaacacaggatccttattttcatgggccatcttacggactagtttctgcaaattacactttgaaaatgatgaattagagaactgcagcaatgatcagttccagttaatttggaaggttcatgggttttggaagggggaagccatactggaaagggagaatgtccgggttaagatcttgaagcacagttccaggctgtggctttgttggtggagagctgggttactttccattccccagttaaacttgttttctaccattgagtccagtatcagttgagtcatcaatatgaatgttgaagttgcaaagtgtaagacaaaatggggaatttatgaagtatttacaaatattctatggtcaatagtttaatttctcatagatagggatggataaagtctttatgaaagcagaccaaaatccaatggcttttcaaataactagacttttcctcttaactataagaaaaggaaagtgggtaactgtcaaaagtagatacactttgaaatcttggagcacttaatagaggtgacttaatattttggagttgagaaacttttaaacacagcagtgtcataagttctgagaatgacccaatttgtaccacctgggcattgaactgaaggctgtctttccagtgaagtaaagtttaagatgacagttaacactgaatgttctctcttaagatttgcaaagaagccagtgattggtgaggatagtgattcttggcagggattagacatttatatagcatgatttaatttttaataatgtgaattttatcagcatacagacttcctcacaatattgagacatagaaaatgggaaggcttctaaacaattttcagttgccccaactgtatgagtttcacaaaattccattctcttctgccaagtgatattattccattccttccctcgtgtatcttatctttattattgaattttccctcacaatccactgttaaaagaagaaagtatcacacacgtgggttcttttggctatggaagtgtccttgagatcactttttgcacgtgactcagctgaagtgttcaaagcacatggaaatcacttgccagtgacaggtggacgttgtatgtgttttctctctcctaaggatgcctaaactttcttttcttcacaggtaaagtcagtgataaatcttttgtttgctgcatatactggagatgtgtctgcacttcgaaggtatgtttacaggatggattagcatgcactttacagatatttatgaagttgcttctgggcgagcagccattttaaggttaaagtctcacttttctttccctttgataaaaatgaccccaacaaaatttttattaaataggcacttccagtgccttaggcctgctttccaatcttgtccttttctgcctcctataaaaaagaccatatctctgtttccccaagtagtaactgttcagctaatctggctaattagtaccagtggcttactggaattggacagtgccttctcactccctgtctaccctccattcccaatctttgatatgtgtgtgtgtgtgtgtgtgtgtgtgtgtgtgtgtgtgtgtgaagcagctggggggtttggtgtctggcagatcatcaggattagtaaggccatatactgctgtatacctaaggtcttttgtgtagagttgtaacttattttcttttttttttctcccattaatacctcaaataactgattttcaaagtggaaaaatgtctgtgcttcccccccttgttttgaagtctgacaagtactagtagactgtgaaatgtttaagaatgggagtcttagtaaaacatacaactttactatagggattagtttcttgcccttatgagacataaaccttggtacacagttgtgccataattcttaggttgcgaacaataatgtaataaagtttaattctgtgagagatggttaacatttaatcttacctaaaaaaaagcaaagctgaggaagagaggtgaagtggcatctacccaaaacacctgtgtactggttaataaggtcggtagttcccattaatgagcttgatgaaggatggcacctgacagggccttaaatgaactgatggagtgaatgttaccagtgtgaattaaatttgctttatatataataaatagctgtgcttacacattttcagatttgctttgtcagctatggacatggaacagcgggactatgattctagaacagcactccatgtagctgctgcagagggtaatacaggaactactcctatctattttctttccagatttaatttctacttagtactaaaatctgctctttttttgggggtgggacggtataggtcatgttgaagttgttaaatttttgctggaagcctgcaaagtaaaccctttccccaaggacaggtgagcacttatgttaccttctaaatatgtcagtattttattatgcaggactgtaatattcaagtgatgataatatttcaacctactaagacattcttgaacctgctatgatatcttataaaggcaataaaccttgtttctactagataggtaattctgtctcccatatcctgtttcttatctaagaatggtgtcttatttagaaattttcaggttgatttgaccattagtcaatacactgtatgaacaaaacaattttttttttgcatttgggaagaaagaattggaattttatcctcatggattttaaaaaaaaaatttttaaattacactttaagttctgggatacatgtgcagaacatgcaggtttgttacatgggtatataagtgccatggtggtttgctgcacccatcaacccatcatctacattaggtatttcttctaatgcgatccctcccttaccctgacccccaaacaggccctggtgtgtgatgttcccctccctgtgtccatgtgttctcactgttccactcccacttacgagggagaacatgaagtgtttggttttctgttcttgtgttagtttgctgagaatgatggtttccagcttcacccatgtccctgcaaaggacatgaactcatccttttttatgattgcatagtattccatggtgtatatgtgccacattttctttatccagtctattatcgatggtcatttgggttagttccaagtcttttctattgtgaacagtgccacaataaacatacatgtgcatgtgtctttatagtagaatgatttataatcttttgggtatatacccagtaatgggattgctggatcaaatggtatttctggttctagatccttgaggaatcaccacactgtcttccacaatggttgaactaatttacactcccactaacagtgtaaaagcgttcctatttctccacatcctctccagcatctattgtttcctttttagtgatcgccattctaactggtgtgagatggtatctcattgtggttttgatttgcatttctctaatgaccagtgatgatgatatttttttcacatgtttgttggctgcataaatgtcttcttttgagaagtgtctgttcacatccttcacccactttttgatggggtttttttgttgttgtaaatttgcttaacttccttgtagattctggatattagccctttgtcagatggatagatcgcaaaaattttctcccattctgtaggttgcctgttcgccctgatgatagtttcttttgctgtgcagaagctctttagtttaattagatcccatttatcaattttggcttttgttgccattgcttttggtgttttggtcatgaagtctttgcccatgcctatgtcctgaatggtattgcctaggttttcttctagggtttttatggttttaggtcttatgtttaagtctttaatccatcttgagttaatttttgtataaggtgaaaggaaggggtccaggttcagttttctgcatatggctagccagttttcccaatacctttccccattgcttgtttttgtcaggtttgtcaaagatcagatggttgtagatgtgtgctgttatttctgaggcctcagttcttttccattgctctgtgtatctattttggtatcagtaccatactgttttgattactgtagccttgtagtatagtttgaagtcaggtagcgtgatgcctccagctttcttctttttgcttaggatcgtcttggctatgtgggctcttttttggttatatatgaaatttaaggtattttttttctaattctgtgaagaaagtcaatggtagctttatggggatagcatagaacctataaattactttgggttgtatggccattttcatgatattgattctttctagccacgagcatggaatgtttttccatttgtttgtgtcctctctttatttccttcagcagtggtttgtagttctccttgaagaggtccttcacatcccttgtaagttgaattcctaggtattttattctctttgtagcagttgtgaatgggagttcactcatgatttggctctctctttgtctattattggtgtataggaatgcctgtgatttttgcacattgattttgtatcttgagactttgctgaagttgcttatcagcttaaggagattttgggccgagatgatggggttttgtaaatatacaatcatgtcatctgcaaacagagacaatttgacttcctctcttcctatttgaatacctttctttctttcttttctgagacaagagtctcgctctgtcagccaggctggagtgcagtggcaagacctcagctcactgcaacctctgtctcccaggctcaagcaattctcctgcctcagcctcccgagtagctgggattacaggcgtgtgcccaccacagccagctaatttttgtatttttagtagagatggggtttcaccatgttggccaggctgctctcgaactcctgacctcaggtaatctgcctgccttggcctcccaaagtgctgggattacaggcatgagccactgtgcccagcccctttatttctttcccttgcctgattgtcctagccagaactgccaatactatgttgaataggagtggtcacagagggcatccttgtcttgtgccaattttcaaagggaatgcttccagttttttgcccattcagtatgatattggctgtgggtttgtcataaatagctcttattattttgagatacattccatcaatacctagtttattgagagtttttagcatgaaggtgtgttgaattttgtcaaaggccttttctgcatctattgagataattgtggtttttgtcattggttctgtttatgtgatggattacgtgtatcgatttgcatatgttgaaccagccttgcatcccagggatgaagccgacttgatcgtggtggataagctttttgatgtgctgctggattcagtttgccagtagtttattgaggattttcgcatcaatattcatcagggatactggcctgaaattttctttttttgttgtgtctctgccaggttttggtatcaagatgatgctggcctcataaaatgagttagggaggattccttctttttctattgtttggaatagattcagaaggaatggtaccagctcctctttgtacctctggtagaatttggctgtgaatccgtctggtcctagacttttttcggttggtaggctattaattactgcctcaatttcagaggctattaattactgcctcaatttcagaacttgttatcggtctattcagggatttgacttcttcctggtttagacttgggagggtgtatgtgtccaggaatttatcaatttcttctagattttctagtttatttgcatagaggtgtttatagtattctctgatggtagtttgtatttctgtgggatcagtggtgatatcccctttatcattttttattgcacctatttgattcttctcttcttattagtcttgctagtggtctattttgttgatgttttcaaaaaaccagctcctggattcattgattttttgaaaggtttttcatgtctctgtctccttcagttctgctcttagttaattcctgtcttctgctggcttttgaatttgtttgctcttgtttctctagctgttttaattgtgatgttagggtgtcaattttagacctttcctgcttactcttgtgggcatttagtactataaatttccttctaaacactgctttagctgtgtcccagagattctggtacgttttgtcttttgtcttattagtttcaaagaacttatttatttctgctttaattttgttatttacccagtagtcattcaggagcaggttgttcagtttccatgcagttgtacagttttgagtgagtttgttaatcctgagttctaatttgattgcactgtggtctgaaaaactgttatgatttttgttcttttgcatttgctgaggagtgttttacttccaattatgtggttggccaattttagaataagtgcgatgtggtgctgagaaaaatgtatattctattgacttggggtggagagttctgtagatgtctattaggtctgcttggtccagagctgagttcaagtcctgaatatccttgttaattttctgtctcgttgatctgtctaatattgacagtggggtgttaaagtctcccactattattgtgtgggagtctgagtctctttgtaggtctctaagaacttgctttatgaatctgggtgctcctgtattgggtgcatatatatttaggatagttagctcttcttgttgcattgatccctttaccattatgtaatgcccttttctcttttgatctttgtcggtttaaagtctgttttatcagagactagcattgcaacccctgctttttttttttttttgctttccatttgcttggtaaatattcccctatccttttattttgagcctatgtgtgtctttgcacgtgagatggatctcctgaatacagcagaccaatgggtcttgactctatccaatttgccattctgtgtcttttaattggggcttttagcccatttacatttaaggttaatattgttatgtgtgaatttgatcctgtcattatgatgctagctggttattttgtccttcagttgatgcagtttcttcatagtgtcaatggtctttacaattttgtatgtttttgcagttgctggttacccctcgtggagtttttaacaacccagggtagacaagacaaacctttagagaagcataaactttaagatgataattaacactgaatgttctctcttaggatttgcaaagaagccagtgattggtgaggacagtgattgctggcagggattcgacatttatgcagcctgatgttgtttttaataataatgtgaattttatcagcatacaaacttgctcacaatattgagacatacaaaatgggaaggcttctaaacaagctaaaatgtataagaaaactgttaactctaaaatgaatatattggagtttgttgaaatttctgcatttggttggaatcagtttcagaaggcttcatgaagttaaattttaatcagtgctttagggaagagacgagactgaaggcacagaatgaaaagaagggcattctatctatagtgggaaaaatatgcctagaatatattctgctcctctcctctctctcctggtcgacatagcaaactgctattcatcctgcaacaaatgatgtcaacaaagtggtcagggaagggataagaatgcagcttacacatatacatgtacagtaaactctagattcatatccttggacattatgtactggagtagagtatatgagtcaatgagtaatgagaataaaagtttagaatgggaaaaaaacgcatacttgatggtggtttgatatgtattaggagtttggattcatttgagaactgggagctgtattaagtttggagcaagttgattactctttagctgtattgtgtttctgtttattaagcttcaattttttttttttttttttttttgagactgggtcttgccttgccactcaggctgaagtgcaagtggcatgatcatagttcactgcagccttaacttcccaggctcaagcgatcctcccacctcaacctcctgagtagctgcaatcacaggcaaacaccaccatgcctggctaatttatttatttattttttattttttattttttgtagaggcagaatcttactatgttgcccaagctggtctccaactcctgggctcaagcggtcctcccatctcagcctcccaaagtgttgggattacaggtgtgagccattgagcctggccaactatcttttttaaaattagggcttgggttttgttggttcagctgttagcttgcaagaaatgcagaaaagttatgtcagtgtctgacaaatgttagcaattttgtaagtttgctaacactttggttatctaactttattcctatagttgtaaaaaagcactatgattaaaaactcctttattggcagtattctaaaacctcatgttaggttgacagtcttcttccctttccccaaattttaatacccaccccaggtttctaaagcaaaaaattgaagagcattttcctcctgtgtttataatcccaactaaaacactatgtaatacatgttggaaatattactgtgctttgtatatgtattaatttcttttgccctaaattggcctctaggaatgtgaaagtagatgtacccacctgataagaaaaagtgagctaagtaactaacttgataactaggcattcaacaagtctttttctctatttcatagaatcagtgtcaccttaaattataataggtttgcacagaattcgtgaattcttgagatagagtcttgctctgttgcccaggctggagtgcagtggcgtgatctcgttcactgcaacctctgcctcccaggttcaggcaattctcctgcctcagccacctgagtagctgggattacaggtgtgttccaccacgcccagctaatttttgtatttttagtagagaggggtttcgccatgttggtcattctggtcttgaactcctggcctcaagtggtgcacccaccttggcctcccaaagtgataggattacaggcatcactgtatctggctgaaattagtgtattctttaaagttcatatttttcattaattcacagaagaattgtaaaaaaggtaacacgcagttgacattccatttttccagaaagacagataattacatactgtagaggatgactcaaaagtctgtttcaagccactgacttcctaaactagtgaaggcctattcaaagtcacttaattcagctgtttttttttttttttttttgataaatacaaagatacatgtaaagttttacttacctgattttaaaaacaggctaccaaaatttatccaaatatattaaaaaatgagactgttttaaaaacctttcgtttccatattgtgactccactaagcgggtaaaaagttcaggacagagatggaaaggaaagaaggaaacaggaagaagtgaaactaggaaggtggtgccagtggcacatggatgaagaaagagagatcatcagccatggagaattttgtaatgtaagtagagagagagattgggtaggaagacaggcttcacagtttgtaaagtgtaagggaactacccatcgtaccctgtcattgactagggctgtgagttatgtagttctgtctcctcttgcaaaagacttaccacttctggcaagtgattaaccacttctggcaactcttcatttcttcttatccttgaatattcatctacatcactctaaacagcacagccccagaagcatggaaaggggagttattagtatggaaaggggagttactcttctggtgtagtggtccgattgagtccatggcttcccagccttaccagaggtgataaaaatgtcaattcctttggggccaatcttgctcctccagtgtgttttagccctaatgaggtcatggttatttctagacttctgagacttactgtggctttgaattgacacaaacactaattttctgtcaaaggctagagtgatggatgttatatgcctgaattttctttgaacattttattttaaaagagatactttgggcttttcatgaaactaaaattctggaaccctagagcagtctattatatctgtcaccacaaggactttccttaaaaagctccctccataagcacttggatgtgtaaacaagatcctttcacagatctttttctcttcctctccatatcccaacttgtcttggagactactttttgaattataaatccctttctgcatttctattattaatttttatttgtaaaattgctaaaatagctaaatttggccatttaacctgcatttaaaatctaggaatgtggggtgatcatctttgtacataaattacctaatgaccctgtccatgctgtgctacgtgtttaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaactgtgtggaaaaaatgaattttcttaaaacaattaagagccaggaactccactgagcatacagaccatctctggttaggttccaatccatttctaatgcctgctataaagctaggtactacacaaggtgtcagatggggttgccacaatgactaggacaagaatcctgtgtagagttcacctttgaaggtgagggatgtgcaggcatgtctctagtcctctagatgcaaacactatccttttacagttaggaagtgctcagtaaatatttgttgaatggaaccagtaaacatacccttgaatgagaagagaggttattttcacaaagccttgaaatttatttagagagttgaagctagtactgccacactagaatctgagtgtcaccagccagtacacctcagctcctaatttattctgcgtgggaatagcattcgcttccaatgccagaaatccctggtcttcagagcactctttcctttcaggccaggggttagtgtatagttttccaaccatagagaaagtacatgaacaccatgactgttacattttcatttatcaaagttatctgtcacaaagtaagttacttggctagaagagtcactgcattactggcattgtagaactgtgatgagccaggtactatgcaaggtgacaagtggggttaccacaatgattagaagagacatcagaaattctctaatctaactcactcttcttttatagatgaagctgagacccaagagtgggctgtgatacagaactcttagtcctgcgctgttgttctacgtcctacaacactgattatgcccagtatggatagaatatacatattagcttattcatatgcactatctcctattagctaaggcctcttctctgctgagttttaggcagaggcctaagtgctacaacagaaagtcctgcaacatatagtcaacttcagctatatatatacatatatatatatacacatatacacatatatatatatatacacatatacacatatatatatatacacacacacacacacacacacacacacacacacacatccatggataggagcaggatatcagtgcaggcacaacaaatgtgtgaataatcctaaatagtgaatagttatttttattcttgatacaagatcattttatttttgtataacttttttaggagttgggataaccttcctaattttacttgctaataatcctcatagtaaaatgagtaaattcataaatcatataccagatggcccagggaagcagcccatgaatgtgttaggtggcacttataaaaaggctttttgggaaaggataatcttttatagttatgcaaggaaatgatgtgattcactagattatatgtgtttggggatgagaaagattagaaaattaaggcagttttttaaaaaggaggcatgagatacagcaaaacaactggatggaaggcattaaaggcagagactggggggttttatttctattctggagaatgaaccagactccaggcctgtgtgcgcccccactgtaccccttgcttcctttccaaatagccaataaaaggctgcaatgaagtgtgtctgacaagcagtcccaatggcaaaagaatatcaagactgtttcaattatgtagaagaaatgtggaaaggctgcaaacagacactgacagtaaggtattaaggtgttataatagctttatgaaatattataggagaattcagagtttgataataggtatttgacagctttctacctcttagatagctttctgttctctgtagactcaagataacgttaataaataagtttaagactgcttaagtatggctctgttgttttttcctttttacaataaatcaagcaaggtgtttaatttctcagtgagtgtagcaaacacataaaccaaagtgagttcacaaaaacttggaagctgaggattatcatttaagagcaatataaactgatcttaaaaagctctaaaagcag

SEQ ID NO: 12759 - DNA, 9811 bp, Human
atttgtattaatcttggtaacaacaatattaaattttttaatatcaaagaaattctgctttcagaaaaccaagatttttatctaacaggagaattagtaggtatggaaatgtgacaaatttgtattatacttgtttatgtgaatgggtaagtagaagtgaagctggatatttagatgtacttattacggtgatcaccgttactgatggcaatggaaaatcagatttctttgcatttccccaggtaagacaaggtaagcagtttatatgtattataatttttaaagacagtacctgaatttgtatctactatgttgtttttcagagtgtcatgatcacgagggaaattcactacatgcctgcttgcaaatgatttagttgaaatgtacaatttcttctttaaagtatttaatacttcccagagacaaatcaattttaatttagtgatgagctgaaagggctggaaaataaactacaaataagctgaaatcatcagaattaagaaaaaatgaaacaaccttgtgctcagagtaactcaaaaaagttgttgtctaaaaaaagcatttttgttttagtgtgccccttattattgtggtattcttcatcttttattcatcatttctgttcataaatcaagccgcctttggttctatgtttaaactgcatctaaaatatatacaacaatttgtatgtattccatcatgattgcagaatctacagcacatttttcatgttttgttccgcgatcatcattacatgtgaataaaagacaaatgtagccaaatatttttgatatttctctcaatgaagaatgcctaatgtaaatctaacaaaatacagcccattttttaaatgacatttttttaatgatgacactcaaagaagcgcattcaaactctgagaaaagtgattattttgtaatgtgcacctttttttttctgctttatgtttcacatccaaagttgccttacattagaatagtttggcattttcaagaagtaaataaagtagatctcaagtttagttctcgaatattttcagaaatcctacaattttcatttgaacaataatgctatgaataccaggctatgagaagtttatgtggccacactagactgccagatcaatacacagatttggaagtagtggtgtttcttgaactgtgttctgctgattgcatatgtcagaatcactgttacaatgcatattcctcggttttctctgagactttttgagctaaattttttttaggtatggtacccagaaatctacaaacaacattttccccaggatacttgtgcaaaaaccactgcttaatactgggttggcttaatattgtgtttggcaattttcatggttatggagggagcaggcaatgatggataactgaaaacaggttgaaaactgttgaaaaatgacgtcttcttttgaaacctagaccaccgtatatttggccacctacatttaggtcgaagaaatatagtgtcctgctctacagtaagcagaattctaagatgactgcccaagaagcccactagcaggtatctacatcctgcattatctctaagactgtgagtataatggaccttacccccgtgattaggttatacatatgggacagctgatcttaagaaaaattatcctgggtgagcctacataaccacatgaacccttaaaggggaccgcagtctccctaaagtcagagatcaaaacatcagagagatttgacaagattctccattgctggatttgaagatgaaagggaccatgtggtgaggtacacaggcagccttaatgagtgaagagcagccctcagctgataggaagcaaagaaacagggacagcagtcatatgtccataaggaactaaattcagccatacacctcaatgaaatgtggaagcaaatgttttcccagagaccccaactgagagtgcaggtggccaataacttgatttaagcctcagaagactgtaagcagagaacccagtctcattccatgcctggacttctgacctgaaatctgtaaggtaataaatgtggctatttttttaacctgtcaagtttatggtgatttgttatgcagaaacagcaaactaatctgtacccagattacgcaaaagcaactctgcctatagtaattagagttataccaacagagctgctcttatgtatactttgatttccctgagtcgtgtatataaatgacattggaaactctcggtgttatgaaccagcagattttacatatcagagttaagttcatagagtcaccaagatctgttgtgaccaggttgaacaattcattaggaaatcattagtaggaagagcagagccccaaaatagtccaaaatttctcagtctgaagtgtttttaaagaactttatccaagatcatatgttacaatcaacattataaggtagattaatattttaattgctattaccaaagaggtataagaatttaattggagaagatggtccaagattgtgcactaaagctgccagcttatggtaataagacctcattctcagaacaattattttcctcaacaaagagaatctcatgattccatctatttagccaaaataaatcaagtttttatttttatgtgtccatgagcaacattcactttccattacttcttgtggtcacacaagcatttcattgaatatttctataaatagtttccacatgctcatgcctcctttaatgactttgcaattctaataaagtgattagaactcctcatccctgctgtggcctctgctaaacgatgtgaaaatacccctcctgctggggttatcccgccagcaaaatccaaatgacccaccaaaaagtacatctgttgtaatttgactttctttgcccttgttactttttcctgccattctataagatctttaatttttcccttggggctctaaatttctttttaattttttattcgtggagaagctcttgtacagataaaatcaggctgactggtctagttttcctctaactattggagctgtaatgtgtcactctctgaaacttcacagcttcctaattaatattctgctcaaacacgacagggttatatgatttcgtcttagacattcattaagtgttccattatgggtcccaaatatgctaattaacaagtgtacaattgtgatctcactgagagaaaatgttgcaaggagtctctgaaacagtcaataagattttggcaagtagttttgtcaaacccaggaggtaatttatagtggaagaacattgaaatacaaattgctaaatgttttgtaagtcttcgagaaatgttaaaaaccaagctgggtttggaggcaggctctttttgaactctctgacttatgggctccacacgggtaagaaaggaaatttagtgccttgctgattttgcctttagccttggccactggtagaagcacctgatcctactttgggaagtcagtcatttcccagtcggcatatggaacataatactgaaactacctcctgactccaggatatactggtggcccactcctagctaacagaggccacatagcactgaccatgtggggacacatcaccatttagggccagcaatagtccaaggactttcataaaaccattgggaaagaaaaactctctttttcctctgggatttccccaaggattgaaaaacactttaagatgctattgacccaatttgctctagggagtccttgctcaagaattataataacctaagggaaagcagtactgagaagaaagagagtgagtgagtgaccatttctttattccatcctttgaggccctacacctaatcattcatgaagctataccactcccagccttttcaattacttgagccaatcaatttcctttaatagttaagttcctttgggctggattttcaaacttgcaactgaaaggatctcactttataaaaagtctctctcacaaaaattaattcaagacactactctttgaatttagtaaaagtaacattataaactaatttactaacttaataatttttgaatggaatacaatcaaactcccaaaatattcctttggtggtcatattaaagttaaaccatttacacaatttaatttttttttttttttagtatttaaagatatttaatgatacagtctcattcattcttacaatgtcattttgagctagccaggggacaggtatgcttatctaataatataatagatttctcttgaacttcatgaaacatttcagtgaaggttaaataacaaagccccaggtcagctgtgtaagcacctagagaacacagtaattatttccctaatggtgtaggtagtatatcactgtggacatcagaataaagattacagcataaatttgtcacctttgagcaaccatgtggccaatgagaacttttgataaatataaaatgtacgtgatgcatgttatatatactatgtagatatttaatgaacacagtttaataaaagtccttctacttgtattttattatatgtatattacacaaaggcatataatttattaatacagttattaagtggtttctgtgtatatataattataaaatgaatatataaagtatatatgaaaatattaatataaagttaaaatatgctaacagtaaatttaagtattcccattatatttttttctcattatataaaaagtttttttttccccgctgtcaattaaatagcagcttttcagactccttagtaaagtaggactggggtagattttcccatattgttaaatatttttctcattaagaacaaaattatatcttaatattttaataaaatttttttctaaaatgtattatacacccttaccaatttaacttgctcttgatgactcattggccttctaatgagcatccaagttataaaattttaaatgcttcttctactgaagtatgtagagctgtttaaacatgaaatgctatactttctgagtttatgtgtccccttttgatagtttcctattttttattccttggagtttgtgcagctttgataaactcctttttacttgagtgactttgagtttctattcctcactaaatattgtaggggtgtttacaggatacattttaatatgtagccttaaaaaacaactacacgacccagaaatttcattcctagatataatcccaactgaaataagtataaatatgcctactgtaagatatgtccaaaaatattcagtgaagaaccattcatgatagctcaaaatgggagataacctcaatgcctatagtagaattggcaaataaattgtggtatattcatacaatggaatagtacacagtcatgagaacgaattaacggcacaaaataataaggataaaacgtcccaacaacatgttgagtcaacaaaattggacacaaaagagtttgatgggtggaggtttgcagtgactggaacaagaagagaaactctgaggtactggataccagtcatatggtgttcctcaatcttggtcttggctacaaaagtgtgtatatgttttgaaaagtcattgaactgtgctgtattttctgcatatattttatactttagtaaaagtttgctaaaaaagaagataaaaattaatataatgtatgcctttattgtacaccactttcaaagcacatgcattatctttcaaaaagcatgttatctcattttagtcatccatttatttacttgtttctttttttctttttggtcatgatctagccatcaggcaagggactaggaatattgagcacatattaagttagacataatcctacttgcattgagtttatagccacttctatttcatgcccatagcatttctgcaaggtaagtagagaatgtttgaaggtatggtcttttgtgtcatatttgtttgtttgtttaaatggaagacaactaagcatgtttatacacttcagagaaaaatccatttgagaggcagcagatgtactatgtgagagtgaagaaaagatttaaaagtgaaacctctgaggaggacagagaaaagaacccaaagcgcaggataaaggaagaaacactccaaactggaaattatcagaggccatatgctgttcattagcaggtcatggactaaagtccaacagcttgacatcccacctacatcaaatcaaatttttctgcatttttgccatttctagaatgccaacgaatcattcacacaccctttaaataacaacttttggtgccagatgcatagttcactattatctgttggtgattcattatatgactctcaaatgaagaggcattcaggccaacttgcatgttctaaaactatgatagaagtttttgctttttctgacagcttggagaactgcagcggaagagatggacaaattagtagtgtagaggatcagaaaagagaataatggcactagtttaaaaaatggaaggaaatggctgggtgcagtggctcacgcctgtagtcccagcattttgggaggccaaggcaggtggattacctgaggtcaggagttcgagaccagcctggtcaatatggcgaaaccccatctctactcaaagtacaaaaattatctaggcatggtggcgcacacctataatcccagctactcaggtggctaaggcaggataatagcttgaaccccagaggcaaaggtggcagtgaattgaggtcatgctactgcactccaaccttagcgacagagtgagactctgtctcaaaaaaaaaaaaaaaaaacaaatggaggaaatttctcttcagaacccattggtttggatagtgaatttctgaatatgttggaatttgtgatcaaaatccttcctaagatggagagacctcttgggccctgggatgagtttctttcatttgctagtccagtcgtgaagaagcacaagccaagatagaattaaacatctaaaatatttctaaggaggagtgcctaggaggaagctaagggagattggaagaatcaagaaactttaacgcaagtctgactcttgtaaaagagataagaaaagagtgaaagtagtgtggacaagtcttggactagtgcacaattctaaaaaagtttagtaatgttgatggggagtcctcaaactaaagttgtccatcatattagtccaacatcccccagtaatgagcctgccttagtgttcctgatgcactcagtcatcttctgggaacagctccaggaaattttgcattgtcaggaatgcagtgtggaattccagagtgcagcagctggggtaatatttgaattatcttctccccagttggagatcagagagaggcattatcatggccaccacacctcacataccatgaaattggcattttacagttaaatggagcattactcatcttgatgataatagagactgggattttttaatactgtatatcttcatctggactgcagatacgatgccagatagacagatacatagatagatagatatcaatttttactttatagatgtacaagtacctatctcagcagaagaggtggttactgtcaaaagttgtttctcccattattcattcagaaatatttgttgatcatctattgtatgcgtggtactactataggctctaggaatagagcagataaatagccatctatcatagagtttaagtgctatgtagtgataggactataaagaaaaataaatctggatacgaaaagcaagaatgatagtggcagaaagatgttattttagagagagtggtcacgacagttgtctctgataggtgatgttgggtagtgatatgagcaagtaatacacttccaggcaaaaagaacagtaaatgcaaaggttatgaggaggggtagtgcttgtcttgcttcaggaatagcaagaaagccagttgagagggaaagaggaagagcaagaacgctactttagagtaagcaagatggagagtagaaggaaatgaggtcagtaagttagaggacctgatcataggacttggttgccatggaagaagctgtatatttcttcttcctcttttttttttttttctaagagtttcgctttgttgcccaatgtggagtgcaatgatgggatctcggctcactgcaacctctgcttcctgagttccagtgattttcatgcctcagcctcttgagtaggtgaaactacaggcacatgccaccacctggctaatttttgtatttttagtagagatagttttttgccatattggtcaggctggtcttgaactactgggctcaagtgatccacccacctcagcttcccaaagtactgtgattacaggcgtgagccactacaccaggtcaaagttgtagatttcattctgaataacatgggaagtccctgaagagcttggggatagggaagtgataggagccgacacatgttactaaagaaataacactggtacctgtgtgaaaagccactgctttttgaaattttgaaatcatgttttttcagcttttcaatatctatctccctatgtcaattattgtctcaatcctatatgtgctgcctttctcatgggcttcttctcaacaggtcacacattcaaatggggtaactgaagaatatttaatgaaggaattgtatgtaagaacatgagcagagtaaaggaaaaccaacaaaagaaagaaatactccctggtccccacccataggcatgaaagaataaataaatgggactatgcaaactcacaagcttctgcatagcaaaggaagcaattaacagagtgaaaagacaacctacagaacaggagaaaatatttgcaagctagtcatctgacaggggattaatatccagaatatacaaagaactcaaacatctctacagcaaaaaacaaacaaacaaacaaacaaaaaagtaaaacacccaaacaatccaatttaaaaatggccaaatgatctgaactgatatttctcaaaagaagacatacatcaggccaaaaaatgcatttaaaaatgttcagtatcactcatcatcagggaactgcaaatcaacacaacaatgtggtatcatcttaccccatttaggatggcaattatcaaaaataaaataaaataaccacaggggcttgtgccttagtcccagctactcaggaggctgaagctggaggattgctggagctcaggggctcaaggctgcagtgagccatgatcatgctactgcagtccagcctgggtgacagagcaagattctgtctctaaaaatacaaataaaaaagacagaaaataacaaaggctgatgacgaggatgtggagaaaatgaaactcttgtacactattggtggaatataagttgttacagccactatggagaacagtgtgaaggttcctcaaaaactacaaatagaactaccatatgacccagcaatgcaactactggacatctattcaaaggaaagaaaatcggtatattaaagagaaatctgcacccctatgtttattgcagcactactcacagtagccaagatatgaaatcaacatagatgtccaacaacagatgaattaagaaagaatatttggtatatacaaacaatagaatactattcagccataaacaaaaaaaatcttgtcatttgcggcaacatggatggaactggagatcactaccttaagggaaataagccaggaaccaaaaattaaatacttcatattctcactcacatgtggaagaaaaaaaaaaaaaaacaaaactaaaaaacaatacccaccggtctcatagaaatgaaaagtagagcaaagaacactagagggatacagagagatttataaaaagatacaaaattatagctagataaaaggaataacttctagtgttcta

SEQ ID NO: 12760 - DNA, 96074 bp, Human
ataagagggaaacagggagtaggtcatttttgcaatagcctgtgacatttgtagggcagtactggcggggaataattaagtaaaattggctggtgctgtggctcatgcctgtaatcccagcactttgggaggccgaggcgggcaggttgcttgagcccaggaattcaagaccaacctgggaaacatagcaagaccctgtctcaacaaaaaagtaaaaaaattagctgggggcgcgatggggtggctcatgcctgtaatcccaacactttggaaggctgaggcaggcggattgcttgagcccaggagttggagaccagcctgggcaacatggtgaaaccctggctctataaagaatacaaaaattagtcgggcccagtggcgtgtgcctgtgatcccagctactcgggaggctgaggtggaaggatcacctgagccagggaggtggaggttgcagtgagtcatgttgtttgcgccactgcactccagcctgggcaatggagtgaaaccctgtccaaaaaataaaaaaataaagctgtggcagaatgtggagattcttggaagctggaagctctcatggggcatttggaaacctcacattgtaaataacggagtctttttatcagtttggcttccttagttttaggaaacaagaaataattatggctaactcaagtaaaaagagaaagagaagagaaaaaagacgtggagatagagagagagggagagagaggaaaagacgaaaggaaggaagggggaaaggagagaggaagagagaaacagagaaacagactgattagtgtattggatagattacataaccaagtgaccagtcaggaacccagcagctctgggggagctcaatgtgatgcattgataaacccgctcttaagagcactcgtttccagttactttctattcggtgggtctccagccaagattccaggtcccaggagaatctgactgacctagtgtttgcttccgcctttgcggtctgggttctgtgcttgcagctcattagaatacagggagcagagacaagcaggtagtttcccaaaggaagggatgctgagtagattaaaaaaaaagtgtagattcttcagtaaactatgggatggtaactatgcaaaacctaagatttcccttattcaaataaattatctttcatattagacatctaaatatgcactaatttagttaaacccctgggttagttgatctcatcacactgagctaacatttttgttgctgttgtttgcagtgacctgaagtttcttatcttcacaattgctttcctctcaaataattcccagattttaaatttttattttattttttctggagacggagtctcgctctgtcgcccaggctggagtgcagtggcgcgatctcagctcacttgcagcctctgcctcccgagttcaagcgattctccggccttagccttccaaccagctgggactacaggcgcgcgcccccacgcccggctaatttaattcccagattgatatccattgcttctgagatgggccaattatccttcggagaagacttaggtcgcctggcagaaaaagatgaaagaaatctaagaaaacgacgacactgagagaggagcctagcgaaccagcagagcgaccccaagccgcaattcccccttccgtggatcgattacgaaggcttcctggcaggagctctccagggctgccgacgtgagccgaactgcacattgggaactgtagttgagtgggaaagccgagaggcgggggccgcacacgcgtacaggggccccggtcaacaaagacgcgccgtgcgcgcgcgcgccggagaaaaacacgggaagacgtgcgcgtgcgcggccgccgctgggagccaccaggcggcggagaggacagcgacaggaagggaggggcccgagccaccgactgcaggaggagaaggggttgtgctcctggccgaggaaggagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaaggtaactagggggctgggggagggggcggcggcgccgggaagaaggcggtggggtcgccgggggagggcaacacctgcgtcccttttctgcgggaggggacggtgcacccccggaattgatatgccccgggagactgctttcccgtaggtcggagcctcatcttctagtattcttaaaacctctcccctttcagggcactgtagctgtcgactttgtttcagacaccagccttcccccacacttctgcatgacccaggtcactatgagacacccagacgtgttgatgacagtgacatttgtcctagagtgaccacactgatcctttctagcactgtgaagagtgtgcagcttcctctgaaccaaggtttccaaaaggttttgatattgaagaagcagtgccgccttactggcttttaatgaaagcagagtattgtagtgtcagaaaaaaagaacaaatggtgacaattttgaaagaaatagctgcatatgactgcagttgaatttgcatcattttaatcaagataatcattttatcagtacaacgattcctgaatactttttcaatgaagttatatttagcataaaacttttccccctgttgctttgattttaattaaaacagtattccaaagtagcctttaatttccaagttgaaatgtttgatgaatggattgcgtaaacttaaacataccactttacagtaaaacctaaaacaactatgtatgtttctgaatgaaagcaaggatactacatctttcgggtttcttttaagctaacttttttttttttttgagacggaatctcgccctgtcgcccaagctggagtgcaatggtgcagtctcggctcactgcaacctccgactccctggttccagcgattctcctgcctcagcctcccgagtagctgggattacaggcacgcaccaccacgcctggctaatttttgtatttttagtagagtagggatttcaccatgttggccaggatggtctccatctcctgacctcgtgatcggctcgcctcggcctcccaaagtgctggtaatacaggcatgagccaccgcgcctggccttaagctaacattttttattatatgtgccaggcattgtgctattagctttgcatgtgttatcttttttctttttaaaaaaaatagcaaccatcccagaccatgaaaagtgttatttaatcctcacaataactttgtgagatgaaggtattattggtatcagcattttagagatgaagaaaatgaggcccaaaagataaaggaggttattccaaacctgtgctaataatgaaatttcttttatggaaaataagtgaaattaggagaagtctaacttttacaattctccccttttatccttacttccagtatgctgagatcttgcttctccctctgccaaaaacacccacttttctaccacacctcaattagatactcacttgcattgtccattagtgaaaacagaaacaatctgcacttcattcatagtgtctgtctctactgccaactccaaaaactgttctagaatttcaatcttgttgaaacctgtttcctttgtggggcctgggagtgggaagtgggatataaggaaagaggcagttattcattgttttggacagtaaggaaagagtgacggttaagagaggtcaaggagggtgttaacatttaagaatactatgtgtttgtagaaggaaattttttgttaactgctccattcttttttttttttttttttgagatggagtctccctgtgtcacccagactggagtgcagtggcgtgatctcagcttactgcaacctctgcctcccagacgcaggcgattctcttgcctcagtctcccgagtagctggaaccacaggtgcgccctatcacggctggctaattttttgtatttttagtagagatggtgtttcaccatgttggccagactggtcacgaactcctgacctcaggtgattcgcctgcctcgaccttccaagtgcttggattacaggtgtcagccactgtgcccacccagcaagctccattctttatcacctcttaagaacatccaggatcccttggggagaattaaaacggttgcaaagttttagaatagaggaacatgtttaagcgtagatcattttttgggccagtcatggtggctcacgcgtgtaatcccaacactttgggaggccggggcgggtggatcatgaggtcaagagtttgagaccatcctggccaacatggtgaaatcccatctctactaaaaatacaaaaattagctgggcatggtgacacatgcctgtagtcccagctactcaggaggctgaggcaagagaagtgcttgaacctggaaggtggaggttgcagtgagccgagatcgtgccactacactccagcctgggcggcagagcaagactccgtcttgaaaaaaaaaagtaggtcatttttggctgggcacggtggctcatgcctgtaattccagcactttgggaggctgaggtgggtggattgcttgagcccaggagtttgagaccagcctgggcaacatagtgaaaccctgtctttgtgaaaaatacaaagattagctaggcgcagtggcaaatgcctgtagtcccagctacttggggggctgaggtaggaggatcacttgagctcaggttgttcaggctgcaatgagctgagatcgtgcaactgcactccgaactgggtgacaggagtaaaactgtctcaaaaaaaaaaaaaaaaaaaaaccaaaaaaaaaaaaactgttttaattgttttatttaggaagagaaagtcagaacatgcaaggaaattttttttatttgtttatttttgagacggagtctcgctcagttgcccaggctggagtgcaatggtatgatcttggctcactgcaacctctgcctcccggattcaagcgattctcctgcctcagcctcctgagcagctgggattacaggtgtatgccaccacgcccagctaatttttgtgtttttagtagagatggggttccaccatgttggccaggctggtttcgagctcctgacctcaagtgaaccgccctccttggcctcccaaagtgctgggattacaggtgtgagccgcggtgaccgaccacaaggaaattttagttaacactgttggttgatgggagttgggaggtaggataaaaggagaaattaaggaaaacctaggcatgaaaaataaaagaccctgagctcttagatttgaagaaatagcagttccatgtgaggaataagtggaagaaatagaattcagacctcaggtctcaggctggtgacttaaatctttcagtatcacatatatgaatatatctattatacttaaatcctcctaaacatttttatttttcagttggatatattaaatatataaaaataattatttaatttattttagagacagtgtttcactctcttacccaagctggagtggaatgtgatcatagctcactgcagcctcaaggctcattcctaggcttaagtgatcctcttttttttttttttgctagagataggatcttgttatgttagccaggctggagaaatttcaacaatattttgaacaataaaaaaaaaataaattaggttttattgtaaagtggtatgtttaagtttacgccattctcctgcgtaatgcatatttcatactcttcctactgataatgtttctgttcacaactttttctttatattttgatttcttttctcttttctttttttttttttttgagacagagcctcgctttgtcgcccaggctagagtgcagtggcgcgatctcggctcactgctagctccgcctcccgggttcacgccattctcctgcctcagcttcccgagtagctgggactacaggcgcccgccaccatgcccagctaattttttgtatttttagtagagacggggtttcactgtgttagccaggatggtctcgatctcctgacctcgtgatccacccgcctcggcctcccaaagtgctgggattacaggcgtgagccaccgcgcccggcacatattttgatttctaatgtggacatcagaatgggctgttgacagctcttttttttttttttgaggcagagtctcgcttcttcacccaggctggagtgcaatggcgcgatctcagctcactgcaacctccacctcccaggttcaagcgattctcctgcctcagcctccccagtaactgggattacaggcatgtgccaccccacacccagccaatttttgtatttttagtagagacagcatttcaccatgttggccaggctgttctcgaactcctggcctcaagtgatccactcgccttggcctcacaaactgctaggattacaggtgtgagccaccgtgcccagccttgacaggtctttagtttgattttagttcaacaactgatgccgtaatatgccaaattaaattagttcagactgaaacggattacttaaagattcattttcctttaaaaatgaagtaaaactttagccggatgtggtggcgggtgtgtgtaatcccagctactcgggagggtgaggcaggagaatcgcttgaacccaggaggtggaggttgcagtgagctgagatctcacccattgcactcctgcctgggtgagaagagtgagactccatcaaaaaaaaaaaaaaaggctgggcatggtggctcaagccgggtgcagtggcccatgcctgttatcccagcactttgggaggcagaggcaggcggatcacttgtagtcagaagttcgcgaccagcctggccaacatattagtgaaaccccgtctctactaaaaatacaaaaattagctgggcatagtggtgcacgcctgtagtcccgggtacttgggacgctgacgcaggacaattgcttgaactccagaggtggagattgcggtgggccaagatcacgccactgcacgccagcctgggcaacagagcaagactccatctctcaaaaaaaaaaaaaaaagaaaactgagtttatattgttatggttcttatctatcttaaattttttctttaggagattgaatatttttgtactttagtcttaatccagtggttgaaagagagtgcacttttgaagtctgcctcttggctgtccttgacaacacaaaccttagttccaagagaatgtaattcttcctctttctcagtgcttcaaaatatatatgatcaaatagaaacgagttgaataggcagtctcttcaaaggtttcctaactctgtggttaactatcaaggagctggtaatatcatgcactgccattcccttggcaacatgacttatcttttttttttttttttcttttttgagacagagtcttgctctgtcacccaggctggagtgcagtggcgagatctcagctcgctgcaagccccgcctcccacgttcacgccattttcctgcctcagcctcccaagtagctgggactacaggcgcctgccatcacacctggctaattttttttgtattttttagtagagacggggtttcaccgtgttagccagtacggtctcgatctcctgtcctcgtgatccgcccaccttggcctcccaaagtgttgggattacaggtgtgagccactgcgcctggcctacttatcttctaatttaactgaaaaccaatttatttgattcagtgaaatggcatcaaactgtagtagtgttaattgaaatatttggtaccttgaaatgttaaatgccaaattaaatctcattttaatgaaatctcgtgtaaatgtgttttatatggtgactatgtttattctgaattttattcttatggcatactaaaaaaaaaaaaaatttttttttttttttgtaatggagtcttgctctgtcacccacgctggagtgcagtggcgcaatctcggttcactgtaacctccacctcccgggttcaagcgattctcctgcctcagtctcccgagtagctggtactacaggcgtgcaccactatgcctggctaatatttttgtatttttaggagagacagggtttcaccatgttggtcaggctgatctcgaactcctgacctgaagtgatccgcctgcctcagcctcccaaagtgctgggattacaggtatgacccactgcacccaacccatactcaaatttgacactgaattttcataaaggccttaatttatctgaaaccaaactatttcaaaagaggaatagcacagcaaattctgttgacttaatgagaggatatgtgaagtctatttattaaagcaaatattaattggaggccagttaatttgtacagctctgcattttagatatttgagaaatatttatttcctctccagtgagatgtgttaaaacattagttatgtgattaacaaatatgtgtacatacgtatatatgtacatacacattttgagacagggccttggtctgttgttcaggctggagtgcaatgacaccatcttagctcattgaagcttcagcctcgcaggctcaatcgatccacccacctcagcctccctagtagctgggtctacagacatataccaccatgcttggctgattttttaattttttgtagagatggtgatcttgccctgttgactaagttggtaaatattttaattgttgaactttcttggaagactgaaaacctgtgatagccattttatataaggagaagctgaagttcaaagagtagactcatagcagaaacaaaaatagaatttaagtgaatggactcaaaatattgtactttttactttatactgcaggtttttatgttgtaatgctggtaatgagctccttggaatatttggaggaaaagagaaggttgtaataatggttctttggatttactagaacatatcatgttctgcatggctcctgtgggtagacaagccggaaatctcctgggtaacacaatggtggaggttctctaggtgacgtttgatttctcaagtacataggactaaacagaaaaggcctagtatgttatatgaatgagagatcaagtttctcaggatattctagggctaaaggatcaggcatcgaagacagaaattgtctaaataaaattttttctattcatagttttaaagggctaaagggtcaggcattgaagacagaaattgtctaagtaaaatatttttctgttcatagttttaagctgtgtatatgtgcatgtgtgtatttaaaataacttcgtcaatgaaaagagtcaaactctgtaaaatatttgaagagatttattctgagccaaatatgagtgaccagtggcccatgacacagccccagtagatactaagaacatctgtccaaggtggtcaggctatagcttgattttatacactttagggagacataagacgtcagttaaacatgtaagatgtacattggttccatctggaaaggcaggaaaactagaagttggggaggcttccaggtcgtaggcagattcaaagattttctgattggcaattggtcaaaagagcttatctaaagtcctggaatccatagaagggagtgtctggtttaaaataataggttgtagctaccaaggtttttattgtacagatgaagcctccaggtagcaggcttcagagagaatacattgtaaatgtttcttatgagactttaaaaggtggcagactcttaagttaattttctcctggttcaggtaaaagacttggaaagggaaaggattctctacagaacgtaaattttccccacaagagaaagctttgcagggccatttcagaatatgtcaaagaaatataatttagggtaaaatacttcaatttgttttatttatttatttattttttgagacagagtctcgctctgttgcccaggctggagtgcagtggcatgatctcggctcactgcaagctccgcctcctgtgttcacgccgttctcctgcctcagcctcccgagtagctgggactacaggcgctggccaccatgcccagctattttttttgtatttttagtagagacgggatttcaccatgttggccaggatggtctcgatctcttgacctcgtgattcacccgcctcggcctcccaaagtgctgggattacaggcgtgagccactgtgcccggcctcaaaatacttcaatttctttcatggcctgctatctgacgtgatgctgtactagagtcaggctgggaatttggcgtcttattgctacaaaacatcttaatatctctgttttaatgttaatgctgatcagttgtccctgaattccaaagggaagagggtatatgagtcatgtccaacccccacttctcattatggcctgaactagttttttaggttaactttggaatgcctttggcaaggggagggtccatgagtcagttgggggtcttagagttttattttttgcttaccggtttataaaaagttaatgaaaattatcatatttcataattctatataattcaatattgtactttatttaaaactcacgtataaaatagctgtccatatctgttttcagaagatgaggatggagggtagaaatcagaagtgtcagatttggtaattttcttacactgctgaaaacctatacctaccactttgaaaggattaatttcagacttgctttctttgggcctaatgattctactttgaagtttctctgattaaactaaggaataaatctgataaatggacattcagatgataccatacttttccaaaagataacattgcttttgattacatatgcaataaacatttcacattttttctcaagattatttactggcatctgcaccaaagacacaaaaaagcagccactgttaaggactttatcccttgttctgtttttagctggtttgttgttgtatttttcctcatgttgaatacagttaaaccctattaaactggattccccatattactgttagttgtcctgatgacaattaaggatagttagtaaatggatattgaatcattttatttttttagtagtgatggcgtttcgctgtgttggccaggttggtctcgaactcctggcctcaagtgatctgcctgtgttggcccctcaaagtgttaggattacaggcgtgagccactgcacctggctggatattgaattattgaagaaggatgttccctaacacttcctgcctcttttccgctgtcttactctctctgttccacccagtagtagttgggtttttgatgtctggcaaagtatagattgtctactcttctatattagttttcttcactcttttttttaaaaatgtttttaaagcaagatagagacagggtcttgccgtattgcccaggctggtcttgaactcctgagctcaagcaatcctcccacctcaccccataaagtgcggagattacaggcatgagccaccatgcctggccagttttcttcactcttgacctataatagtcctgcaaagccagtgaagctgttaatatgctgacgtagcctttttttctctcgtttgtgaattattaacaatcgctgatcttacacatcatatacaataaaacatctttgaacactgtcacatctcagcagctcattctggttaatgaggaaagaaaaatgtcaaaatctgtgattttcttagaggttattaaatgttttacagctatgtagatattctgtagacttgctgtacttacttacataacttttctgctcttctgcagagggagagaattaacttcataagtgggctttgtcaatgccctccagtcagcgatctccaggaacaaacttatctatggttgagcaagtggggtttattacccactgtagccagggagaacacacatatgtaataaccatggtatgtcatagtaaagggtgttaggaagataggatttgggctcgtttatttggtgattttaaggagggtttaaagaagcagggttttgctctgatttggatgctaccaggagctgcgaataattctatgaataaatatcataaaacctatctagaagaaaagactagagtgaggtctaaagctgtagtagttaaaaagcaaaggtcactccttatctggaaaaggggaatatttggtatttcatggtttagacagtgttcagtgttcatgttttgcctgtgtttagacataattgtagagtggtcttgttccaccgtggtcacagagtggcattatttcatgctgatattctgtaagtgccaggtcaaataccaaggtttagctgatagtagtaggccagctcctggatgtaataagctgtttttctctttctcagcttttttttttgttgttttttttttaaaatagagtctggctctgtcacccaggctggagttcagtgggggcaatctcagctcactgcagcctctgcctcctggattcaagcgactctcctgcctcagcctcccaactagctggaattacaggcgcaagtcaccacacccggctaatttttgtatttttagtagagacggggtttcaccatgttgagcaggctggtctcgaactccggacctcaagcaatccatctgcctcagcctcccaaagtgctgagattacaggcatgagtcactgcacctggcctgtttcttagatttgagggtcaacttttacccttttcgaactgtggggcttcttatggaaattgacatttaagtcctgaccatataggatcttgggcaagttacttaactatgtatgctgagatgtttttttaaatgcttagtgcttgcacataataggtactcagtaaatgagaactattattataaaatcaatagtacttttaagattacagctagaggttatgttagaacattgttaactcttcgtactagtttctgttacactttttaggatgcagtagcagcataaacgagatatggggaagaacgagaggtatttaaacagtgatataggccgggcgtggtggctcacgcttgtaatcccagcactttgggaggctgaggtgggcagattacgaggtcaggagattgagaccatcctggctaacacggtgaaaccccatctctactaaaaatacaaaaacaaaattagccgggcgtggtagtgggcgcctgtaatcccagctatttgggaggctgaggcaggagagtggcgagaacccaggagacagagcttgcagtgagccgagatcgcgccactgcaccccagcctgggccacagagcgagactctgtctcaaaaaaaaaaaaaaaaaaaaattaaaacaaaaatatttgtgttaattgtgatgacaaaaaaaaaaaaagagatggaagtctctccctaacctcactcctcatttagtgtcatggcttttttcttttttttttttttttttttgagacaaagcctcactctgtcacccaggctggactgcagtggtgcaatctcagctcactgcaggctctgcctcccagattcaagcaattctcctgcctcagcctcacaagtagatgggactacaggcacatggcaccatgcccagctaattttttgtgtagtttttagtagagacagggtttcactatgttggccaggctggtctcgaactcctgagctcaagtgatcccccctccttggcctcccaaagtgctgggattacaggcgtgagccctgctcccagactcctggcttttttttttttttttaatgaaaaattcaaaatgctcttttttttttttttttttttttgagacagagtctcgctctgtcgcccaggctgaagtgcagtggtgtgatctcggctcactgcaacctctgcctcccaggttgaagtgattctcctgcctcagcctctcgaacagctgagattacaggtacgcgccaccacgcctggctaatttttgtatttttaatagagatggggttttgtcatgttgtccaggctagccttgaactcctcgcctcgtgtgatccacctgccttggcctcccaaagtgctaggattataggcgtgagtcgctgcacctggccacagaaattttttgaagaagataaataaggtgacatttttaagggtcaaagaaaatgtcaaaaactagaatgatgtctttacatagggtttaaaactttccaaattaacagggaaaataattctttaccttgaaaataaatgtttgctagtgaaagcaaatacaatctttttactaaatgttttattaaatttttttttcttgtagacacagggtcctactgtattacccaggctggtcttgaatgcctggcctcaagcaatcctcctacctcagtcttccaaagtgctgggactacagacatgagccatcacactgggtcttttttaccaaattatagtagaaagcactttttctctaatagtgaactatgagagaattaatcaggggctattagtaattcatccctgaattaatcagtgattataatgctttgtggtccatgtagtttgctggggattaacacaccatgaaagtctaccaggagatttttttttttctttgagaacaggggccataatcagtagtccttaaatgaaatggactattcccatttcattatatgttgcctaggctggactcgagctccttggcttaagtgatcttcccacttcagactctcaagcagctgggactataggtgtgtgccaccatacctggcttaattgagtgtttgttttttgtttttttttctgagacagagtctcgttgtgtcgcccaggctagagtgcagtggcacaatctcggctcactgcaacctctgtttcccaggttcaaacgattctcctgcctcagcctcccaagtagctgggattacaggcgcctgccaccatgcctggctaatttttgtatttttagtagagatggggtttcaccatcttggccaggctgatctcgaactcttgacctcatgatccacacaccttggcctcccaaagtgctgggattataggcgtgagccaccgcgcccggctttaattgagatttttagatatctattactctgctaattttgtcacttgcaagttgccatcagaaaattgtaggaaaatggatatatttgttccttggaatggtttgtgtgagaatacttaaggattaaatagataagtaaaactggtgggctttatataacatagatgagcaaatgtcaggaacatacaactgtgcacacagttcaggagaaggaggatttaagttaatcaacaaatttactaagtataataaagatactaaaagtagtgtttccataccactttattacttaaagtatcatcatataccctattttatatgatttttgccacaagtcagagttaggtaaaagaaatacttgcttttcaggtaaggagtttgacgcccagacagattaactgacttttccaaaatcatattgctattaaatggtggaacaaggacttaaatctttgccttctaactcacatacttgcaaacacatatcctctcactctaccccaagctacccatgttttgacccttcttgtggcaatctgggtctcactaatatttgaaagaaaacgtacagtagataatttgcaagttaatctgttacgcatatctcttacctctatttaaagatgaatatcagcatttctgttgtttctacagtaacatactaaaaaataatgcagtccaggtgcagtggctcacacgtgtaatcctagcacttttggaagttgaggcaggaggatcacttgaagccaggagttcgagactagcctgggtatgcaagaccccatttctgttttttttttttgtttgttttgttttgttttgttttgtttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccccatttctttttcactgcaacctttgcctcccaggttcaagtgattgtcgtgcctcagcctcccaagtagcttgggattacaggcatgtgccaccatgcctggctaatttttgtattttttggtagagatggagtttctggccaagctggccaggctggtctcgaacgcctagcctcaagtgatctaccctccttagcctcccaaagtgctgggattacaggtgtgagccactgtgcccggccccatttctacaacaattaaaaaatattagcccagtgtagtggtgcatgtctctagtcccagctactcagaaggctgaagtgaaaggattgcttgagcccagaatttcaaggctacagtgagctatgataatggcattgcactccagcttgggtgacagagtgagaccctgtctctaaaaaatgaagtaaaatagtgcacaagtatagaacttgaaaatcttccttaaccttaccataagggaaatgattactaataagtttcttaactttttgtacttacataaacataaatattcatcagagaaaaaaatatgcaaaacaatttgcaatctttttcacttaccatattttggaatttttttcatttcaatatatttgatcttccttgtgttttttcagtttgtttgtttttgtcacccaggttggagtgaagtggtaagaacatggcttattgcagcctcaatctcctgctcccattcagcccctcaagtagctgggactacaggtacatgtcaccacgcccggctaatttttatttttattttggtagagatggggtttcaccatgttgcccaggctgatcttgaattcctgggctcaagtgacccgcccacctcagcctcccgaagtgttgagagaacaggtgtgaaccaccatgctccacctcttagtctttacaatctgcaaaacctcataagtggctaatagaggaatatagtaaagcaaagggggatatcactgattagaactgtgtttttaggctgggtgcggtggctcacgcctgtaatcgcaacattttgggaggctaagtgggagtatcacttgagcccgggagttcaagaccagcctgggcaatatagtgagagaccctgtctttagaaaaaaattaaccaggtgtggtggtgcacacctgtggtcccagctattcaagaggctgaggtgggagaatcgcttaagcctaggaggcggaggttgcagtgagatcataccactgctctctagcatgggtgacagagcgagacccagtctaaaaaaaaaagtattttttcgtttttttccaactcatgtacacccgccaccccacccctgctttttttttttctgacattgggtcttgctctgtcacccaggctagagtgcagtagcacaatcaactcactgcagcctcctcttcctggactcaagcagtcctaccacctcagcctcccaagtagctgggaccacaggtgtgcaccatcatgcctggctaatttttgtactttttgtagagatagggtttcaccatgtggttcaccatctctaactcctgggctcagtcagtccacttttgcctcggcatgagccactgtgtgcagcccacgttttttattaatggatatttggattgtttccatctattgtgaataatgtggctatgaacattggtctaaatatctgtttaagtcccggctttcaatacttttggatatatacctaggagtagaattactgaattatatggtaactttctgtttaaatttttgaactgccaacctgttttccataggggctgcaccattttgcattcccaccagcagtgtacaagggttccagtttctccacatttgttatttttcattttttaaaataatagtcatcctaaagggtatgaagtggtatctcgttgtgattttgatttgcatgtatttttctaatgacttatgatgctcagcattttgtcatgtacttatgtaccatttgtgtatcttctttggaaaaatgtctattaatgttcttttcccattttttaattgggttgtttttatgtttatcaattttgtaaacattttaagctctgcagcataactactcaaccctgtcacatggtaagattgacccagtaaaactttatgtacaaaaataggcagcttactagatttaatcttagtccatagtttgctaaggcatgcattagataatgtagttacactattggctaatagttacactactataatttaaactacaagtggttgtaagtttctgccacccaaattctttcttgatttgatgtagtctggttggttgaatttgagtgttatatggggtcatagagttaaaagagaaatgtctatgagaaactagggactgttgggagctaatgttaaaggattttggaggccttttgtgcactggagaccattggaagattggattttctgctataaatgtatctaaaggataatcagtgtaagttatgggctgtagtttgccaacccctacattaagggattgaaataatttgaatatgggtttcagttcttgtatggtctggctcagttctttttttttttttttttttttttttttttgagatggagtctcactctgttgcccaagctgcagtgccatggcacgatctcagctcgctgcaacctccgcctcctggcttcaagtgattctcctgcctcagcctccagagtagctaggactacaggcacgtgccaccacatctggctaatttttttttttttcaagacagagtttcgctcttgtcacccagcctggagtgcaatggcacgatcttggctcaccgcagcctccgcctcctgggttcaagtgattctcctgcctcagcctcccaaatagctgaggcaacaggcgtgcgccaccacgcctagctaatttttctgtttttagtagagatggggtttcaccatcttggccaggctggtctcgaactcctgatctcatgatccacccgcctcagcctcccaaagtgctgggattacaggcgtgagccacctcacctggcgtttttttgtgtgtgttttcagtagagatggggtttcactgtattagccagaatggtcttgatctcctgacctcgtgattcacctgcctcagcctcccaaagtgctggaattataggcatgagccaccacgcctggctgtggctcagttcttaactgttcattcattcagggtcccagccaaaatcttttgccacagcttctcctgggcatgctctgaaattcattttttgtctgtttagttgcatgagtccactgaaagctttgcttattttctccaccactttcagagttcacagtcacttcaagtagacgaggtcaggagatcgagaccatcctggccaacatggtgaaaccccgtctctactaaaaatacaaaacttagctgggcgtggtagcgtgtgcctgtagtcccagctactcaggaggctgaggcaggaaaattgcttgaacccgagaggcagaggttgcagtaagccgagatcataccatttcactccagcctgggcgacagagtgagacactgtcaaaaaaaaaaaaaaaaaaaaaaggaaagaaaagtgctccaaatgctgggctcatctctgctggcttctctcctttttatatttcgataatttttaaaataataaccatcctaatgggcttgatatggtccctcctttctaaattttggtaattttcattgttttggaaactcactaatcccttcaaacagatgtttttaaaactttttttctagttctctctctttttttttttttttttttttttgagacagggtctctctcagtggtgcgacctcccttactgcaacctctccctcctgggttcaagcagcgattctcctgcctcagcctcccaaatagctgggagtacaggcacccacccccacgcccagctaatgtttgtatttttagtagagattgggtttcatcatgttggccaggctggtctcgaactcctgaccccaggtgatccgcctgcctcagccttccaaagtgctgggattacagccatgagccaccgcacctggctctagttctcttctaatcttactatagtaatcaaaattttagtgctgatgttataatccaagcccaaatggatattcttatacattaaatgttggaatatcatgtttgttaaaaatcagatctgctgggcacggtggctcaatgcctgttatcccagcactttgggaggccgaggcaggtggatcccctgagatcaggagttcgagaccagcctgaccaacatggagaaactccgtctctactaaaaatacaaaattagccgggcgtggtggcacgtgcctttcatcccagctacttgggaggctgaggcagaagaattgcttgaacctgtgaggcggaggttccagggagctgagatcgtgccattgtactccagcctgggcaacaagagcgaaattccatctcaaaaaaaaaaaatcagatctgtccctatggttttatcttcactgcatgtcatatataaatggaagcatgtagtatgtagccttttgtgtctcgcttctctccctttgcataatatttttgagatttatcccttttcctacatatgtcagtagtttgtttctttttaatgctgaatagtattccacgtgtggagataccacaatttgttactccattcactaaatgatttgggttgtttcctgtttttgttattgttgttgttgttgtttaattaattaattaattttttttttgagatggagtcttgctctgttgcccaggctagagtgcagtggcgcaatcacagctcactgcaacctctgcctccccggttcaagtgattctcctgcctcagcctcccaagtagctgtgattacaggtgcccgccaccacaaccagctaatttttgtatttttagtagagatgggatttcaccatgttggccaggctggtcttgaactcttccctccttggtctcccaaaatgctgggattacaggtgtgagccaccatgcccatcctcctgtttttaaattttatgaataaaggtactgtaaattcatgtacaggtcttagaagtttgcatttttcttgggtaaatatgtagaagaagagattgttgactcatgtggtaaatatatgtttaatgtcataagaaactaccaaactgtttttccaactgggtgccattttgtttcctaccagcaaacataatgaaaggtccattaccctttgtctcgtaatattttggtatttttatgttcttttgtttttttgccattcaaaattgggtgcattgttgtatctttggattttaatttgtacttccctaacaactaatgatgtggagcatctttttatatgcttacttgccaattatgtcttaattctttggcaatacttatatttgactctgcctactatatatatatatatatttttatgctatatatagaggatatatatttttatactatatatatttatatatactatatatatatatatatatatatatatttttttttttttttgagatgaagtcatgctctgttgaccaggctggatgcagtggcatgatcttggcttaccgcaacctcaacctctgcctcccaggttcaagtgattctcctgcctcagcttcctgagtagctgggactacagacacatgccaccatgcccggctaatttttgtatttttagtagaggtggagtttcgccatgttgtccaggctggtcttcaactcctgacctcaggtgatccacccgcttcagcctcccaaaagtgctgggattacaggcatgacccaccgtgcccagctggaataagcaatcttaaaaagcagtttgttgatttctggtgaatagagaaaatgtgacaaactatgactcaatagtttcatttcttttttgtttgtttgtttgtttttttgagacagagtcttgctctgtcacccaggctggcgtgcagtggctcactgcaagctctgcttcctgggttcacgccattctcctgcctcagcctccggagtagctgggactacaggcgcccgccaccatgcctggctaatttgttttttgtatttttagtagagacagggtttcactgtgttagccaggatggtctcgatctcctgacctcgtgatccacccgtctcggcctcccaaagtgctgggattacaggcatgagccaccgcccctggcctacttttatttcttaagcatatatcttaaagaaactgcaggtatgcattaggggacaggtagaaaaatgttacagcattgtttgaaatgttgaaaaactggaaacaacctcaatatcttaataatagaaaaaatggttgaggctggctgtggtggttcatgcctgtaatcctagcacttttggaggctgaggcgggcggatcacctgaggtcgggagtttgagtccagcctggccaacatggtgaaaccccgtctctactaaaaatacaaaaaattaggcaggtgtggtggtgcacacctgtaatcccagctacttgggaggctgaggcacaagaatcacttgagcctgggaaatggaggttgtagtgagccgagatcatgcctactgcactccagcctgggcaatagagtgagactccgtctcaaaaaaaaaaaaaaaaaaaaaagggaaggagcatgggaatgggaagaggcactaaaaaaggaacttcttttgtatctgttacattgtactcattttgtttttaaaattttaagccaaatatgacattgttatcacttttgttgccactcagaatacaagtgctattacactattttctataattttccctttttcaaactaaaaaacaaaaatacatgtaaacaggtgttttctttatggaaaacaggaaggtgagcatccaaataattttagttaatttataacaaactcttaataatttctttttcttcttcttctttttttttttttttttttgagtcagggtcttgctcttttgctcaggttagagtgcaatggtacaatctggtacaatcacatcttagtgcaacttctacctcttcagctcaagtgacctctctcctcagtcccccaagtagatgggaccacagatgtgtatccccaatcatggttaatttttaaattttttggtagagataaaatctcaccatgttgcccaagctgggcttgagctcctgggctcaagcagtcctcctgccttggcctcccaaagtgctgggattataggcgtgagcaaactgtgcccagtcttcataaacttttctttacatgtccttatcaagtactttttgagcacctactgtcaaccagccgtagtatataatactgataattctataacataagaaattgacctgtttaaggggatgaatatggttagttattttcagggtgaagaaacagaagaatcggggaggtagtacatagtcataaggagacggcatttcttagtcactttgtgtggtgtttataataagacttcatgtggccaggtgcggtggctcgtgagcgcctgtaatcccagcactttgggaggccgaggtgggaggatcacaacaaggtcaggagatcgagactatcctgaacaacatggtgaaaccccgtctctactaaaaatacaaaaattagctgggtgtggtggcacgtgcctgtaaccccagctactcgggaggctgaggcaggagaatcgcttgaaccagggagtcggaggttgcagtgaaccaagatcgtgccactgcactgcagcctgggctacagagagagactccatctaaataaataaataaataaataaataaatagacttcgtctgtttcatcaagagtcattgtattatattgattttgaaatttcaaataataataaggaatagtatggaaatttttgtttgattaaatggggacatgaggccaggtgtggtcactcaggcttgtaatcccagcacttcgggagaccagggcaggaggattacttgagcctaggagttcaagaccagcctgggcaacatggcaagaccctatctctacaaaagaaatacacaaaaattagctaagtgtggtggcacatgcctgtagtcttagctactcgggaggccaagggaagaggatggatcacttgagcccaggagttggagggtgcagtgagctaggattgtgcccctgcactctagtgtgggtgacagcaagactctgtttaaaaaaaaaaaaaaatgaggccgggcgcggtggctcacctctgtaatctgagcactttgagaggccaaggcgggtggatcacctgagttcaagatcagcctggccaacatggtgaaaaccccgtctttatacttaaattacaaagattagctgggtgtgatggtgcacacctgtaaccccagctactccagaggctgagacagcagaatcgcttgaacccgggagggggaggttgcaatgagccgagattgcaccactgcactccagcctaggtgacagagcaagactctgtctcaaaaaaaaaagaaaaaaagtctaagaagttaattttcattcagacaaatgttcaaaaataatagaaataaaacaaaaaattaattttcaaatatgtgatttgagtataacgatcactttacagaagttattctacatactttttgattatgctgagtttttaggtccttttaaagcttaacttgtatcaggaattaatgttttaaactagttgttgggttcaaagaaaatagaaatgtgttattaaatgccacacttgtaatctcatacagcagttctcatgatgcaatcaattgttaaataaaaacttcctctagagaggaggtacccagcaatgaacacattatatcagatttgaatatgagattaaacaatgctttttgtttcattgttattgaaatcatatttgtatttttcaaaagtatatatacttaaaaattcctaaataaaatgtctttctgtaatacagcattttaggttataaggatcaataccatgggctgataagcaaaataggactcacggccccaaaatgttgataaacatcatgaccatattccccataatggagttacatatacacattacaatgataaaaatactaagaagttatatagtaatgtttctcagacttgttcacaaccctgttttttatgtattacctctcaaaagcatgatttgcaatatttagtgtactcttcatacgatctatacaaataattttttattttaaagcaggacagaaggagcaagctgtggaatggtataagaaaggtattgaagaactggaaaaaggaatagctgttatagttacaggacaaggtaagattgtatttgtttatagccatcccaaattatgatatattcacatgattgtccagatttcagatctatttatttatttatttatttttctttctttcttttcttttcttttcttttttttttttttttttgagacagggtctttcctctgttacccaggctggagtgcagtgatgtgatcatagctcactgcaacctcaaacttctgggctcaagtgatcctcctgcctctgcttcccatgtagctgggaccacaggcgcacactaccatacttagctaattattattattattattattattattactagtttttgagacagagtctcgctcttttgcccaggctgtagtgcaatggtgcaatctcggctcactgcaatctccgcctcccggattcaggctatttattctcctgcctgagactcctgagtagctgggattacaggtgcatgccaccgtgcccagctaatttttgtatttttagtgaagatggggttttgccacgttggccaggctggtttcgaactcctgatctcaagtgatctgcccacctcagcctcccaaagtggtgggagtacaggcatgagccactgtgggccacacttagctaattaaaaaaaatttttttgtagagacagggtctcactgtgtttctgtgactgatcttaaacttctggcctcaagtgatcctcctgcctcagctttccaaagttgtgggattacaggcatgagccactgtacccagccagattgtatttatcttaataaatgtatttgggccaggcacagtggctcatgcctgtaatcccagcactttgggaggccgaggtgggcgaatcacctgggatcaggagttcgagaccagcctgatcaacatggagaaaccctgtctctactaaaaattcaaaattagccaggcgtggtgtcgcgcacctgtaattgcagctacttgggaggctgaggcaggagaattgcttggacccaggaggcggaggttgtggtaagccaagatcgcgccattgcactccagcctgggcaacaagagtgaaactctgtctcagaaagaaagaaaagcaaaacagtatttcatttaattaaaaatgccttgtattataccagtaagagtaaaaaacaatttaattaaagtatgatatatgctcttttcatcacttagaatttgaattttaatcttattgaagaggctgttttagttttatttagatatggttataacaacaatattaatatctgtgaccaaattggtgcatgcatgggcaatgaaaagctatgttgtgactgcagcatggtggatagcattagtaagttagcattggttgtaaaatgaatcccaatttcaaagattttgaaacgtggggaaaaaatattttagaccccatgaaataagacctgaaatctatgaaataccacagtaggttggaaatcatcatgagaaactgtaactatttttttttataggtattatatgtattctttgagacagggtctcaccctgttgcccaggctggaatgctgtgatgtggtcacctctcactgcaacatccacttcctggggctgaagtgatccttgcaactcaccctcccatgctcggctaattttttttttttttttttaagtagagaccagatctctttatgttgcccaggctggtcttgaactcctgggctcaagtgattctgctttgtctgcccagagtgctgggattacagaagtgagccacaacacctggcctaaagatagtatttttaaaatttcttctgttttctttcttttgggtatacattttcttctttttttttaaaaaaaatttctgtataaagactgtgactccccatgaaagtagtttgggtgataatttatcgtgaaacaatattagttgggaaatgtagatattttaattaatttttttctttcaggtgaacagtgtgaaagagctagacgccttcaagctaaaatgatgactaatttggttatggccaaggaccgcttacaacttctaggtatcaattaatgtataatttgatgtgggatgtattggaaatgtgtgttcaatgaaactttaatttgtagaaagaaatagatcagtgattgaaaatgtggtccaggctttttaacataaagaaaacgtataacatatacaaaaacagaagagcataatggacttctttttttttttgagatggacgcttgctctgtcacccaggctggagtgcagtggcgtgatcttggctcactgcaagctctacctcccaggttcacgccattctcctgcctcagcctcctgagtagctgggactacaggcacccgccaccacgccccgctaatttttttgtagttttagtagagacagggtttcaccatgttagccagaatggtgtccatctcctgacctcgtgatccacccgcctcggcctcccgaagtgctggagttacaggcgtgagccaacgcgcccagccgagcataatgaacttctaattattcttctctcagctttgataattatcacctcactatcagtcttgatttatttataccaagggctagcaaactgcagctgatgggccaacccagctcactgcctattactataaataaggttttattggcacacagccattcctttcctttaggtattgtctatggctttcatgctacggtgacagaattgaatagttgatacagagacaacactgccctcaaaacctaacatatttactgtctggccctgagaaagcctgccatcttcacttgacatcccacttcactgtcccccaacttcttattattttgaaacaaattattgacttattttccatttataaatatttcatattatacctctaaaagataaggatgtcaaaataaaatcacagaaataccattatcacacctaaaaaataactccaaatttcttttaacattatccaaaaaaactgacccccccaaaatgcaatttccaaatttctaattttctcaaaatttaataatttttactattttttaataatttgtttgtatcaggatcttaaaaagatccgtatgtctcttttaatgtacaggttcatctgtttttcattttcttccaatttatttgttgatgaaaccaggtctttgtcatgtaatatttcctacagtctgacttttgctgcatgcatcttttgtggtatgttttaacatgttcttctttcctcccacgttaaatgatagttggatatagagccttgatcacattgaaagttgatttttattttttaatgattagactacttcctaggtggttgtgtttgtgtgttcatcattagttgttccatcttgtgaggttagcagcagttaactatgactgatgtccagtgatactttaattctgtcattctttcagcattcatcaactgtaatagaaacttttacttgtcttctgtttgatggcgtaggttttaaatatatattaataagttaaatctaccactcaaaaaaagtagaacaaaacctactacatatgagtggctctaccatacgttggtggatggaaatagtagatatttggtaagcaggtaaaccttatttatttgtagccctgtgacttggggtaagttattttgcatgtctgggtcttttttatctaatttgtaatatgaagctattattattattattattattattattattattattattattattattattcgagatggagtcttgctttgttgcccaggctggagtgcagtggtgcaatctcggctcaatgcaccctccacctcctgggttcaaactattctcgtgattcagtctcccgagtagctaggattacaggggcctaccaccacacctaatttttgtatttttagtagggacggggtttcaccatgttggccaggctggtctcaaactcctgacatcaagtgatccatccacctcagcctcccaaagtgctgggataggccgggcacggtggctaacgcctgtaatcccagcactttgggaggccgaggcgggtggatcacgaggtcaggagattgagaccatcctggctaacacggtgaaaccccgtctctagtaaaaaaatacaaaaaactagccaggtgtggtggcgggcacctgtagtcccagctacttgggaggctgaggcaggagaatggcatgaacccaggaggcggagcttgcagtgagccgagatcatgccactgcactccaggctgggcaaaagagcgagactctgtctcaaaaaaataaaataaaataaatagataaataataataataaagtgctgggattacaggcatgagccaccacgcccagctgaagctaatattattagctaataataatatctcatatttttgaccattgaattattaaaggaacctaaaccatagtagtaagtgctttaaaaatgttggtttttatttatctgtttacctgactgtcatcacctcctttgcttaggtagaaagatatattcataaacacatacatatacattttattcattctttaattcatttactcctatatggtcattgtgtttgtgggatttttgcccgcacatagttaaaaatgcagccgttactgctttcagatgagtaacaaggtagtgttccctggcttctgtggctgacaggatttgccttcttcctttctaaatggaggttattactgtgtcagatataattaaatagtgtattaaagtttgttgcaataaaataattgatggttctaattggtactttctacgtgttttatctttaaagcttttcagtgtatatataaagtatatatcatacagaataaatttgattgtggagcattttgtaacatctttcaaaattaataagagttggtttttatgttttgtttgatgttatgatataggacattagaagtattaatatcaattagagactcatctttgaatgtgactttgtactttcttatttgtgttagtagaggagagaacaaaaagaagatatgtaatgtaatatgaaactaggcatttaaagatttaacgttttggatattttaaagttggtgtctgttttcaccctcaaaaatgctattacctatttatgaaatatctttaaaagtgtggagtggtagatgggaaaggtgacatcggctgggcgcggtggctcacacctgtaatcccagcactttgggaggccaaggtgggcggatcacctgaggtcaggagttcacgaccagtctggtaacatggtgaaacctaatctctactaaaaatacaaaaaattagccaggctggtggtacgcacctgtaatcccagctactcaggaggctgagtcaggaggatggcttgaacccagaaaatggaggttgcattgagccaagatggcaccactgcactccagactgggtgacagagagagactccgtctcaaaaaaaaaaaaacgccgggcactgtggctcacacctgtaatcctagcactttgggagactgaggcgagcagatcacttgaggtcaggagttcgagaccagctgggtgcctgggcaacatagtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgacagagcgagactccgtctcaaaaaaaaaaaaaaaaaaaaaaatagccgggcatggtggcgggcacctctaatctcacctacttgggaggttgaggcatgagaattgctcgagcctgggaggcagaggttgcagtaagcagagaccacaccactgcactctagcctggatgacagagtgagactttgtctcaaaacaaaaacaaacaaaccaaaccacctcttgtccactcctaatctcccttactgtgtttcacttatttttttcccatatatttgtcaccttctaataaactgtgtaacttattttttatgtttattgtgtactatctgtcttctccctgttggaatataaactctatggaggagggatccttgtctatatcccaagtgcctacaacagtgtctagcacatgctagttaccgaataaatatttgccaagttaataaagttgtttataacccttggcactatacctgatacagtgtagggacttaataaatgaatgttaaatgaagctatcttaaaaatatatatatatatataacagccagatacgccaatttgccgacatcaaaattaatcttttcatctattgcaggttttacagttaagctttgctctaaggttcactatcactaaaccaaaaataaataatatggatggtcttttcccatttttaacagagaggctacatcctctcaaaccagtcagtattaggaattcccaggatcattctctccattttccatcctaattagatacctatctggcaccacatctctgaaaagctccaatttttaaccagcacataataaacaaatatgttactattaatacacgtttgtacacaagtcatttttattgtcttaggtatatccactcccagaccttctgagttattgaaagacaggaatttgtgatgtcacctcttttttcttttttttgagacggagtcttgccttatcacccaggccagagtgcaatggcgtgatctcggctcactgcaacctctgcctcccgggttcaagcgattatcctgcctcatcctcctgagtagctgggattacaggtggccctagtttgggtttttggttttaaacaggatggtctcctctttgagaagttgccatgagttagccatgatgatacctgggacaataatggtccacagagaagtaagagccaatacaacgccttaagagaaagtacctggtatgtttgtgaagcagcaaagaggccaatgtgttccagcaaggagattatagtagagatgaagtcagagaactcatgcggagagggattgtcacaacacgcagggctgtaaaggccaccatgaggacttgagcttttaccgcctgtgaaatggggagcagttacaaagatttttaagaaagcagcccagtgcagtggctcatgcctataatcccagctctttgggaggctgaggtgggtggatcacctgaggtcaggagttcgagaccagcctggccaacatggcgaaaccttgtctttactaaaaatagaaaaattagctgcgtgtggtggccatgcttgtaatcccaaatactcgggaggctgaggcagaagaatcacttgaacccgggaggcggaggttgcagtgagccgaggttgcgccactgccctccagcctgggcaacaaagcgagactccgtctcaaagccagaaaaaaagatttttaggaaaggaatgaaatactctgacttaaattttagaaggatcactctggttgctatgttgcattatagactctaagggtagaaccagggagagcaattaggacactgttacagtaatctaggagaaaagtgatagaggcttgcaccagggtagtatcaggagaaatggtaacaagtggttggattatgattatagttgaaggtcgaacaactagatttgctgatagattggataaaatggtcctctctttatggatctcataatacagtaggagaaacagacacataaatagtcatcactgcaggatggggattagaaatattttgcaagggtgtaaaaggtgctaagaaagctttcttgtgtgacaaagctggttaaagaaagaaaagaaagcttcctagaagtgaaacctaaaatatacacttagataaatgaataaaagttatgaaagaatgtgagggctgggcacagtggctcatacctgtaatcctagcactttgggaggttgagtcgggggtattgcttgagtccaggagtttgaaaccagcctggacagcgtactgagaccccatgtctaaatttaaaaaaaaaaaaaatagccaggagtggtgatgtgcacctgtagtcctagctacttacttgggaggctgaggcaggaggattgcttgagctcaggaggtcgagactgcagtgagccatgagtacaccactgcactctagtctgggtgacagagtgagaccctgtctcaaagaaaatgaaaagaaaaagaatttgagaaaagatatgtcaggaaaatgtgatgacatgaacaaatactcaaaggcaagaaaagcatggtgagtaggggagggtacaggttgagacatgaagttgggattgccgaggcgtaagaggtataggcagatcatggatggcctggtttgtcataggaaggagcttgggctcttatctgtgggcaatgggaagccactaaagggttttaagtagaagagtgttatatggtaaggttttcctctccagtagatcactcagatgactgtgggggttggatgtgaggaggtaaagcagcaaagttactgctttaatttaaatcattgattaatctgtacaatcctagtcattccaaaaagaaacattagtcctttaacagaagtgaattgggtctgggcgcggtggctcacgcctgtaatcccagtactttgggaggccgaggcgggcagatcacctgaggtcaggagtttgagacaagtctggccaacatggcaaaaccttgtatctactaaaattacaaaaattagctgggcatgggggcacccacctgtaatcccagctactcgggaggctgaggcaggagactctcttgaacccataaggcagaggttgcaatgagctgaggtcgcaccactgcgctccagcctgggcgacagagtgagactccgtctccaaaaaaaagaaaaaatattggagcagtttcacagatgctgtttactgttatactgtatgtgtctatgactcctcctccaagaaaaaaaaaatgaattggagcaggttcacagaagcaatgtactgttacactgtatgtgtctgtttctacacatataaatctgaattctgtgtacacgaaaagaaatcctatagctttttattcctagctataaaaactaagaatataatttctttctttttattacataatgaatggttctgttaactttttgttaaaatttcattgaggggagtattaattcacatttatgtacggatgtctacatttacaaatcagtgtattttttgatttatgcttttactgagacaaagggtttctgtctcagcatggtcatttaaagagtttatcattgagaaaaatcagatgaccaacctgttagctcaaaaaaaaaaaaacctccaaggtatattgtatcagccagttctaggatacaaaagccatgcagtactttgtgttttgtgccaaaaagggtagctgctatttgacctgtcccaaaggcatgtgtggttgtaccgtaaaccaagcatggtacctgtttgtcaaactttagaaatgaaagtttaagagagttaatatataggtgctgcattttttatgtattcattgacttgctggtacagaagaaaagaatcaattatgattcagcacaatactccacttggggaagagagtgcagcagtagtttagagtgtcagggatcaaactgctaccttcttgggcttcagttgctagacttaagagacccagatcttgggaggggtttttgttgttatttgatgtgggggtaaggttgaaatactcccttttaattgattaatataaaaaataggtaatgtagacgtatgtcacaaaattttaacaagtttgagtgtgaaaagcatccatcccattctatgccctggctacccatttcccctccctagaggcggctgttattatcagtttctctgggtcctttttagaggtaatctttttgtatgcaactgtgcacatgtatgtttacacaaatggtagggtattgtatatatatacagttactgcagtatgcttatttgactttgctttattgcttttattttctgcctgacatatgttaatgtggccaaatagggcatttcccagacaatccttatagtttcattctgtgctactttaaatgctgttctccttccctgaaatgtcctttttttttttcttttctttttttttttttgagacagagtctcgctctgtcacccaggctggagtgcagtggcacaatctcagctcactgcaacctccacctccccggtttaagccattcccctgcctcagcttcccgagtagttgggactacaggcgcgtgccaccacgcccggatacttttttgtttgtttgttttagtagagacagggtttcactgtgttagccaggatcgcctcaatctcctgacctcctgatctgcctgcctcagcctcccaaagtgctgggattacagacgtgagccactgcgcctggctgtcctttcttttaatcttttcaaattctagccagttcatagcccacttgctctgtaaagctttttcagtgatctttcttttgtaccatgcagtcttttaaaaaatctacagttttattataagttgctaattatatttaataaatacctaaatggtagaaattgattcattttttaatctccgtagtgccaggaactgtggctcatgtctgtaatccctgcactttgggaggctaaggcgggaggatcgcttaaggccaggagcttgagcccagcctgtggaacatattgagaccccgtctctacaaaaaataaattagctgggcatagtggtgtctgtatgtagtgtcaactactcaggagactgaggcagaaggataacttgagctcagggagttgaggccacagtgagccatgatggtgccactgtacttcagcctgggtgacagagcaagaccaagaccgataattatctccatggtatttgttttggacgtattagatattcagtaaatattttctggtgatgatagtgatatctaactacctcaggttacctaacctgaataaggcctatttttaacatagccattcacttgttaatttctgttattttcgtgacttcatttttactaattatattttaaaagataattttatataaatgcaaaaactttttatcatgtaacaatctggtaacaccttgagtaatttgtcatttcacatgcacattttatttgttcattatcttttttctttttgtttattttttctgttttttaccttctctgttgcatagagaagatgcaaccagttttgccattttccaagtcacaaacggacgtctataatgacagtactaacttggcatgccgcaatggacatctccagtcaggtgggtttaggttaactaacataaaataataaagcttgcatgcaaagtaagagtcttacttaacctgataatgttgatttgattttataatggtaggtttaattgttcatgctttcacagggctgtgttgaaaatatagtacctttatcatcatagtatataaacatgcaacaaatcaggtatagtcattctaaacttgctttatttgcatattttgcaacctctggtttttcagattataaaatatgaaggtatacattcccgtaagtgattaaaataatctttttttctgttgtggcttttgtgtttttatatggatagctatactgatttttttcatgaaatagtgttttctaagacacattttaattttttatgtatcaatttttattgcatatcaattttcatttatagtatatgtgaatgtcttatagtacttgatagaagaaatttgaaacttcacatagtgaggagaaacattacagtattatttgctatggattaactctatccttcataaacttttggatatcaacttctacagaagattaaatgtctttctgttttgttttctttgggtaggggactctccatttcttaggttctctgacatctgagctagctttttgtttaattaaaactttttttttagttgacagataatgtacctgttcatggggtacacagtgatgttttgatacatatagtatatggtgattagatcaaggtaattatcatttccatcatcccaaacatttatcattccttgtgttggaaacattcagtattttccttctagcatttgaaatgatataatatattatattgttacctataatcatcctgcagtgatgtagaacaatggagcttactctttctatctagctatacctttgtatcctttccctacccttttcagcctctagtatcctctgttctactttttatttctatgagattaactttttaaaaataatattctgtgtgtatatataccacattttctttattcattcgtctgttcttggacacctaggttgattctgtatcttggctgttgtgaatagtgctgcagtaaacatggggtgtagatgtctgttcgatatgatgattttctttcctttggataaattcccaatagtgggattggtgggtcatatggtagttctgtttgtagtttttgaggaacctccatactcttctccatagtagctgtactagtttagattcccaaaagtagcgtataagagttcactttctacacatcctcaccagcatttggtactttttttgtctttttgataatagccatcctaactggggtaagataccttgttgtggttttgatttgcatttccctcataattaacgatgttgagcattttttcatatctttgtttttgacggtccagctagttttattggttactttttttttttttttttagcaatagtttcatgtgcagggctcaaattatatttaatattacttttttcaaattataccagaacaaccttaggttaggctataaaacaactgccttctttttcttttggcataataattatatatatatttttaattacactttacgttctagggtgcatgtgcacaacatgcaggtttgttacatatgtatacaagtgccatgttggtgtgccgcacccattaacttgtcatttacattaggtatatctcctaatgctacccctcccctctcccctcaccccacgacaggccccattgtgtgatgttccccaccctgtgtccaagtgttctcattgttcagttcccatctgtgagtgagaacatacggtgtttggttttctgtccttgcgatagtttgctcagaatgatggtttccagcttcatccatgtccctacaaaggacatgaactcatcctttttgatggctgcttagtattccatggtgtatatgtgccatattttcttagtccagtctatcattgatggacatttgcattgattccaagtctttgctattgtgaatagtgccacagtaaacatacatgtgcatgtgtctttatagcagcatgatttataatcctttgggtatatacccagtaatgggatggctgggtcaaatggtatttctagttctagatccttgaggaatcgccacactgtcttccacaatggttgaactagtttacgttcccatcaacagtgtaaaagtgttcctgtttctccacatcctctccagcacctgttgtttcctgagtttttaatgatcgccattctaactggtgtgagacggtatctcattgtggttttgatttgcatttctctgatggccagtgatgatgagcattttttcatgtgtcttttggctgcataaatgtcttcttttgagaagcatctgttcatatactttgcccactttttgatggggttgtttgatttttttcttgtaaatttttttaagttctttgtagattctggatatcagccctttgtcagatgggtagattgcaaaaattttctcccattctataggttgcctgttcactctgatggtagtttcttttgctgtgcagaaactctttagtttaattagatcccatttgtcaattttggcttttgttgccattgcttttggtgttttaggcatgaagtccttgcccatgccagtgcccatgccagtgtcctgaatggtattgcctagattttcttctagggtttttatagttttagaactaacatttaagtctttaatccatcttgaattaatttttgtataaggtgtaaggaagggatccagtttcagctttgtacgtttggctagccagttttcccagcaccatttattaaataggaaatcctttccccatttattgtttttgtcaggtttgtcaaagatcacatggttgtagatgtgtggtattatttctgagggctctgttctgttccattggtctatatctctgttttggtatcagtaccatgctgttttgattactgtaccttcgtagtatagtttgaagtcaggtagcacgatgcctccagctttgttcttttggcttaggattgtcttggcaatgcaggctcttttttggttccatatgaactttaaagtagttttttccaattctgtgaagaaagtcatttgtagcttgatggggatggcattgaatctataaattaccttgggcagtgtggccattttcatgatattgattcttcctatccataagcatggaatgttcttccatttgtctgtgtcctcttttatttcattgagcagtggtttgtagttctccttgaagaggtccttcacatcccttgtaagttggattcctaggtattttattctctttgaagcaattgtgaatgggagttcactcatgatttggctgtttgtctgttattggtgtataggaatgcttgtgatttttgcacattgattttgtatcctgagactttgctgaagttgcttatcagcttaaggagattttgggctgagatgatggggttttctaaatatacaatcatgtcatctccaaacagggacaatttgacttgcttttcctaagtggataccgttgatttctttctcctgcctgattgccctggccagaacttccaacactatgttgaacaggagtggtgagagagggcatccctgtcttgtgctagctttcaaagggaatgcttccagtttttgcccattcagtatgatattggctgtgggtttgtcataaatagctcttattattttgagatacatcccatcaatacctagtttattgagagtttttagcatgaagggctgttgaattttgtcaaaggccttttctgcatctattgagataatcctgtggtttttgtctttggttctgtttatatgatggattacgtttattgatttgcctatgttgaaccagccttgcatcccagggatgaagccaacttgattgcgttggataagctttttgatgtgctgctggattcggtttgccagtattttattgaggatttttgcgttgatgttcatcagggatattggtctaaaattctctttgttgtgtctctgccaggctttggtatcaggatgatgctggcctcataaaatgagttagggaggattccctctttttctattgattggaatcatttcagaaggaatggtaccagctcctctttgtacctctggtagaattcagctgtgaatccatctggtcctggactttttttggttagtaggctattaattattgcctcaatttcagagcctgttattggtctattcagggattcagcttcttcctggtttagccttgggaggctgtatgtgtccagggatttatccatttcttctagattttctagtttatttgagtagaggtgtttatagtattctctgatggtagtttgcatttctgtggaatcggtggtgatatcccctttatcatttcttattgcatctatttgattcttctctcttttcttctttattagtcttggtagcagtctatcagttttgttgatcttttcaaaaaaccagctcctggattcattgattttttgaaaggttttttgtgtctctatctccttcatttctgctctgatcttagttatttcttgccttctgctagcttttgaaggtgtctgctcttgcttctctagttcttttaatggtgatgttagggtgtcaattttagatctttcctgttttctcttgtgggcatttagtgctataaatttccctctacacactactttaaatgtgtcccaaagattctgatatgttgtgtctttgttctcgttggtttcaaagaacatctttatttctgccttcattttcttatatacccagtagtcattcaggagcaggttgttcagtttccatgtagttgtgtggttttgcgtgagtttcttaatcctgagttctagtttgattgcactgtggcctgagagacagtttgttgtaatttctgttcttttacatttgctgaggagtgctttagttccaactatgtggtcaattttggaataggtgtggtgtggtgctgagaagaatgtatattctgttgatttggggtttagagttctgtagatgtctattaggtccacttggtgcagagctgagttcagttcctggatctgtcttgttgatctgtctaatattgacagtggggtgttgaagtctcccagtattattgtgtgggagtctaagtctctttgtaggtctctagggacttgctttatgaatctgggtgctcctgtattgggtgcatatatatttaggatagttagctcttcttgttgaattgatccctttagcattatatgatggccttctttgtctcttttgatctttgttggtttaaagtctgttttatcagagagttggattgcaaaccctgctttttttgttttccatttgcttggtagatcttcctccatccctttattttgagcctatgtgtgtctctgcacgtgagatgggtttcctgaatacagcacactgatgggtcttgactcgttatccaatttgccagtctgtgtcttttaattggagcatttagcccatttccatttaaggttaatattgttatgtttgaatttgatcctgtcattatgatgttagctggttattttgctcgttagttgatgcagtttcttcctagcctcgatggtctttacaatttggcatgtttttgcagtggcttgtaccggttgttcatttccatgttcagtgcttccttcaggagctcctgtaaggcaggcctggtagttacaaaatctgtcagcatttgcttgtctttaaaggattttatttctccttcacttatgaagcttagtttggctggatatgaaactctgggttgaaaattctttcctttaagaatgttgaatattggcccccactctcttctggtttttagagtttctgccaagagatcagctgttagtctgatgggcttccctttgtgggtaacccgacctttctctctggctgcccttaacattttttcctacatttcaactttggtgaatctgacaattatgtgtcttggagttgctcttcttgagtagtatctttgtggcattctctgtatttcctgaatttgaatgttggcctgccttgctaggttggggaacttctcctggataatatcctgcagagtgttttccaacttggttccattctccccgtcactttcaggtacacccgtcagacatagatttggtcttttcacatagtcctatatttcttggaggttctgttcgtttccttttactcttttttctctaaacttctcttctggcttcatttcattcatttgatcttcaatcactgataccctttcttccacttgatcgaatcggctactgaagctcatgcatgcatcacgtagttttcgtgccatggttttcagctccatcaggccatttaaggtcttctccatgctgtttattctagttagccatttgtctaatcttttttcaaggtttttagcttctttgcaatggtttcgaacatcctcctttagctcggagaactttgttattacccatcgtctgaggcctacttctgtcagcttgtcaaagtctttctctgtctagctttgttccgttgctggtgaggagctgtgttcctttggaggagaagaggcgctctgaattttagaattttcagcttttctgctctggtttctccccatctttgtggctttatctacctttggtctttgatgatggtgacgtacagatggggttttggtgtggatgtcctttctgtttgttaattttccttctaacactcaggaccctcagctgcaggtctgttggagtttgctggaggtccactccagaccctgtttgcctgggtatcaccagcggaggctgcagaacagcaaatgttgcagaacgacaaatgttgctgtctgatccttcctctggaaccttcgtctgacaggggtacccaggtatatgaggcgtcagtcagcccgtatggggaggtgtctcccagttaggctacttggggatcagggacccacttgaggaggcagtctgtccgttcgccgatctcaaactccatgctgggagaactactactctctttagagctgtcagacagggacctttaagtctgtagaagttactgctgccttttgttcagctatcccatgtccccagaggtggagtctacagaggcagtcaggcctccttgagctgtggtggactccacccagttcaagcttcctagctgctttgtttacccactcaagcctcagcaatggcagatgcccccgcctccagcctctttgccgccttgcagttcgatctcagactgctgtgctagcagtgagcgaggttccgttggcatgggaccctctgagccaggcatgggatataatctcctggtgtgccgtttgctaagaccattggaaaagcccagtattagggtgggagtctccctattttccaggtaccatatgtcacggcttcccttggctaggagagggaattccccaaccccttgcgcttcccaggtgaggcaataccccgcccttcagctcacactatgtgggctgcacccactgtctgacaatccccagtgagatgaacccagttcctcagttggaaatgcagaaatcagctgtcttctgtgtcgctcacactgggagctgcagactggagctgttcctatttggccatcttggaaccctgccttcttcattcatatgtaatacaaaacttctaaggttttagtggagaagagatagagtaaaaggatttctatagacagaagaaacagttggtcatcaactctttcccttgtggcttcacatctcccctaaggacttcttatgttggtttggtcttacagtatagtcagtggcagtttccctcttcccattccttcctctgtctgatttaaaatgctgtttcaagtatcgatataagtattttgcctgtttcttttagcgtggctgtgaagggctgacattttcagaaggcacttactgaaaaaaaaaaaacaaagaaatgtaagagtccatcacatataaatagttaagtttctaaaatatgtatttgagatcccagtaattctactaggataaatagcaaaaattctccagccctgaagagttggtctgtctttcctttccttgttatcttgattctcttttatttcatttcacatgctagaccccatcatgttttcctgctgcattccccactccaccctccaaagcaatgttctcttcctgcaacctgtttgaaaaaattgaactttgtcttatttcatatccctagtacaagttgaatatccctaatatgaaatctgaaatccaaaatgctctaaaattcgactcttttttttttgagatgaagtcttcctctgtcactcaggctggagtgcggtggcgcaatcttggctcactgcaacctccgcagcctcccctaaccccatccctgtgggttcaagcgattctcccacttcatcctcccaagtagctgggactacaggcacctgccaccacacccaactaattttttgtatttttagtagagatgaggtttcaccatgttggtcaagctagtctgagactcctgaccttaagtgatccacctgccctggcctcccaaagtgttgggattacagtcatgagccactgtgcctagccaaatatccaaaactttttgagcgctgacatgatgctcaaaggaaatactggagtattttgcattttggatttttgggttaaggatgctgaaccagtaagtataatgtaaacattgcaaaatgcaaaaaaatgtaaaaaccctaagcagttctggtcccaagcatttcgcataagggatactcaacccataatcttttcttttctgttttctggttggaagggcatattggctttatagctaatttacacagcattgatgtttaatacacagtgagtccaagtagatcactcagacctattagtagtttattagtgtcactcacttctggaacattctgtgatgttttacttggatgagttctttcacctctcttgggaaatagtcataccaaagtctgcttattactacaatgtgttatctattatacattgtccaattttctactcaaaattactagacaggcaaagaaaaagtaaagtataacccttactcaagaaaaaaaagcaatcagtagaaactgtgagtgggcccagatattggatttagcagacaaagacttcaaagcagctattataatatgtttaaagaattgaaagaaaatatggtatcagttaaacaggaaatctaagtagatgatataaactagacaataaaaataatattctaaagttgaaaagtgtagttactgaaattaaaaatttacagacaacagcctcaacagcagattagagatagcaaaagaaagattcagtgactttgaatgcaggtctgtagaaattactaaattgatgactctcacgtagcaactttcacccgtagtttggtttcatatacaatgctttaactctttttgctattttttctcttactttctgtgatggaaacattttgtgctttgattttaatgggtgtatcacagttatatacatctttacaaactcatcaaattgtatactttatttatatatttatttttttttgagatagggtctgactctttctcccaggctggagtacagctgaaattagttgggactacaggtgggcaccactgtgccagctaatttttgtattttttgtagagatggggtttccccatgttggccagtctggtctcaaactcctgggctcaatcatttctgccgcctcagactcccagagtgttgggattataggtgtgagctactgtgcctggctggtatagctttttttttttttttttttttttttgtgacagagtctcactctgtcgcccagggtggagtgcagtggcgcgatctgggctcactgcaacctctgcctcccgggttcaacccattctcctgcctcagcctcctgagtagctgggactacagatgcgtgccaccatacccagctgatttttgtattcttagtagaaacagagtttcaccatgttggccaggatgatctcgatctcctgacctcgatccacctgccttggcctcccacagtgctggcattacaggcctgagccaccatgcctggctgttggtatactttaaatggatgtaattcattgcagattatacctcagtaaatttttatttagtttttgagactgagttgctctgttgcccaggctggagtgcagtggcacgatttcagctcactgcaacctctgcctcctgggtttaagcgattttcctgtctcagcctccccggtagctggaattagaggtgtgtgccaccatgatcagattatttttgtgtttttagtaaagatggggtttcaccatgttggccaggctggtctcgaactcctgacttcaggtgatccacccgcctcggcctctcaaagtgctgggattacaggtgtgagccaccacgcctggccttaatttttaaatactgtaaggcttataaagaaaagaatattccccttctgtttctttcctctcacgtagcaaccttcacccctagtttggtttcatatacagtgttttaactctttttgctatttttttctcttactttctactatatttccaaatacaatgcttctataatgattccttttttttttctatcagtttttgataatcattgactccttatggtcaaagaagacttaattcccttctgtcactcttcatatattaatataactaatatatatattgtttagttttgatataactaaaaataactatatgtatatataactatatatgtataagctatctgtatatagttatatatgtatatgcacatacatatatagttacatatgtatacacacatacatatatagttacatatgtatatgcatatacatatatagttacatatctatatgcatatacatatatagttacatatgtatatgcatacacatatatagttacatatgtatatgcatatacatatatagttacatatgtatatgtatatgtatatacatatatagttatatatgtattagttatatcaaaataactatgtatatatagctgtaaatgtatatataaactatatgtatacagttatatatgtatttgtatatgtgtgtatacatatatagttttttttgttttttttttttgttttttttgtttttttttggagatggagtcttgccctgtcccccaggctggaatgcagtggtgctatcttggcttaccgcaacctctgcttcccaggttcaagcaattctcctgcttcagtctcccgagtacctgggattacaggcacgtggcaccacgccaggctaattttttgtatctttagtagaaatggggtttcaccatgttggccaggctgttctcaaactcctgacctcgtgatccacccgcctcggcctcccaaagtgctgggattacaggcgtgagccaccgcgcctggtccctatacatatatagttatatatacctatagttatttttagttatatcaaaataactatatgtatatgtaactatatatatagtatatatagtatatatatactatatagtgtgtatatatagtatatatatactatatagtgtgtatatatagtatatatatagtgtatatatcgtatatacactatatactatatagtgtatatatagtatatgtagtatatatagtatatatagtatagtatatatagtatatatagtgtatatatactgtatatatagtgtacatagtatactatatagtatacatatagtacactgtatagtatatatagtatagtatatatagtatacatagtatactatatatagtatagtatacatagtatactatatatagtatagtatacatagtatactatatagtatatagagtatatatacagtatactatatagtatatagagtatatatacagtatactatatcgtgtgtatagagtatatatacagtatactatatcgtgtgtatagagtatatatacagtatactatatcgtgtgtatagagtatatatacagtatactatatcgtgtgtatagagtatatatacagtatactatatcgtgtgtatagagtatatatacagtatactatatcgtgtgtatagagtatatatacagtatactatatagtgtgtatagagtatatatacagtatactatatagtgtgtatagagtatatatacagtatactatatagtgtgtatagagtatatatacagtatactatatagtgtgtatagagtatatatacagtatactatatagtgtgtatagagtatatatacagtatactatatagtgtgtatagcgtatatatacagtatactatatagtgtgtatagcgtatatatacagtatactgtatagtgtgtatagagtatatatagtatactgtatagcgtatagagtatatatatagtatactgtatagtgtatagagtatatatatagtatactgtatagtatatagagtatatatagttacatatacatatagttatttttagtaatatcaaaaaaccatagctaagatttttatgatttagcaaaatattgtttaccccaaagccacgtattatatattaatgatattttttcccttttgagtttttcttccccacaggttttctgatctttttttttgttctctaactttatattataggtatatactcttttctctgtttaatttgctttttaactagaagacctcctttagtagttcttttagtgaatatctgtggttaaactcttagtctttccagtgtctgaaataccctcattttaatgtgacaggtcacttttctcacctcaacattttggacatacctcatttccaacaaacatttgttacttctgatagagagtctgctgtcattctcatacttgttccttgtggaaatgtctatatataaagtctcagaactatatatttttaatatatatacatatatttatttatttaaaaatgtataattaagttagtagtagtagtagtagtagtagtagtagtagtagtagtagtttttttttttttagatggagcctccatctcccgggttcaagtgattctcctgcctcagcctcctgagtagctgggattacaggcacacaccaccatgcctggctaatttttgtattttgagtggagatggggtttcaccatgttggccaggctgatcttaaactcctgacctcagatggaccacctgctttggcctcccaaagcgctaggattacaggcatgaaccactgcgtctggccttaagttattattgactattgatgccctgttgctctatcaagtagtaggtcttatttattctagaacctcgttttaaggtatcctgaatgtggcttttttttttttttttcctaagacggagtctcactctgttgcccaggctggagtgcaatggagtgatcttggctcaccgcaatctctgcctccttggttcaagcaattctcctgcctcagcctcctgagtagctgagattacaggcgcacgccaccacacctggctaatttttgtgtttttagtagagacggggtttcaccacattggtcaggcttgtctcaaactcctgaccttgtgatccgcccaccttggcctccgaaagttctgggattacaggcgtaagccaccacgcccagcctaatgtggattttgtttttttttttaacttgaattttatttatacttcctgattttataatagttaacttgtagtaaaagtaaactggttgtctaaataaataagctgatttcctatactagtttagagtctttagttttcttaaaccgtattaagagatttgattacaaaagtaaaattgaggcttttgtctttttttttggccactctaatttgctgactgacttaacatttgtcttcacagtaaacattgtaaataaacactgatgtttgttgcgtagtatgtaaaaatattatttaggagtggtgagatttaaacatttacaaacctgtaatatatatagtacagcaacactggacaaataaccttttcaacttaatcagaggtgttctataaatgttcatttgcatatatacagcccatataatacttagcatatgtaaaagcacatctttatactctttcaattaaaattgattattattattattttttttttgagacagagtccctctcagtcacccaggctggattgcagtggtgtgatcagggctcactgcaatcgggtagctggaactacagggatgtgccaccacgcccagctatttttgtatttttagtggagatggggtttcaccatgttggccaggctggtcttgaactccatacctcaggtgatctgcccgcctcagcctcccaaaatgctgggattacaggcgtgagctactgcacccggcctaaaattgattagtttttaagaccctcttggtgggaacagactttcatagtgtttatagttataatagtttggaatcaaagtagtcgagtgctacttttttttcctctgtacatcctatccctaatgcctttactatattttgtttcttatttgagagctttatttgcttcataactttttttttttttttttttttttgagacagagtttcactctgtcacccaggctggagtgcagtagtgcaatctcggcttactgcaacctccgcctcctgagttcaagtgattctcctgcctcagcctccgaagtagctgggattataggcccccaccaccacgtctgactgattttttgtatttttagcagagacgaggtttcaccatgttggccagcctggtcttgaactactgacatcaggtgatccgtccacctcgatctcccaaagtgctgggattacaggcgtgagccatcgcgcccggcgcttcataacctttttatattgtctttctgttccccaaaatgaagtagtttcttcttaaaaatactgttttttgtttttttgtttttttttttatttgagatggagtctctctctgtcgccaggctggagtgcagtggcacgatctcggctcacttcaacctctgactccgtggttcaagcaattctcctgcctcagcctcccaggtagctgggattacaggcacaaatactgtttttaataagaaaattagaatagggacaggcacaatggctcactcttgtaatcccagcactttgggaggccaaggtgggaggattgcctgagcccaggagttcgagaccagcctaggcaacatagtgagtgagaccctgtttctataaaaaaaatttttaattagtccggtctggtggtgcacaactgatgtcccagctacttgggagtttgaggtgggaggatggatcacttgagcccaggaagattaaggccacaatgagctgtgatcatgccactgcactccagcccaggccacaggtttcaaaaaaagagaaaattagaattatacgttagggggaaaaaacctaataaccatattcctatctacctagtgaccacccctatgaagatcctggtacatgttctcattgaaatcttattttgaaatatttttgaattaaaaaaatatattattaccttggttttacaaatgtttgcttgtctttatgttcagctacaattttctaatcacaatggttttactttttccttgtcagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataaggtattctgggacagtaactttaattgctgtctttttgcaaatagaaaaatttttaagatactattcctgcttaagttgatcataagtactttataatactttagagaatggataagtttccataaagttaaatttttttttttttttttttgagactcttgttttccaggctggagtgcaatggcgcgatctcggctcattgcaacctccgcctcccaggttcaagcgattctcctgcctcagcctcccaagtagctgggattacaggcatgcaccaccacgtcgagctaattttgtatttttagtagagacggggtttctccatgttggtcaggctggtctcaaactcccgacctcaggtgatccgcctgcctcagcctcccaaagtactgggattacaggcgtgagccaccgtgcccaaagttaatttttttttaaatccacagggcaacttgctataaaactttttttggacctcattagacatttaataccaagttttgcttacccagtctgttttatataatgctgtatatttcattttaaatttatttttaaaattatttcaatctttgtaaatgttttataccagtaacatacctagagttttgtcatgattctaacaagggttaaaatttgtttttattttgtaaaaactaaatctctggataaaatcctctataactgacttaatgccaaatatagttctctagtgaatacagttttaccttcaggtaaataaatatacaatttatggatttttataccctttttcctatttttaaagcttgaattctgtgaactttaaggttaacttatttatgaaaagtgtaaatgttaggttgtattttcatattaaaattttgtatcctttaagggtactccgaaaacaaataggacaaataaaccttctacccctacaactgctactcgtaagaaaaaagacttgaagaattttaggaatgtggacagcaaccttgctaaccttataatgaatgaaattgtggacaagtaagttttgccatctaaatgttttattttatagtttttatattttaattttacttataaaacatgtcaggagtgaaatagataataaataccttgtctggtttacatacttaatttttatgatagttttcaattataaatgtagaaaaccattgctttactgatttaactatagtttaacagttaacattaaaaataactatatgtcatagggcttaggcttcatcttgtaataactgggccctgtttgtatcgtagaactaactgaggtcttgtttcttagtggaacagctgttaaatttgatgatatagctggtcaagacttggcaaaacaagcattgcaagaaattgttattcttccttctctgaggcctgaggtaagaactttatattatcatttttctataataccatctgttactgaatccatagtagtagtagtagtaaagaaatatttgagctatactaaaataattaattcatataaggtaacaatagatttaatgttttaaaaaagataaaacattaacaattgatgttgagaagttattatagaataggaaaatggatatgagttcctaatttccaatccttttatatttttaggaaaagtgggtagtatgatataattttgttttgttttggagacggagtctcactcattgtgtcgcccaggctggagtgcagtggcatgatcttagctcactgcaacctctgcgtcccagaattcaagtgattctcctgcctcagcctcccaagtagctgggattacaggcatgtgccactatgcccagctaatttttgtaattttagtagagatggggttttgctatattggccaggctggtctttcatacctgatgtcaagttatccacccatttcggcctcccagagtgttaggattacaagtgtgagtcactacatctggccaaattttgatatcaaggtgagagagatttaaaattaagataaggtacaaaaattagcctagtgtgggggcgcacgcttgtagtcccaactactggggaggctgtggcaggagaattgcttgaaccaggaggcagaggttgcagtgagccaagatggcaccactgcactccatcctgggtgacagagcgagatgtcatctcaaaaacaaaacaggccgggtacggtagttcacgcctgtaatcccagcactttgggaggctgaggcgggcagatcacgaggtcaagagattgagaccatcctggctaatatggtgaaaccctgtctttactaaaattacaaaaattagctgggcttggtggtgtgtaaccccagctactcgggatgctgaggcaggagaatcgcttgaacccgggaggcggaggttgcagtgagccgagatcacgccactgcactccagcctggcgacagagcgagactccgtctcaaaaaaataaataaaaatttaaaaagataaatacataaaaataaataaataatattaagagaaggaaatcaggcaggtagtggcccctgacacaatgagttttcccagaattggattgcttggaaatgccgctcaaagagtgtggtaaactccatcgaaggctaaataccaacgtgacagtgataataaacaagtactttatgggaaagttttttttttaattatttttaaaaagagagaaattgtactggagaaaagaggaattcaggtagaataattcttttttttttttttttttgagatggaattttgctcctgttacccaggctggagtgcagtggcttgatgttggctcactgcaacctctgcctttggggttcaagtgattctcatgcctcatcctcctgagtagctgggtctataggcatgcaccccaacacctggctaatttttgtgtttttagtagagatagggttttaccattttggccaggctggtctcaaactcctggcttcagatgatccgcccaccttggcttcccaaagtgctgggattacaggcagaggccactgtgcctggcatgaagaacaatttttaaaagaatgacttttaaggatattaagtcatcaaagtagatagagccattaaatgatgggtagaaacctaatcttccatcccatattttatgacttattaaggaagataggcaatcttgcagttgataataaatatttggctttccatacttagcaccgttttgaatttttccagttcacagatggtatatttagtgctgttccaataatattgcaaaaaataaatctgaagactcacttctgggtcacagttatttcactattaacattaaaatcttacggacctacctgcaacatgtagtggaaataagttgtgtggcacgttgtggtgggtgcattattaaataaatgtgcaaaggttttatggctgtctcaatttttccatagtcttgagtcattcacatactgcctttatggtgtttatcacttgtaagtgagtaccaactgtactagaacttactgaatatttttcaagtctattttacttattactcattctaagtacataaaatcactggtctgatatgcaagttaggttttcgctaatacccagtaaaataattagataattattaaaatagaaagcatttgtcattatgtgaactggatttatgtcatgtaccacctcaggtcacactttgggaaacgtagcttacgtattgagctaacattttgctggagttatataagattagtaaatgctatagactaaatattgaaaaaaaagcttgcttaaagaggatttacataattgtagacctgaaaaggatcttagcagtcttctgatcgattcattgataaagaaactagtcctaagagctaaaatgacttgctcaagattttagttaagtggtagacctaggaaatacctttctaagattagagctgcctggttagtgctatagctgccacctaattcttacatttatttattaagggacatgctttttacggtagaaaaatatatctaaaattgtgaaggtaataccaaggaaatatttaggctatgcaagaaaagtcattcagcttttgctttacccaggcctatagagaacatatctaaaataataagtaacatgtgaatttgaatttaggcatattttcatggtagtgacataatgtgcaattaagaagctataataatgtaaaaatgccagttgcaagttatttcaaataaagttgaataacctgacctcaggaggggcagaaaccttagtaaacttagcaaactgagacctaaggaagagcaagatctgtggtagagccaggtctaaaggtttatatcctggtacaaacttgtctatacatcaccacacctgccaaatggaactttttttccttgtagttcagatttccaagaaagggaatattattgtcctagctcagcgtttcacaatagactcacaaaatgaatcttgttaagcctatgaatgggtaagacttatcccataacacgcctctattgtgtaaaaaaatcagctttattcctaattccctgtagtaggaagcttgcatagaccacaatagagacattgttagattatatcaagaaggtgagtggcaggcattcttgagtatactggaatttttatttcattgtagaaacacagaatcataattagtcatctaaaactggttttaaggagataatactaaagatactcacttgaggtagattgttctcagaattacttaaaataagtgctttaaatcttgctcattcatgaagccatagccctggaaggagatattgaaaaacttctccatcttccttcaatcccataggaccatgtttttaattgtagtttaacattaaacataatttttgaaagtagccaatattaatctttgacaaaaaactcaaactaaatagcagaaaatagaacatgccctctcctctcgcccaaaagtaagactacattttaaagtatatcacagtgatctgtctaaatatttttctcaaatattttactaagaaagcgtatattcttctgtccttatttcatagatctcttctgtatcctgtgcagcttgtctatcatttcgagcttttatatttcttattttgttctcttgctgcttaaatgtgattctttgagatttatagaagaatgtgattgttctccagttttaaaaagctcttctctatctactaaaatttccatgaatttctttctttctttttttttttttgattgagacagtctcgctgtgttctccagcgtggccttaggcttaagtgatcctcctgtctcagcctcccaagtagctgagattacagaaatttccatgaatttccaaatatgatgttatctttcatataagcttaaacataagcctttcttctttcaaaaatgttagaacttacctctttaaataatcttataaagccatttcttaatttttgtttccttttcgaatctattaacttgcatatcatagtaaatgaacccttagctccatcataccacacaccttctactcctgtcctcccactttttctcacccaggctggagtacagtgaatatttagtgcttttaaatattattcattaccaagccaagtagcgtactattttttccttgtacagcctttttttcccctaaataattgtgttattttttcatttgcttcattttcatcttatcgattgataattcttctgttccatttcagtctaatttccacatggccaaaccaatctaaaaacctgttaactcaggtcttttttttttttttttttcccagaataccttttcctggaaccaccttcttcttttcattcgagaccaaatgctttccatgcctgtgtcaaagtggttgttctctaatctgtcttcactaccatcataatttccttttccttttttcctttctttattatgtatctcctgtcttttaaattccatattttccactttcatgatttattttctcattttgatggctacatctttcagtaactgagaaaaggttgtgtgagggaatattttgagatgctgtagttttgaaaatatctttattctgctgtcttctcattaataatttgactggatgtcaagatttaagttggaaactattttccatgagtattttgaaggcattatctattgtcttctagcttccagtgctgctttgtattagagacagaagatcaggaatcaggatagcattggacttcttatttctatttcccaaagctttttggatcttctctttattcttatcttctgatattttataatgatatgcttgatgcatttactttttcttttcttcttccctcttgtacatttctttctttttttaggtgggggcaggggggaaggagtctcactcttctcacccaggctagagtgcagtggtgcaacctcagctcactgcaacctccacctctggggttcaagcgattctcctgcctcagcctcccgagtagctgggattacaggcatctgccaccacgcccagctaatttttgtatttttagtagagacggggtttcaggctggtcttgaactcctgacctcaggtgatccgccctcctcagcctcccaaagtgctgggattagaggcatgagccactgcgcccagcccctcttggacctttctagatattcatccttcaattctgagaaaggttctataattctttaatttaaaaaaagtttttttgtttcatctttctcactttttttttttttttttttttttaagacacagtcttgctctgtcacccaggctggagtgcagtggtgcgatctcagctcactgcgcccttcgcctcctgggttcgagtgattctcctgcctcagcctcccaagcagctgggattacaggtgcccaccaccaccatgcccggctaattgttgtatttttagtagagacggagtttcaccatgttggccaggctggtttcaaactcctgacctcaggtgatccacctgctttggcctcccagagtgctgggattacaggcatgagccaccgtgcccagccctattctgatttcatagatgcagtgtcttttatgtctctgagaggttttgtcaagttttcttttgtttactttattatctgtttcttcaagattcctcctcttttctttttgccttaagctttttcatattggaagcttctctcaaatgtctggttattctggttgtccacttatattacgtggaacaataaaaaagttgattaggactctgtgctgtaagtaagtaaattgttgatagtgagagcccattaatcacaggatgatcaagcagcaagcctactgtttatttgggtttctccaaatggctatagctgtcagtcttttttttctggggttatttggcttctctagaaaagaattttctagtctcttgtttggagaatacaagcttgactattggtgttccagaaaatgggtgggaggagacgactttgttttctgttaggttgagccatgtgaaattactaggttttgttttgttttctgttttgttttgagacagagtctcactctgttgcccaggctggagtgccttagcatgatcttggctcactgcaacctctgcctcccaggttcaagcaattctcatgcctcagcctcccaagtagctgggattataggcatgcaccaccacgcctggctaatttttgtatttttagtagagacggggttttgccatgttgaccagtctagtctcgaactcctgacctcaggtgatccacctgccttggcctcccaaagtgctgggattacaggtatgagccaccacacctgggctgaaattactgtttttataggtcataaacagttgagggataggcatggtggctcccacctataatcccagcactttcagaggccaaggcaggaaaattgcttgagtccaggagttcgacaccagcctgggcaatgtagtgaaaccccatctatatttaaaaaaaaaaaatagatgaatatctttgtttgcagataacatgattgcatatgtagaaaatcccaaagaaccaacaaaaagagctcctagaactaataagtgattatgacaaggtgtagaatacaaagttaatatacaaagtcacattgcttttttatctaccagcagtgaacaactggaatttgaaattaaaacacaatactgctgggtgcagtggctcacacctgtaatcccagcactttgggaggccgaggtgggcagatcacctgatgtcaggggttcaagaccagcctgaccaatatggtgaaaccccatctctactaaaaatacaaaaattagctgggcatggtggcgggtgcctgtaatctcagctactcaggaggctgaggcaggagaatcgcttgaacccaggaggcagaggttgcagtgagccaagatcgcgccattgcactccagcctgggggacagagcaagactccgtctcaaaaaaaaaaacacaatacctttcatattaacactaataaaatgaaatatgtgtagttctaacaaagtttgttgtagaagatctatatgagaagaattatagcactcatgaaagaaatcaaagatctaagtaaactgagagatattccatgtaaatggacagggagactaaatattattgagatgtcagttcttcccaagttcatatatcgattcagtgcagtcccagtcaaaccccagccagttattttgtggatactggcaaactaaagtttatatgaaaaggcaaaagacctagaacagccaacacagtattgaagaagaaaaaagtcagaggactgaaactacccaatttcaagacttactgtaaagctacattaatcaagacagcatgtcattggcaaaagaatagacaaataaatcagtagaattggacagagagcctagaaatcaacccacacagataaagtcaactgatctttggcaaagggacaaagacaattcagtggagaaaagatagccttttcaacaaatggtataggacaactggacatccacatgcaaaaaagttaatctagacacagacctgacaactttcacaaaaataaatggatcatagacctaaatgtaacatgcgaactgaaacttctagaggataacataggagaaaatctaggataacatgagaaaaatttttggtttggcagtgacttcttaggtacaataccaaaacatgatccttgaaaaaaaaaatcagtatgttgaactttgtttaaattataaacttctgctctgtgtaagatgctgttaggagaatgaaaagacatgcagcagagtgggagactttacaaaattcattatctgatgaaggaccagtatccaaaatatacaaagaacttttaaaactcaacaataagaaaatatacaacccagttaataaatgggcaaaatatctgaacagacacctcaccaaggaagatagatagatgacaacaagcatatgaatatatgctcaacatcatgtcgttagggaaattgcgcattaaaacaacaacaagataccctgccatccctattagaatggctgaaatctaaaacactgacaacaccaaattctggcagggatgtggagcagcagaaactttaattcattgctgatggaaatctaaaatggtagaaccattttggaaggtagttggacagttttttacagaactaaagacagtttgacagtttcttacaaaactcttaccatatggtccagcagtcttactccttagtatttacccaaataagtttaaaatgtacatccaataaaaaaaactgcacatgaatatttctagcagcattattcatagttgccaaaacttggaagcagtcaaggcatccataagtaggggaatggataaacagactttggtatatcatgtaatggagtattattcagcaataaaaagaaatgatctatcaagccacaaaaatatatggaggaaccataaatgcatattgctaaatgaaagaagccagtctgaagaggctacactataggattctgactatatgatgttttggaaaaggcaaaactatggaaacagtaaatagatcagtggttgccaagggagacagggagagatgaataggtggagcacagtggatttttaaggcagtgaaactgttctttatgataatccaatggtggatacatgtcattatacctttgtcaaaacccacagaatataaaacataagagtgaaccctaatgtaaaatatggacttcagttaataataatatatgaatattttttcattagttctaacaagtgtactacactaatacaagatattcagagtaggggaaattggaaaggaatgagaggttatatgggaactctgtactttctgctcaattttctgtaaacctaaaatcactaaaaaaaaagtttatttttatttttatttttttttaatttttaattttttgagatggagtttcactcttgttgcccaggctggaatacaatggcacgatctcggctcactgaaacctccgcctccagggttcaagcgattctcatgcctcaacctcccgagtagctgagattacaggcatgtgccaccacgcccagctaattttgcagttttagtagagacagggtttctccatgttggtcaggctggtcttgaactcctgatctcaggggatctgcccgcctcggcctcccaaagtgctgtgattataggcgtgagccactgcgcccagcaggtttttttttttaagttggatattagccatttcatatgattcaacttaaaagtacatacaccttcactgttattaaagtgtaggtgagatgttttcagtctggagctctacccttgattcctgccatgcctagtgtccctgaatctggagactctgacttatttctttagagaacgaaactcctgccttctgctttggtggtgattggtacctgcttgactgcctttggtggggagttcctcataccaactttcaatcagttcctgtgtttgtttgtttgtttgtttttgagacggagttttgctctgtcgcccgggttggagtgcagtggcgcaatcttggctcaatacacgctccgcctcccgggttcacgccattttcctgcctcagcctcctgagtagctgggacgacaggcacccgccaccacgcccggctaatttttttgtatttttagtagagacggggtttcatcgtgttagccaggatggtctcgatctcctgacctcgtgatccgcccgccttggcctcccaaagtgctgggattacaggcgtgagccactgtaagccaccgtgcccggccagttcctctgtttttgactgcctgccttactactgctttctgtggtgcctgataacatccaattcctgaaccttcctgggatttttgttcacgtcagcgtgcttcttgcatttaggtatcccttcacaagtaggcatttaggttttaagctctgctaagtgatttaccacactttatcagttctccattttgtggaattcattgtgttaatctccttttctatttttgtttggaagattcatatattttttattcatttagtattttttggtgggatttctaagtagagaaacatgcctatgttcaatatgtcttgtttaagcagtctgctttcatttttaccaccgaggagttggttttatttctttttttttttttttttttttttttttttgagacagggtctcactttgtcagccaggctggagtacagtggcacaatcaaagctcactgcacccttggcctcccaagctcaagtgatcctcccacctcagcctcctgaatagctgggagctcaggtgatccagcacacccagctaattttttttttttttaattttttgtagaagcagagttcccctatgttgcccaagctggtcttgaactcttgggctcatgtaatcctcctgtctttgccccctaaagtctgggattacaggtgtgagccaccacacccagctgtttttaattattacattaatttatgattatgtgtttcctttaaagctatgggcagctctgtttgggaagatgctactgaaaaaaggatgctttttagatggcaaagagtacttaaaatgtctctagaatcatagttgtaaactaaagtatatattttttagttgttcacagggcttagagctcctgccagagggctgttactctttggtccacctgggaatgggaagacaatgctggtaagggttctcttcaaatttgagttttctgttgagatatttgggataatatgaaaaaaagaaactttatcttgtccttgagtctattatttacgacttgctttttgctattgtacacttttgttttttttgtttgtttgttttgttttgttttgagtgatctgggctcaccgcaacctccgcctcctgggttcaagcgattttcatgcctcagcctcccaagtagctgggattacaggcacacgccaccacacctgtctaggttttttatttttggcagagacaggatttcgccatgttggccaggctggtgtcgaactcctgacctcaagcagtcctcctacctgggcctcctaaagtgatgggattacaggcatgagccactgcacctggctgatacacttttaagtttttcagctacttttcaatgtagaagtagatggaaaaccatgtacgttatcttcagtagtgtgtttttggttggttaaatttgacagtatgattgtcattattttttgtaaattaaatttttacctggaagagcttaccttactatattgagtatctttctaacccctgatttttgcttctactatcataataactttatttaagtaatcagtatgttatagcttttttttttttttaagtattcttttgccagaagtttttatcaggctctggatacctctttcctctgcatagtcctcctggatggaagaaacaaagagggaaagagtaacttttccttagatgtttgtctttctcaaagcagttatctttgtatatctaagaagagaggagaataacactgtctctctttttttttaaatctctctctactcattctctctcaggaggagagtagaaagaagcacagctcttcctataacctgtccttattactgagaaaggaacacattgattgccatgtattggggattgtattataccttacatttttatttttattttttattaatttttttttttagacagtcttactctatcacccaagctggagtgcagtgatgtgatctcggctcactaccatctcttccttctgggttcaagcaattctgccacgtcagcttcccgagtagctgggattacaggcatgcgccaccacgcctgactaatttttgtatttttattagagatgggatttcaccatgttggccaggctggtctcaaactcttggcctcaagtgatgcgcctgcctcggcctccgaaagtgctgggattacaggcatgagccaccacacctggcctcatagcttacatttttagagaatcttttctagtacttaaatcggtaaatatggttatcttttaaatgtaatatattgaactaatttaatatttgctcttgtgatttttaaaggctaaagcagtagctgcagaatcgaatgcaaccttctttaatataagtgctgcaagtttaacttcaaaatacgtgagtgctctgtttccaatattgtcgtattttaagttactgtctaaatgttactgtgttaactgtaaatggtaatatttcatgaaaatatttttctaggagcttatctattgtatctattatttacatatgatgaatatctatcttcagagtagaaagttatgtacatttgtgttgtcaaatactgtattagtttactggggccatgtaataaaataccgtaaactggctggcttaaacatcagcaatttattgtctcacagttgtggaaggtagaagtctaagatcagtcaaaatgttggcagggttgcttcctcctgagggctgtgagggaaaatgtatgttgtgtgcctctctcctggcttctggtggcttgctggcaatcttttgtattccttggcttgtagatgcatccctcctatctctgtctttatctttatgtggcattctccctgtgtctgtcaccatgtccaaatttcccctgtggattaggacccaccctaatgatctcaatttaagtttgtcatcagcaacaattctatgtccaaataatgtcacattcataggtactagggataggacttcaacacgtttttggagaacacagttcaacccattaacaaatactatcactttccacttaagcttcaagtaaagtggattttatctcaaggagccaccagataggaacacagatctgatggcataaactgagtatttctggccttctgattctgatctaaaatatgacagaagattttccctgttttaattttttttttttttttataatagagacacagtctcgctatgttgccaggctactttcaaattcctgggcttaagcaatcctcctgcctcggactctcaaagtgctggaattacaagtgtgagccaccacacctggccagtagattttccctgctttcttttgattgtttataattttgttttctttttccattcaccctctgctgaccctatagtattattcaaagaagtgttcagtctagttttggggtagggcaagcataactacagtgcttaaagagagtaatttgtctggtgtgcagaactagtgtgtaaatataactggtgcattgcaaaactgtgaagtagtttctgtcaaaccttacactgctttgtctttctccctctctccctttctcttggttgccccctccccctcccaatgataccttagtctctgcttgcctttatcaaaacctttatgattggccgggcacagtggcccatgcctataatcctagcattttgggaggctgaggcaggaagatcacctgagcccagaagttggagaccagcctaggcaacatggtgaaaccccatctcttccaaaaataaaaaatagagccaggtgtggtggcatgcacctgtagtcccagctactcaggaagctgaggcgagaggatctcttgagcctgagaggttgaggctgcagtgaactgtgatcatgccactgcactccagcctgagtgacagtgtgagaccctgtctcaaagaaacaaaacaagggggggcatggtggctaactcctgtaatcccagtactttgggagactgaggcaggaggattgcttgaggccaggagttcaataccaccctgggcaacatagtgagacccccatctctacaaaaaataaaaaatttagctggacatgccagcgaatacgtggtcccagcaaatcaggaggctgaggtgggaggatcacttgagtcaaggaggttgaggttgcagtgagccacgatcatgccaatgcattccaacctgggcgtcagagcaagaccacgtctcaaaaacaaaacaaaacaaacttttatggttgaaagtgttttggcaaacatacttaaactgaaatgtgaatctctgatgaaagaacatgttacctgtaaaagtttgaagtgtcagcatttgttgcaccgaaatccagaggtgaggccaggtgtggtggctcacgcctgtaatcccagcactttgggaggccaaggctggcagatcacctgaggtcaggagttcaaaaccagcctggccaacattgcaaaaccccgtctcgactaaaaatacaaaaattagccagacttggtggtgtgcgcctgtaatcccagctattcgggaggctgagacacgagaattgctcgaacccaggaggcagaggttgcagtgagccgagatggcaccactgcactccagcctgggcaactgagtgagactctgtctcaaaaaaaaaaaaaaaaaaaaatccagaggtgaatccagaggtgatcaccacatgatatccagatagcctctttccatgagaggctcaaaggataattttactgtctacagttttgcagcgagagaaacttgattttatcagtacaccaagagcagatctatgtcttcggaacagacatgagatcagaattgtctagctgctatgaacagcatgttctctccctgtacctatagacatgtatgggaaacttatttgtaaggttgtataatgagcagtgagttaaagcaaacttgacatgttgaccatagttgttatggcattggactaaagtagcctccatcactatgatagagatagccttggtgttggacccatagtttttgaagtctgtttgctaagactccctcttccttaggcagttcttcaaatattattatgctttttcctgtcatgggattcctcttcatggagtttcctttctcaggaacactatcttctcctggttaatttgtacttattcttcagataccagttgaaatgttacaaccttccctgaccctccaaactattccccgttattattctcctagcaccacttgcacctcattttcatactcactggagttgcaattcatattcattgataggattattttaattgtatctgatatcactgtcacctccactagaagatggtctccatgcgggcagagactatcaccatgtgttcttcacttcaattttcagtagttggctgtgagtaggtattgaataaatatttgtggagtaatcataatgaggtatagatattattctcatagctctattttattaattagggaattacagaattcagtgatctgctcaggatctcataaccaggaagtgggaaactaggatttgagctccagtgagtgtggcctttcattaaaaatattacagcaaccattctctttttttttttttttttttttgagatggagtcttgctctggagtgcagtggcgtgatctcggctcactgcagcctctgcctcccgggttcaagtgatccccctgccttagcctgctgagtagctgggactacaggcacccgccacgacacttggctaatttttgtattttagtagagacggggtttcaccatgttggccaggatggtctcgatctcctgaccttgtgatccgcccgcatctacctcccaaagtgctggattataggcgtaagccaccacacccggcctacagcaaccattctcttttatccatacttttttcaagagtactgtttcatcttcatgttttcagaaacaacatagcattcatgatcttaacccccaattctgatactgcctgaatatcttgaagtaagtttacttttaagaaagttgaggctaggtgtggtggctcatgcctgtaatcccagcactttgggaggccaaggcaggtggatcacttgagctcaggagttcaagaccaggctgggcaacatggcgaaaccctgtctctaccagaaatacaaaaaattagtcgggcgtggtggcgtgtgcctgtggtcccagccacttgggagactgaagtgggaggatttcttgagcttgggaggtggagtttgctgtgagccgagagatcatgccactgtactccagcctgggtggcagagtgagatcccatctcaaaaaaagaaaagaaaaagaaaattgaaatgtctagtctatcattttgtcagttctatctaatacaattttttccttatgtctaactgaaatctgctttttctaatttttacatacttgatttaacaaaactcaatctttttttttttttatgagacagcctttcaaatatataggaacttaatgttatatctgcttccctccagtccccagaatagttactattttagttgtctttctatggtctcatgccagtttgtcagtatgcctagataagaactgaatattttacctcagatgtgacctgactttgaagacttaaaaaggaagcattgtgccaggcgcagtggctcacacctgtgatcccagcactttgggaggccgaggtgggcaggtcaggagtttgagaccagcctgattaacatggagaaaccccatgtttctctactaaatacaaatctctactaaatactaaatactaaatctctactaaaaatacaaaagatgagctgggcattgtggcacatgcctgtaatcccagctactcgggaggctgaggcaggagaatcacttgagcccaggaggcggaggttgcggtgagccgagattgcgccattccactccagcctgggcaacaaaagtgaaactccatctcaaaaaaaaaaagcagcagcattgtgtaatattatgtagatgttgtgtctcatgatctatcctgagaaagcttttgggaggaactgcatcatagtcatggacaacatttgtgttattaaaatatctagattattttccacaaaaaatcagttacatatgtatcttaacatgttgtattattgtttaaccttgtttattgaataactaacatgtagaaaagtatttatagcataagtatacagctgtatacagctcagtggattaccacaaagcgaatatactttcataatcaccacccaggtcaagaaataaattgttacctgtggccctaaaatccctccaggcactccaccatctttatccactcactcctctccctcaaaaccactagactactaacatcatagacaaagctagcatgcctttgaactttatataaatctaatgatgtaggattttgtgtgtatgtgtatttggcttctttcatcagcattgtatttgtgagatttatccagattgttgcaagtagttgtagttgtgcttttttacacagatttaatttttatatttttcttatatgttcgaacagttaacctgcttatctattattaaaaaaaaaaaaacgaacattcacatagttcttaccagtttacagtgttttttccacaccgtcttcaaaatgtaaagtttggtcttcaatacatcagtatgctgctagatttaaatactagggaaaaaaaaatcagagaagttaataatattaactgtcacctccactagaagatggtctccatgtggacagtaatatttctcttgtattatctgtgctaagtaaaatcttctgtaagtttctttaaatattttaataaatcatagtacttaaaatgttctcaatattctaaagtagttaaaagtaactataaaatagtacctgtttttctgatcacattttacttcctatgtgaaattttacaagtcgttactctatttatttattgatttattttttaagacagggtctgttctgtcgcccaggctggagtacagtggcgtgatcatggctcactgcagcctcagcctcctgggctcaagtgatcctcccaccttagcatcccaagtagctgggactataggcacatgccaccatgcccagctaattttaaaaaattctggggggccgaatgcggtggctcacacctgtaatcccagcactttgggaggccgaggcaggcgaatcacaaggtcaggagttcgagaccagcctggctaacatggtgaaaccctgtctctactaaaaatacaaaaaattagcggggtgtggtggcaggcgcctgtaatcccacttactcaggaggctgaggcaggagagttgcttgaacctgggaggcagagattgcagtgagccgagactccatctcaaaaaaaaaaaatttttttttgtagtgacaaggtgtcactgtgttgccagggctggtctcaaacttctgggctcaagtgatcctcccatttcggcctcccaaagtgctaggatcacaggcatgagtcactgtgcctggtcttcaagttgttattaaagcatgtttacccacattatgcacatggtataatggaaagtattgttgtggaagttaggagatagggattctagcctagctttttatttttttgggacaaggtctcactttttcgccccaggccgaagtgcagttgtgcgatctcggctcactgcaacctccaactctcaggttcaagcaattctcccacgtcagcctcccgagtagctgggattacaggcatgcgccaccacgcccggctaatttttgtagttttagtagacacagggtttcaccatgttggccaggctggtcttgaactcccgacctcaggtgatccacccaccttggcctcccaaagtgctgggattacaggcatgagccaccgcacccggcctctagcgtaacttttacatcctgaactgaccttaagaaagtataactttaggcctgtttcatctgtaaaatgttaatgtcataggagatgatcttttgagatttctttcagctctgataattttgtgtgtgtgtgtgtgtgtgtgtgtgtgtgagatggagtcttgctctgtcgcccgggctggagtgcagtggtaccatctcggctcactgcaagctccacctcctgggttcacgccattctcctgcctcagcctcccgagtagctgggactacaggcgcctgccaccacgcctggctaattttttgtatttttagtagagacgaggtttcaccgtgttagccaggatggtctcgatctcctgacctcgtgatccgcccgcctcagcctcccaaagtgctgggattacaggtctgagccgccgcgcccggcctagaatatttgtttcgattattctaaatctggtgacatttcttttgtttttaagttaaatcttcagtaaaaagaataaatgccacctagaggacagaaaaatttttacagtagattatcacagacctcatgactcattactttggtgtataaaatggcctttgtatggtgtcagcacctgggaatgtctcaaggggtgttcattgaccttctggactatctggaaatattttgatatttattggctgggcgcggtggctcatgcctgtaattccagcacctcgggaggccaagttaggtggatcacttgaggtcaggagtttgagatcagcctggccaactaagttagttgactatttgtgaaatttccctctccaaataggaaagataggattggaaacattattcagaaggaagaagttttaaagaagggcaggcttaaagactatctaatgaatttaccaatatggtaaaaccccatctttactaaaaatacaaaaattagccaggcgtggtggtgggcgcctgtaatcccagctacctgggatgttgagggatgagaatcacttgaacccaggaggcaaaagtcacagtgagccgagattgcaccactgcactccagactgggctatagagcaaaactctgtctcaaaaaaaaaaaggaaaaaaaaaaaagaaattttgatatttatgtgagaatgacttttcacggtgttcttaatagcgcaagttttgtttaggagagcacattccaacttacttgcttctataaatataccgtgtaatctagggcttaaagaatatgtacaatgtctttttctctcccctagtcttccccttttctcactagttatatccttgactgaagagctatttcattctcaagtcttaggaatgcagggtgaagcaaaacagatgaatttttaaagcacttaaccaggctgtatgaaatcacagtctgttgtctaaaattgtaagggacggttagtagtactctcccctttctcaaaccaaatctttggttgttttaaggaagggaaattaaattcctgtgtgctagattttcaacataaaatttaaaaaactggaataatgttgcattttatgtgtataacagtataatgctttgttttaggtgggagaaggagagaaattggtgagggctctttttgctgtggctcgagaacttcaaccttctataatttttataggtaagaacatattttccaactaagttattgactatttgtgaaatttccctctccaaataggaaagatacgattggaaacattattcagaaggaagaagttttaaagaagggcaagcttaaagactatctaatgaatttagtaggacccactatattaataagtagtaaactagattaatctcagatgactcacatagcttggtctttaattaaagtcttatacttgtatttcctctagatgaagttgatagccttttgtgtgaaagaagagaaggggagcacgatgctagtagacgcctaaaaactgaatttctaatagaatttgatggtgtaagtgttgattatgatatttttaatgtggcagcattttagtatattttcctattaaatggccaaggttaaaaatacaaatatctttatatttgttattacttttctaaatgaattgaaaaaagattttttgcttgtaggtacagtctgctggagatgacagagtacttgtaatgggtgcaactaataggccacaagagcttgatgaggctgttctcaggtagggagatttatatggaaatacatgcatttattacagacaatatttactcatgtgtccatcttacatattatttccttactctcagttttaagactaaattcactattttcttccagtactatctctagcctcttgttaccaactacataaggattttgaggtcaacagcttgatatcaggagaattagtctagtaaaggtttagttacggttttaggcaaattggtcagttcttctgggttgcattaaattatctttaaacttgaaaattgattcttaccgtcttttattgggcttcatgagaaaataatcaaatcagggttcatggaaaatgtgttttctgttcttgtgtgtttgagcagtttattcccttcatactggaaggacggtttgggtcagcataaaattcttgggcatcctttcccaaggaatttacaatattgctccattgtttctagattggctgtagtagtgtaaaagtctgaatccaaattgattttttcaaatttgtaaaataacttgatttttttctctctttactggatgggttacgtgggtatattgcacccaggtagtgagcatagggtgcagtaggtagtttttcaacccacacctcactgctttcttcccccatgtagtagtccgcagtgtgtattgttcccatgtttatgtccatgtgtactcaatttttagctccccacttatgagaacatgagctatttggtttactgttcccacattaattggcgtagtattaaggcctccacctccatccatgttgctgcaaaggacattatttcattcttttttatggctgcgtagtacatagtattccatggtgtgtacgtaccacattttctttatccagtccaccattgatggacacttagattgattctatgtctgctgtcatgaatagtacagcaataaacatgaaatgcatgtctttttggtataatgatctattttcctttgggtatatacccagtaatgggatttcagggtcaaaggtagatttgttttatgttttttgagaaatcttcaaactgctttctacaatgactgaactttacattcctaccagcagtacatacgctccacaacctcaccaacatctgttatttttttactttttcccgccaatctgtagacaatatgggattttttttgccattttattaatagccattctgactggtgtgagatatctcattgtgattttgatttgcatttttctgatggttagtgatgatgagcattttttcatgtttgttgtcccctcgtatgtcttttgagaagtgtctattcatttcctttttacccattttttaatagggttgtgtgtttttagcttgttcaattgtttgaattccttatagattctggatatcagaccattgttagatgcagttctgtagattgtctgtttactctgttgatggttctttttgctgtgcagaagctctttagtttaattaggtcccacttgtcaatttttatttttgttgcaattgtgtttggggacttagccaaaatttctttctgaggctgatgtcaagaagtgtatttcctagttttcttctagcatttttatactttgagatcttacatttaaatctttaatccaccttgagttaatttttgtatatggtgaaaagtaagggtccagtttcatttttctacatatggctagccagtaatccccatgccatttattgaatagggagtccttttcctcattgcttgtttttgtcagtcttatcaaagatcagatggttataggtgtgtggctttatttctcaattttctgtcctgttcctttggtttgtgtgtctgtttttataccagaattatgctgtttgggctgctgtgtagttcggtttaaagtcaggtaacgtgatacttacagctttgttctttttgcttaggattgctttgtctatttggactctttttttgcttccatatgaattttagaatatttttttctaattttgtgaaaaacaacattgatagtttgatagaaataccattgaatctgtaaattgctttgggcagtatagtcattttacgaccagataaatcaggcaagagaaggaaacaaaaggcatccaaataggaaaagaagtcatcatactctcactcttcactggcaatatgattctatactttgaaaaccctaaaaattccgtcaaaaggctactagaactgataaatgattttaccccaagattcaggatacaaaatcagtgtacaaaaaattagtaccatttctatacgctaataatgtccaggctaagagtcaaatcaagaacacagtcccatttacaatagccacaaagaaaatgaaataatggctgggcacagtggctcatgcctgtaatcccagcactttgggaggctgaggcaggtggatcacctgaggtcaggagttcgagaccagcctgaccaacatggtgaaaccccgtctctactaaaaatacaaaaaattagccaggcgtggtggtgggcgcctgtaatcccatctgctcgggaggctgaggcaggagaattgcttgaacccaggaggcataggttgcagtgagccgagatcgtgccactgcactgcagcctgggtgtgaaagagcaagaatccgtttccaaaattaaaaaaaaaaaaagaaaaaaaaaaagacaatggagtacctaggaatacggctgatgaaggaggtgaaagaatctgtatgaggagaagtgtaaagcactgctaaaataaatcagagatgacacaaataaatggaaaaacactccatgctcatggattggaagaatcaatatcgttaaaatgggaaatttatcttaatttttttccctagttcatttttctgttttcttttgcacataaattatgtgttatgttgcgtccttttgttttccctatctgtaattttcttcttcatccttttaaactcttaggtctttttgttttgttctgttttcccaagcctgttgcctttatttcttactgggttagtatctaatctcctttctgctatatcttttgtaactcttctttccttggtggttttttattcattactttcctgacatctgttattctacttttcatcttctgttttatttctttgagcatctgtatgttatttccataagctcttacatttcactgggctcttgtttcatagaaaacaattttttggcaaggacagaccacttgaggccaggagtttgagaccagcctggccaacatagtacaaccctgtctctgctaaaaatacaaaaaattagctgggtgtggtcacacacacctgtaatcccagctactcaggaggctgataatcgcttgaacccaggaggcagaggttgcagtgagccaagacggcggcactgtactctagcctgggggacagagcaaggctctgtctcaaaaaaaaaaagaaaaaattttttggtcaggcgtcatggtgggtcacacctgtaatcccagcactttgggaggccagatcacttgaggccgggaattccagaccagcctcgccaacgtggcaaaaccccatatctataaaaaaaacttaaggataaaaaaaattaaatttttaaaaaattaaattattttatttcgtggaaagatacttggtcataattttagtttgctctatggcaaaatcttctcatgcatgttcttcattttatctagtttatgtttattgtgttttgtttgctcttttttgggggcaggttttgttgttgttgtttttttttttttttttttaaatgagccctgtcctggtttttccttttttgcttattatttttctttgaataaaaggagttttcttggaaaacctagttttggaaggatattgtaggggaagggataggtatcttgagtagtccatgtatacactaaactagcatgcagcctccctcacttacagtgaagccctacctaataatgaagtatatgtgtatgtaaataagagatagggttgatttattcttctactaaaaaatattggtcactgcaagacattgtcttcccgccagactgttagatgccttcttataaagataattcgtcttagagtttctttgttcattctcaccttccttgccattcctatgctatcaattagggtttatatggtctgcagagccaggcttcatatgcttgtttaaatgtggagggactggccttattaccctttagggtgtgctatctctttttgggaggaaaactgtactctgacagtcatgtccatgatctttagcggcagatcctttgtgtgtcttcctttgtcagtgtaattttcactgccctaggcagttcacctttatgtattttagttccataaatgttacctagtttgttgatgaagtgtatgtttctgtttctattatccttgctgattttagtttttttcagattcaagaagacagatctacttatatcagatattttgtttgttttaaagcattactgctattaaaaacatatacatacataaatgattaattctaacaataccgaattaaggattttaaacattaactagagttttaaaagagtaacaaaaatatttttacattgataactaccaaaatgcattccagtgccttgaatattatattttaaaagcttttcctgtcatttgctgtttcagctttaaattcaaaattatatttctaaaagtgctggatttttttttttaggcgtttcatcaaacgggtatatgtgtctttaccaaatgaggaggtatgtatctgtgtttgaattttttttgttttagagcagaaacaagaactaccatcttgacaatattaagtcttccaatccatggtacagctactttggaaaacagtttagtggtttcttaaaaagatgtacataagcttactgtcagagccagcaatttcactcctaagaatttaccccagagaaacaaaaatgtatgtccacacaaagacttgtacaagaatttttatagcagcaatattaataatagccagaactacaaatgatctaaaatgtttattttggtgaataaacaaatgtggtatattcatttaatggatactgttatccattatacatgctgcatactcacttcatatattaagttttatgaatgaaactccaaaacattataagtgaaagaagcaagatgatatatgtcgcatatcataggattctgtttatatgcagaaaacgcaaatttattttttatttatttatttttttgagatggagtcttgctctgtcgctcaggctggagtgcagtggcgtgatctcggctcactgcaaccttcacctcctgggttcaagtgattctcctgcctcagcctcctgagtagctgggactgcaggcatgtgccaccaggcctggctaattttttgtgtttttagtagagacgggtttcactgtgttagccaggatggtgtgatccgccctcctcagcctcccaaagtgctgggattacaggcatgagtcaccgtgcccggccagaaatcgaaaatttctagaaacgtaaagcagatcagtgggttgtcagggtgagagttgggaatgaggattaactgcaaacaggtatgagtgaactaaaaagtgttctaaaactggattgtggtgatgattgcacatctataaatgtattaaaactcattgaattatatacttacaatgggtgaaattcatagtagatgaattcatacctctataaaactggttttttgcagcaaaatatttattgctatgtttttattcaagtgtggtgaattattgctatgtttttatccaggtgtggtgtctcacgcctataatcccaacactttgggaggctgaggtgggaggatcgcttgagccaggaattcaagaccagcctgggcaacatagggagaccctgtctctacaaaaacttttttagaaattaaccaggcatggtggcacgtgcctttggtcccagttactcgggaggctgagatgggaggattgcttgaacccaggatatcgaggctatagtgagctatgattgtgccctgcactccagcctgggtaacagcacaagaccctgtctcaatataaaaaaagaaaagaatcattaattctgaaattagactgaatgatcattttttaatatttttcagacaagactacttttgcttaaaaatctgttatgtaaacaaggaagtccattgacccaaaaagaactagcacaacttgctaggtgagtaatttggatttggtttatcttacagcttttatttattttttgtaaataattctttttttagttatttaaagtaatcttaagtatgaaatgagtaattcattgatcagaagactttctctcatcctctacctcctttgcctttttcttacctcttgttcttatatatatatgtggaatctaaatttcactggctatgtcctttgcaagacgtgatctaatgatgatagtatattctttttataaatttattaaaacctgtaagtggtattaaagtaatttaaacatttacaccttaggcaacatggtaaaaccccatctctacaaaaaataaaatgagtcaggaatggtggcacatacctgtagtcccagctacttgggaggttgaggtgggaggatcgcttcagcccgggaggtggaggttgagcaacagagtgagaccctgtctcaaaaaaaattttaaacatttcatattgcacactaacacagatatttttatataaacttgttcttggcatatgctgaatacttttcagctcttttaataattttaattatttgataattttaataattttaatttcagctatttgaataatcttaaactttatgaacagtgtgaagtagaaactgagtataggagatgcgctcatgaattttattccctgaaaaatgtcataaagtaatataaagtattcaatgagtatgtgagtattgaataattttaacaagaactctgagttcccagatacctatgacaaaagaacaaattacttggaagtctcttctactccagacctttctgtctatccccttatttaaaaaaatgtacattgattgtcccttatcccatcaagagagtgttctttgccaagataaacgctaattagagaagtaattgtgtttatgtgtcagttggccaccagtagtttgtagatgttacctttccaggtgacatgtttacaatttaatgaagcctctggagatagtatgccttaatctaaaggaatggttctaatgattaaaatttgaggcattactacatttgttttcagcaaatgggcctttctattcccttaaaatcaaaccctcataactatgggtttgctgacaaagggaaactagtttttactcttattatatggagattttaaatctgcagagatgaaaataatttgctgtttcagctgggtgcggtggctcatgcctgtaatctcactactttgggaggctgtggcgggtggatcacctgaggtcaggagttcgagaccagcctgaccaacatggcgaaacgccatctatactaaatacaaaaaaaaaattagccaggtgcggtggcgcatgcctataatcccagctacctgagaggctgaggtaggagaatcgctccaggaggtggagatcacagtgagctgagatcatgccattgcactccagcctgggcaacaagagcaaaactccatctcaaaaaaaagcgggaggggaaataatttgctgtttcttccttcccttcctcagaatgactgatggatactcaggaagtgacctaacagctttggcaaaagatgcagcactgggtcctatccgaggtaggtatacaagagcttaaaacatttagaactatttattataccaccttagaagtttaagaagtccaaaaaaatctaccaagagattttttttttcttttggagacagggtctcactctgttgcccaggctgtagtgcagtggcacaatcatagttcactgcagcctcgaaccccccaggctcaggtgattctcccacccagccttcccagtagctgggactacaggcatgcaccatcatgcccagataattattttattttatttcttgtagagacagggtttcaccatgttgcccaagctggtcttgaactcccgggctcaagtgagcagcctgccttggcctcccaaagtgctgggattacaggcatgagccaccatgcccagccttaaaaccattcttagctcacagatcatacaaaaacagtctatgagccagtagactgtgacccctgttctaggcaagaggtttcatttcttgatagtaagtaagcagcagaaaactcaaaaagaaaactttaaacaaaaaagaataatgtaaggaaaatgttcttatctgttttctggctcttttcagtattctgacatcatttgaaattaatgtgtctaaaggaaattctataagagaagttttcacttttttaattatatcttttgagggattgcagcaaaatatttattgctatgtttttattcaggttacttggttgattctgaaataccacgaccaattctttttaggttaggttaggataaactcacacagatattttcagctacatttccacagccagcatcggtagtggatggttgatgctctcaggtatgcactcagattattagctatgatgataaagtaatcataatagctccatccctttctctcattcaagaaagtacaattgaatgtagttgtacgagaaagatgttatcatagtgtctactgtaatttgcattaaaagcctacattatacaaacctttttgttttactagttaaaaattaccagtaacacctcccgtagtgaaatagggtgctgattaagaactgctactttgcaaaataaaaaatgtaatcttgagagtatattttgaaactctggatgaacaaattttcttgctgctggagcttaaatcttgttcagttagtggatttagaaacagtagctaatgcataaatgagttgtattttcttagaacgttttggctattctaaggtagacaaaatttgggtttaaaaaaagattcgcatccattaaagtacagaaaatggccgggtgcagtggctcacacctataatcccagcactttgggaggccaaggtgggaggatcgtgtgggcctaatagtttgagactagactgggcaacatagggagatcctgtctctacaaaaaaatataataaattaaccaggcccgttggcatgagcctgtaatcccagctactcgggagtctgaagtaggaggatcacttgagcctggaaggtgcaggcagcagtgagccatggtcatgccactcactgcactccagcctgggtgggtgacatagtgaggtgctgtcttaaaaagtaaataaataggccaggcacggtggctcacgcctgtaatcccagcactttgggaggccaagatgggtggatcatgaggtcaggagttcgagaccagcttggccaatatggtgaaaccgcatctctactgaaaatacaaaaattagccaggcgtggttgtgcgcacctgtaatcccagctactcaggaggctgaggcaggagtatcgcttgaacctgggaggtgaggttgcagtaagccgagcactgcagcctgggcaacagagcaagactctgtctcaaaaaaaaaaaaaaaaaaaaaaaaaaaaagtaaatacataaagtgcagagtaaaaacaaaaaaagactaatgcattttgtaaagaacaagttgcattcttttaagttccctttcaaatttgtgaactattgtttttgggcagtatgcaagaaattgaacactttccagttattccaaagaaggaatattctcttctcagcatttataaattgtatttgctctcaaagttaacatgtgtctcttttttttaatataatgatttgtactgaatagatacatgtagatcattgtacttggttttgcccttcaacaatttcaactgcaaaatgtatgtatttttaagtgcctgacttttatgttttacagaactaaaaccagaacaggtgaagaatatgtctgccagtgaggtatagtattttacaatgatattttctttgtcttctatattgtaagacatatataagacatacatatatgaatgtgtgtgtgtgtggtttttttttttttttttttttttttgagacagtctggcatgatatcggctcactgcaacctccacctcctggattcaagctattctcctgcctcagcctcccaagtagctacaggcatgtaccaccaagcccagctaatttttgtatttttagtagagagggcatttcaccatgttggccagtctggcctcagactcctgacctcaagtgatccacccaactcggcctcccaaagtgctgggattacaggcttgagccgctgcatctggctgttttgtttgtttgtttgtttgtttgtttgtttgagacggagtctcactctgtcgcccagactggagtgcagtggtgcgatctcagctcactgcaagctctgcctcccgggttcacgccattctcctgcctcagcctccctagtagctgggactacaggcgcccaccaccacgcctggctaattttttgtacttttagtagagacggggtttcaccgtgttagccaggatggtctctgtctcctgatctcgtgatctgcctgcctcagcctcccaaagtgctgggattacaggcgtgagccactgcgcccggcctttttttttttttttttttgagacacagggtcttgctctgttctcaggctggagtgcagtggtgcaatcgtggctgactgtagccttgacctcttggtctcaagcagtcctcttgtctcaaactttttagtagctgggactacaggcaagtgccacaacgccccactaattttttaattttctgtagagatggtgtctctccctgttgcccagggtggtctcagactcttggcctcaagtaatcctcctgcctcagtctctcagagtgcttgggactaattttttttaatggatttttctagttgattagaagctagaaaaaattaactttgcttcatttcaaaatatggaaacctatgaaatagtcaaaattttttttggtaatagacaaaacatatatacataaagtcattttctatcaaatcatattacataaataccaaacagaagaaaattacaggccgggtgcggtggctcacgcctgtaatcccagcactttgggaggccgaggtgggcagatcacttgaggtcaggagttcaagaccagcctggccaacatggtgaaaccctgtctctatcaaaaatacaaaaaaattaggccgggggcggtggctcacacctgtaatcccagcactttgggaggccgaggcgggcggatcacgaggtcaggagatcgagaccatgctggctaacatggtgaaaccctgtctccactaaaaaatacaaaaaaattaccggggcgtggtggcgggcacctgtagtcccagctacttgggaggctgaggcaggagaatggcgtgaacctgggaagtggagcttgcagtgagccgagatcgtgccactgcactccagcctgggcgacagagcaagactccatctcaaaaaaaaaaaaaaatagctgggcatggtggcacgtgcctgtggtcctggctacttgggaagctgaggcaggagaatcacttgaacttgggaggcagaggttgcagtgagccaagattgccccattgcactctagcctgggcgacagagtgagacccagtctcaaaaaaaaaaaaattacatgaaacttgtgggggtttatacaataaaaataacctataactatacgttaatcctttaataatgttctattttgtttttcaataacctttatttttttaattaatttcttttttttgagaaggactctggctctgtcacccaggctgcagtgcagtggcaccatcttggctcactgcagcctccacctcccaggttcaagcgattctcctgcctcagcctcctgcgtagctgagattacaggcatgggccaccacgcccagctaatttttttttttttttttttgtatttttagtagagatggggtttcactatgttggccaggtgggtctcgaactcctgacctcaggcgatcgccagcctcggcctccctaagtgcaaggattacaggcgtgagccaccatgcctggccaatttattaccgtttcttaatatggaagacctccttatgagatgctgaagcatttcatttgaaaaaagttgcatgtaaaatataaaattgggtatgcagaatggtcataactctgtgagcaaaattttgaaatcaggcttgaattacagtcagccttttctatccgtggattctgcattcatggattcaaccaactgcagatcaaaaatacttgggggaaaaaagcatctgtgttgaacatgtacagacttttattcttgttattattccctaaacaatatagtataaaaactatttacattgcatttacattgtattaggtgttataagtaatctagagatgatttaaagtatacaggaggattgtgtaggttgtatgcaaatactgcaccattttacataagggactttaagcgtttgcggattttgctatctatgggggaaccaatttccgagagatactgagggacagctgtatatttgtaacttattttttatttccctaattgcagcagctgttgaggggacagtgaactgttaacacagataacaagtgtattcaagtacattttggagtttgtttgtttttttttttcaggcttttattcgcctgtcggatgaggcaccatacttgaatttttttttttaagaaagcttttagttttctttctttctttttttttttttgtgagatggagtcttgctctgtttctaggctggagtggagtgcagtggtgtgatctcagctcactgcaacctccgcctactgggttcaagtgattctcctgcctcagcctcccgagtagctgggactacaggtgcacgccaccacgcccagctaattttttttttttttttttttttttgtatttgtagtagagacagagtttcaccatgttggccaggatggtctcgatctcctgaccttgggatccgcccaccttggcctcccaaagtgctagggattacaggcatgagccaccacgcccggctgaaagcttttagttttctaacttatttaatttaatttaatttaatttatttttattttattttttgggacagtgtctcacttggttgcccaggctggagtgcagtggtacaatcatggctcactgcaccctctagctcctgggctcaggcaatcctcctgcctcagccttttgagttgctgggactacgggcatgtaccaccacactcagctaaatttttaattttttgtagagatggggtctcactatgttgcctaggctggtctcagattcctcaagcattcctcccacttgcacctcccaaaatgctgggattacaggtgtgacaccgtgccagacttgaaatttttaatcccacacctaaaaatataattttatccaccattttttaaaagtcataacattatttattaaaaatttagatggtaaaactaaaaattaaagcttaataaaactactgagtgatttacaaggaagaatattactggtcccttttgtgagcatcccattaattatatatattcaggttatattgttacaatatttggttctactgtatactttttttttttttttttttgagactgagtttcgctgttgttgcccaggctggagtgcaatggtgcaatctcggctcactgcaacctccgcctcctgggttcaagtgattctcctgcctcagcctcctgagtagctgggattacaggcatgcgccactatgcctggctaattttgtgtttttgtagagacagggtttcactatgttggtcaggctgatctggaactcccaacctcaggagatccgcccacctcggcctcccaaagtgctgggattgcaggtgtgagccaccatgcctggctctactatatactttcattcagttgtttctttttaatctagtggttttggtattaataatttgataatgacctttagctgttattgcttacttatgagttaatatttataaagcacttaaagtagctggcacgtagtaaacactatgtaaagatccattaaataactttaaaaaatataaaactgatagtggcattttattatagagattaaggtaatccattctctcatttccatttatgggatgagacgtaaacacaagtagtttgctctctaaaactgtatactagaattttatatacccattatttgatgcaactttaataccaaagtgtattgtcagttaccggtgaatatatataaatttaggtaaggaaaacccaacttggtcgcacacagtggctcacgcctgtaatcctaccactttgggaggccgaggcagttggatcacctgaggtcttgagttcgagaccagcctggccaacgtggcgaaaccccgtctccactaaaaatacaaaaattagccgggcgtggtggcacatgcctgtaatcccagctgctcgggaggctgaggaaggagaattgcttgaacctggggaggtggaggttgcagtgagctgagatcgtaccactgcactccagtctgtgcgacaggagcgagactccatctccaaaaaaaaaaaaaagaaaaacccaacttatcttttacagtttataatagtagaagttcaaataattggtttggaatttctgtatttttaaggttagtactaaaattgttggttataaattggggtacaatatactttgttttttaagtaccttgtgtatctaatttaactttaagtcctttattattttggtttgataagacaacttttctacttatttccccccttaactgaaccagctaccatctgcctttttcctgttgtatacattagtctcttacgttaaaatatcatataagtttcatatatatacacatatcaaactatagacttaaagtacaattacatcaacatcttttaaaaccttaatttctggccaggcgtggttgttcatgcctataatcccagcactttgggaggctcaggccattggatcccttgagctcaggaattcgagaccagcctggataacatggtgaaatcctcatctctacaaaaattacaaaaagttagctgggcgtggtggcgcacacctatagtcctagctacttgggaggatctcttaagcctgggaggcagaggttgcagtgagccgagatcatgccactgcactccagcctgggtaacagtgagaccctgtctcaaaacaaaaatattaatttctataacaaataaattttatttagtaatatcatgtttaatacccatgttacattcattattcttctacactttggcctttaggaagaggcagtgtgtgtgttacagttaaataggaaacaagtagggttcatatagtgcttatggggttttctttggtggggggttgctgggtttttggggtttttttttttgagacagggtatcactctgtctcccaggctgaaatacattggcatgctcatggctcactgcagcctcaacctcccagactcaagtgatcctcccacctcagcttccctagtagctgagactacaggcgtgcgccaccatgcctagctaaattttgtacattttgtagagatgaggctttgccatgttgcccaggctggtctctaactcctgggctcaagtgatccacttgcttcagcctcccaaagttctgggattaacaggtgcgagccactgcagccagcctatattttaactatatgtttttttctttttggctaaaatttttcagattagtttacaagttacaagtgtaggtgatatctcatggagatatcaaagatgatatgaagttagattgggtttttaagagtagtttttaaaatacggataaataccagttgttggagttttgtttaaagttctttaacttcttatttttgggccaaaatacaggtatacgctagaaatgatttttaacacaggtcatttatgccaaactgcattttgccttaatttttttttttttttttttttttgagagggagtctcactcattgcccaagctggagtgcaatggcacgatctcggctcacttacaacctccacctcccaggttcaagcgattctcctgcctcagcctcctgagtagctgggattacaggcacctgcctggctaatttttgtatttttagtggagacggggtttcaccatgttggccaggctggtctcgaactgctgacctcaggtgatccacccgccttggcctcccaaagtgcggggattacaggtgtgagccaccgtgcttggccaaaatttttattaatttttctattgcctggactctgtgaacctatccattttgccttttaaaaatacttaggtgtaaatatagatattcattaactcagcattgttttaatctatatttccaaaggcaatttaaaagatcagaaaataagaccaaattaatataaaaatgcatactttaggctgggcaaagtggctcacgtctgtaatcccagcactttgggaggccaaggtgggcggatcacctgaggttaggagttcaggaccaacctggccatcatggcgaaaccctgtctctactaaaaatacaaaaattagctgggcatggaggcatgtgcctgtaatcccagctactcgggaggctgagacagaagaattgcttgaaccttggagggggaggttgcatatctgagtggtgaaattgtgattctttttttctctttgtctgtatttttgaacttttctataaatgattgtgttttgtttttatattggaaaaatattatgctttcaaatgttaatacctatgaaactaaacacaagtaataaatatattagtatagcatttattaaggtttcttgtgtagcagatcaacatagaaaatatatttaaatggctgacataattttctaagaatacatacacgtatattttttataacattaagaaacagcagcatcattactttaatccatcatttcgttaaccaccatatacctgttgatcatttgtattgtcatgtgctttttaaaaatctagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctgggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctcaaacattacaacatcaattatgaaatactgataacgaaaggtagtaatgaaatatatatgatgaaaagaattgagaagttctaaattaagacatttcagttaagctcataaaatttcattgttttcatttaaaaggagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaactttattttgtctttacttttttactttaaaactttttgatattttaggggttggagtctgataatgaaggagttgtgtgtattggactcttagtaacaattataaacgcttaacaaaatatagaaagcaatgattgggtggctctgc

SEQ ID NO: 12761 - DNA, 41062 bp, Human
cgaaaatacaactttcaagcaacaagacatcttaccacactcaattagcatctacagagaaaattactttttatgaattcaaagacccaaaataataagagtcctttatttagattattatccaactaccttagaaaaatcaccaaaaataacttcatttcctatttgcctgcctttttcaaacccattcttccccacccactgtcttcctccatctttcttataaagaacctaaaaataaccaatatatttcttgttcattctcttcctcttacttctatgtgccaggttgggtaaagaaaaaaacaatgattaatgttggtccattacatcttctccaaaatgaaaatgcacacattttaaaatctagtacgtgcagctggtcaaggctgatgctaattgttttgcagctatcaacagtgggggaagaaagaaaaaacattatttatgatgaaagagccttcaatgtgcatataagcctctgaaatatgccaacaactccataacatccgttacctccttacatttcctgtaaagcaccaggaaaagttaaaaagcagagtaaggaccttgctcaaaataaggtaacgcatgaaagaaccagaagcccgggtgtttgagacgttcttaaaaaagagtccagttggtttgttggcttagagatctaacaagtgttatactattttatgacaatccatgtctttaaacaattgtccttaatatttagtatgggccagacgcggtggttcttgcacttccaaagtaatctcagcactttgagaggccgaggcaagaggatcgcttgagcccaggtgttcgagaccagcctgggcaacatggcaaaacctcatccctacaaaaaataaaaaaattagttgagcgtagaggtgcctacctgtagtcctagctacgtaggagactgaggtaggagcatcacctgagcccgggaggttgaggctgcagtgagccctgatcgcgccactgcactccagcctgcgtcagagtggagggacccagagtggagtgacaaaaaaaaaaattttttttttttttagtatggtatctattggtgccttgcaattttttttttttttttttttttttttgagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagttcagcgtcatagatcagttcatagtctgggtccgaagacacggcgatgcttcttgcgcacccccacggagcttattattccgattccgcaccagccccccgcccctccccaaaaaaagcctaagatgggagtggctatgattcagaggacagagggcagaagctgtttgcgttaaggagtggggggcttgccctattaaggtaatccgcaaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggtgaggagtcggcgttgctggggtgtcggaggagagcggacccggtagagacgagcctctgccgcggcgcaggcgcagtatccgggctcggcgcgagctcgctcaggccgccagcgcgagcctctggatccgcgcgcacggtggttgatgaggttcgcgctggaatggagatcgcgccggttcccgccttaacggcagcagcgcgagcccaaatgggagggtgtgcactactctccaggagtgtcttaagctccttcctccttcccccaccccctccttgtttgtatctgtggtttcggcgcatgcgctgcagaaggagttaaatcccactacaacctacggcgttgctggcctgaggggggcgagttgggctgggtcggagttaggggtatagttgcgcgaaggggtggatggggttggtatcggtatctgcacgaataggactggggtagggtaaaatgtctgctcgattagatgaggaggtgagatgaagagagacctttatttgaagggacttgatgagagagaggtctctaatttagtggcatctagtggcaatttgggtggttaagagtttggtgaatattggtgagagaggcgaggcaggttgatatatattggggattttgaatcggtttgagtagattaaggtgggattgtcatgaggtaggtgtagctcgattcaagtgtataggtttggtttaaagaagggaagatgaggatgtcttggttttaattagagttcaacaggatacgtggcaggtagtgcagattaggtctgggttggctccagggttgagttggcagaccgttgcttatacagaagctgatagttttgtgtgtgtgtgtttgtgtgtgtgtgtttgtgtgtgtgtgtttgtgtggatagactaggttagaccacagtttacagggtctgtggtcattttcttctgtagcttcctctttgaaaattttataaatttgataaatctaggtgccacagtactggaaattatacaaattgaccctggtactgggtaaccctttgaccaagtaattccgtcaggcaaaaaccaggagccccatggctggtttgagtattttaagtaattttacatgcatgatcagatttagaaggggcacttggcgaaagtgcagaagataatagggattttagtactggttctattactgatattatgacatagccaggtcactgattctgtgtgcctgcattttatatctgtacatttagtaacagtaaccatggctacctttatgggtcttctgaagatgaatgagaacagtgttagtaaagggttttcaggtccctggaaaaggaatacagtttaattgtgtgtatttaagtcattgcgtttaatttagaggttgtggtagaggtgggggtttgtttttcttttttttcctcatcatttctgacttttacccttctctataccaggctctaatgctagaaaatttacagaaacactcaacaccccatgctgcattccagccaaattcccaggtgagaaagaaggtgtattcaatggagtgggccctttggatatccagacacatggaaggacgtggtgttgtatatttgatgcttaagtcctcatgactgttttcctaagttctcttagtcagaaatgttctcaaaccaggacagttgaattctaatcaacccagttgtatacaagggcctggagtaaagaacagaatcagaggcactgttagtttataataattgaaatggcatgtgtagaaaggtgtggcttccattaattacgtgtagtacagagatctgaagtcatttatctgccatgaatttaggaaaggtagttgatgtctttgagtatagatatgaagtagatcaccaatatggcagtgtagggaaatagttgctgattaagaactcttgttgatgtagattttccaagggttcaatcctgtgtaagtcacccaccattactagtgttaactactaactcagtgcacttactcataaacattactaatacctctttacttaggataagaaacaacctttggaggccttggtcttctccatttccttatctgtaatatgagaaacagactaaacccatgggtttataactgttctcttagggttttgtggagctgctttggggagcttcctaggggaaatacctttttcccaagtaagcaaggctcatactcctctcttaaactagattagatctactttttaactattgagtttctgcataaaatttttaaattattccacagttaaaatccaaaaattattaggctgcacagtctcttaaagtttctttcagcttttaaaaatcccctcattataatgtgtcatatacttaaaggaaaaatccaagtctttgttaaagcaatagtgtgcagcctcagtactagatgaagtctcaggatactgtggaaaacaagagagccctcctcctcctttgttatcacctcattaagctgtaagtatcataatctagccagcattcagaggttcaattaagtactttaacaagcataagaaactgcataagttaatcagcttaattgtattccttttgcccattgcatgttagtctttgaagctttgcttttattaacacgggtttgtgcagcaaacatgcctattctgtaatacacatgcaacccacccttcaacaatgtccattgagtgccaagagactcatttctactttaggtgaaaataaacctttactatgtttaggaaacatgactaataacatagaaagtattcaggtttttttgctttttcagttctaaataggacttgctaagcaagaaggttctagggaggagaacttgtgaagagaaagctggaggtcagaagggcaacttgggaatctgtattacaaaaaaaaaaaaataggaaaaggcataagctcctgttaccaaggatttcctttcacccagacaaaatggagttataactttgtctaaatgctgaatggatatcccttttcttagtctcttgatttcatacttttaaatactatacttgaattttggagttgtttgataaaatgtttcctggatatgaggccgggcattgtggctcacgcctgtaatgctagcactttgggaggccaaggcgggtagatcacctgaggtcaggagtttgagaccagcctggccaacatggcaaaaccccgtctatactaaaaatgcaaaaatgagctggttgtggtggcacatgtctgtaatcccagctactcaggagactgaggcaggagaatgtcttgaacccaggaggcggaggttgcagcaagccaagatcgcgccattgctctccagcctggatgacagtgatagtccgtctcaaaaaaaaaaaaaaaaatgtttcctggataggtaacggttgatcttttggaggaactggcttttttttttttttttcttgagatggagtcttgctctttaacccaggctggagtgcagtggcacgatctcagttcactgcacccaccacctcctgagtagccaggatgacagactcacaccacaatatgcccacctttttgtatttttggtagagacgggttttgccatgttgctgagactgatcttgaactcctgagctcaagcagtcttcccacttcagcctcccaaagtactgggattacagacgtgagcccccatgtttcagtcttgatactaccaaaaggaaattttagattaccctttagataatgttccacgtaatctaggaatttagcctaaaagatataattacaggaattttaatttaaggttatttgtggctgggcacggtggctcacacttgtaatcccagcactttgggaggctgaggcgggtggatcacttgaggtcaggagtttgagacccgtctgaccaacatagtgaaaccccgtctctactaaaaatacaaaaatcagccgagtgtggtggtgcacacctgtaatcccagctactcaggaggctgaggcaggagaatcatttgaagccaggaggcagaggttgcagtgagggaagatcacgccactgcactccagcctgggcaacagagtgaaactctgtctcaaaaaataaaaataaagaatagtaatttgtataccagtatcactctttgggaactgaatatttaaatcaaaaacttatgtgcagctcttctttttgccctttttttgtgtgtgactcaaggctattctgttcttcaatatagaactaacttagaaaaaggccttccaacattttagttatctttcttgggcgcaactataaggagtggacctttgctccatggaatgttcttctttgcattctcctggtttgttttcctagaccctctgttttcatttcctctacacagattggtgaggaaatgagccagaacagtttcataaaacagtatctggaaaagcagcaggagctacttaggcagcgtctggaacgtgaagctcgagaagctgcagaacttgaaggtaagcccagattgtcacttttaacaaggagttcgtcattcttatccctgtcaccaagtagataggcctgtctaactagacaatttcagaaataagtgaggctgagactgctacttacttgctttcatagcccatgaagccaagtggtttactatttacttttgtcagggaagaggacacttaatttgactgtcttgttagaagaggattcctgccaacaggaagagttataagtaaattaagctaccatttagatgaagtagagctgaatcccagggagttttttctttttatacggtgctctttttggtatgtatctctgtatctgtgactttgcctgacctccttcactcctctacatattcctacatgctgagtccttcactccctccctgccccgacccgatctgtactttgcagaagcttcagctgagtcggaggacgagatgatccatcctgagggagtggcttccctgctgcctcctgactttcagagcagcctggagagaccagagctggagctcagcagacattcgcccagtacgtatctccctccccactgcgctgttttgtcaatcctgcgtagttggtggggggaggtagttacacctcctttcatgctaagcctccatgaaagtcccagggaaattctgtgacattgatatttgacatctgtttctcatggaaagtataccctttttgaagtctgctttcacctatatattgtgttaccttctcagtgttttacgaagcagtgtgatttttcttctcatctgtacctcttcaactcttctacctctgaatttggcaacagtcagctctttttcatctcttcaccagttgtgtatattacgtgttaacacattcagtcaccctctggagttgggtatctgctgtggtttaatcaacaaatttttattgtgtacttgttgtataccaggcacatgctaggcacgaggaatatagtaaagaaagaaacaagtctcagccccaagaaacttagtctagtgaggacatggacattagttacagttgttttggctactgtgcaaggcaacgcagagtattatgtgagcatattatagtagggagctctaacctagtatatgggattggttcaggcaagattaattaatttcttcacattatagaaaatattaagcacccagactgggtgtggtcgctcacgcctctaatcccagcactttgggaggctgaggcaggaggatcacctgaggtcaggagttccagaccagcctggaaaaaccgtgaaaaagccatggcaaaaccctgtctctactaaaaatataaaaattagctgggtatggtggcaggcacctgtaatcccagtgactcgggaggctaaggcaggagaatcgcttgaacccgggaggcagaggttgcagtgagccaagattgcaccattgcacttcagcctggacaatagagcgagactgtgtctcaaaaaatacataaaatcataataggcacccaattttgcataatatctcaagcaaaagtctataaatatagcctttgtcttttgggaactacctgtctaagtcagtatactttgaggaaaatatgtgcaggttgagcatgcctaatccaaagacccaaaactttttgagtattcacatgacactcaaaggaaatgctcatcagagcatttcagattttgggttttcagattagggatgctgaatcagaaagtataatgcaaatattcaaaaatccaaaatctaaaacacttgtgatcccaagcattttggaaaagggatacttaatatgtatataagacatgtggattgttagtacatatgttaaaccaatgtgtaacttaacaagtattttgaataattagtgttgagggggatgcggaatccaccataatcagtgtttttaggatgtatggaggtttccagctcttctgattaatacagaattccttcatggactacacttgattttagttaaaaggctgagcagcgatagactcttcatggaaatagattttttaggagacatttaatggtgggaaagaaattttccaaaaggctagagaaaatagagagcctttgagtctagttttaaggtcctgttttactcagtccctgtttttcttgatcctagtcttagacccagaaagacatttctagaaatcttttagtaagaaaatactggccaatactttggaattattaagttccttagggacctcttttctcctgaaatacgagagtagtagaccctcagctgatccactttgctccctgcgccctttcccccttgattttaaagccgagaggaaagagaaagctcttctaaaattgtcggtatttcttctcacataaaacaaaaaaaaatttattgaattcctactgcatacatatctctgtgagagtatattgggagttagcacagcataaagtctgttaggaagagagaacaattacacataaatcgaacaacagaagatagtatgtgacaatgatacagacatagggaaccaaaagagtggaagagctctgaggactacagtgattagagaaagcctcataaggagatacaggatttgagctgagccttagaaatggtttggcagagaggatacaagaagatatttttaggaaggaacaaagtcagagagataggaatgaaaatggtatttttaaaggagaggtagtagactaatctagccagagtagagtatttcacattcaagaatagtcagcaaaacaatttaaaaggtagatgagggtgatacacagagggctttaaatgccaggccagtaagtatgagggttttttttttagttctataggtaatgggggaaccattgaaaattcttaataggaccatgatttgataaggacctctctttaaaaagagaggctgtcagttcttaatataattcgaaatgaaaatgagaaatgatttctgaaatagatttcaaaagcaaagatttagagtaagggtagccaatcttttcagtgctttatgtcatcagtaagaccctgcccatggctaatgattgatggaggaaaaaaaaaaccccagacgttaaaaaaaaaaaaaggtgaaaaataaattggaaaatatgaatgtggtaaattgtagagtactgctcataattgccgtaaatgctcttcagtgtcctttatgccataaacttttctacctctgatcttggcttagataagaatcccattatagatgttgtacaaaatttagttaaggtcctgaatggagtggccatttggaattctatcagtgcttagttgaatcagcattaaccctagtgtttgtccagaaatcagattcttccaggtatagaatctcagtctgccatatgccagtatgccattgcaatggcagcttatttgttggctttgaatgttttggggttctctcttgaataacaatttttgattaagtttcctactaacatttttctaaacgctactggcacctgagggagattttttatttgttttaatattactatgtttaagaatatggattcctggcccctacccaaagaatctcaaggaatgggagtcctggggctctacattttttaaaaagtccctgagtggttctgttgaccaattcattttatgaatgactaactgaaggaagagtttttcagtgttataatttatcaagatctttggtttatattccagcatcctcctgtttatatgctattggcaaaattccaaataggaaggaagaattggtttgtccaggtgtggtgtctcacacctgtaatcctagcactatgggaggctgaggtgggaggatctcccaggagattggcctgagcaacatagtgagtcctatctgtacaaaaaaatagaaaacattagctgactgtgatggcacatgcctgtagtcccagctactcgggaggctgaggtgggaagattgcttgggccctagcagtcaaggtggcagacaacagagtgaaaccatgtctcaaagaaataattggtttataaaatcctgtctgactttccctcttatgtctccatcactttcttcagatatttctaaggtgttaggactcattatccacctaccatagtcataaattgtctgaatttccttctatatcatgactgtgtgtacagaaattcttaccgtccttaattttttcaaaaagagctcaaactaagaaaatacatttttaaatgcatattcagaatattgattctttaacaaaggtgattttagccagcctttggcttatagagtatgcccctcattccgttttctccatattaaaacctggatgcggaaattctagagaaatgctaggtaacttacttacaggtctaacatgagtcagatttaggtttggcattgtttccaggtctgtattctcttcattcctgcttcttattcacacctaaggttaccttttagccacaggcttttcttcgatctctggcttccttactttggtcccacaaatcctacccaggaatttgttttctaggatgaagaactatttcctctataacccttaaacattctgcactttaatatatcctgcattgtctagcaactgccttttcctttctgtgaagccttctggctttggactcttggaaatctaatatttaccctgacttgtttttcgaatcctgaaatgtatttattagcctgttatcagtatcagctccacccttagctaaagcgctcactgtctacacgtgttactaacatctggcctaagacattcattgtggccatgttcttataatagaagatatcacctttttcagaagtttgtctgcatcacatcagctctttccaaggaactagagattcctcatctctttatattttgcattgctgactaatttcttgtttcatgtctgaggcgcctccagtttctgcttttattgcaaaacagtgatgaccagaactttctgaacagccctgttcatttctccagatctctttgatgacttactacaagttcttccagaggagtaatcatccagaaatcctatcactgcagttttacagtatcaaaaataacattataattcaataaatagcatataattcacagtaggtagataaagaggctgttttgcttgtacatactaattttaaaattgcaactcagttatttgactttgttgttgttgttcttgttgttgttgttttttgagatggagtctcgctctgtcgcccaggctggagtgcagtggcgcgatctctgctcactgcaagctctgccttccaggttcacgccgttctcctgcctcagcatcccaagtagctgggactgcaggcacccgcccccacacccgactaatttttttttttgtatttttagtagagacggggtttcaccatggtcttaatctcctgacctcgtgatcgcccacctcggcctcccaaagtgctgggattacaggcgtgagccactgcgcccagcgttgactttaacacatttatctctgaccaaccttgcacttgccttttttttttggtgtgtgtgagataaatcagcttctttcactgatacttgtgaaggaactttgcctaacatttatgaaaactttttattttggttttacttattttataacttagcctatttcagatcactgaattatgaaatgagtatttcatttcactgcactactgtcttacagatgtcttcaaatgtttgctaaagagtctggcctttcactatatattctaatcatatatcctgtatgaacaaccataacacaaatctttcttcacttacccagatacgaaatggtatatactcagaggtccttttaatcaaatgatcatgaagtaaagttttacaaaatatgtgtagtcttctaattgatttcattagtttcattttgggttttttgttttttttttcttttttgagatggagtctcgctctgtcgcccaggctggagtgcaatagcgccatctcggctcactacaacctctgcctcccaggttcaagcgattcttctgcctcagccccctgagtagctgggactgcaggcgtacgccaccacgcccagctaaaattttttttgtatttttagtagagatgaggttttacctaattggccaggctaatctcaaactcccgacctcgtgatctgcccgcctcggcctctcaatgtgctgagattacaggcatgagccaccgtgcccagcctcattttgattttttaattattattacagaagcattcgcctagttcattttagattgtaaggatatagaaatagagaaggccgggcatggtggcttacacctgtaatcccagcactttgggaggccaaggagggggaggatgacaaggtcaggagttcgagaccagcctggccaacgtggcaaaaccccgtctctactaaaaatacaaaagttaaccaggcgtggtggcgggcgcctgtagtcccagttactcaggaggctgaggcaggagaatcacttgaacccaggaggcggaggttgcagtgaaccgaaatcgtgccattgcactccagcctgggcaacgagcaagactctctctcagaaaaaaaaaaaaataagagagaagatcttgggttagagctgcataccatctgctttatttgcactattactatacaacatggttttgtgtacagaaccttttgtactgtattaacattgagtccaatctagctgatcaagtatctggaatataattatcttcctgctattttctaaactggttctcattgatgttagtattgctactgtacatagttgatcttttttgtttttttgagacggagtctcgctctgtcgcccaggctggagtgcagtggcgcgatctcgactcactgcaagctccgcctcccaggttcacgccattctgcctcagcctcctgagtagctgggactacaggcacctgccgccacgcctggctaattttttgtatttttagtagagacagggtttcaccatgttagccaggatggtctcgatctcctgacgtcgtgatccgcctgcctcgacctctcaaagtgctaggattacaggcgtgagccaccgtgcccggccgcctagttgatcttaattctggtaggaaatttggaaatcatctagtgcagcccctcctttttctcaatcatgacatttgagactcgggcacagtggtttataccttaatctcagcactttgggaggaccggggtgggaggattacttgagccctggaggctgaggctgcagtgagccatgatcatgccactgcactccagcctgggtgacagagtaaaacactgtctaaaaagaaagatattgagacccaaattacttaagtgatttacccagttaccttccttcatggaatttgagtgaaactttctttccgttttacatggatttattgttcaggataacctagattggtggtttccaagctttttaatagaactttttttttccttaaaaaaaaaaaaaatctcacctagtccgggtgcggtgactcacgcctgtaattccagcactttgggaggccaaggcggggggattgcttgagcccaggagttcgaaccagcctaggcaacatgatgaaaccccgcctctgtaaaaaataccgaaattagccaggtatggtggcgtgcgcctgcagtcccagctgcccggtaggctgaagcaggagaatcgcttgaacctgggaggcggaggttgtggtgagcctagatcatgccattgcactccatcctgggcaacaagagcaaaactctgtctcaaaaaaaaaaaaagaaaaacatgtgagctcatgcctgtaatcccagcactttgggaggccaaggcgggcagatcacttgaggtcaggagtttgagaccagcctgtccaacaggatgaaaccccatatctactaaaaatacaaaaattagccaggcatggtggtgggcacctgtaatcccagctactcaggaggctgaggcatgagactggtttgaagccagggggcagaggtcgcagtgaggcgagattgcaccactgcatccagcctgggtgacagagtgagactccatctcagaaaaaaaaaaaaaaaaaaaaaaaatattgagctctaatacataaaacctaatagacaggacccaattctgaaaccccatccagttggcttgaagtaatttcaggaactttagggcgctgaaaaacattcctctaagtatttatttcttgagtttgttattgtgcaaattcatatatttcatcataatattttggttgaaattagaaagtagtagtaataggcaatccaaaaaaatggatacagaacataatgaagtcttaaactttattcagagtaagaacactttgtagaaataagtacacttcatatttgtacatccctgctagacagtttgaagcccctggaaattattttacatttatttgagttatttataacatgtgaattggcttcgaggtgttgaaaatattctagacttgcacaccaagaattaccaataagaccctgacctagttagggctttttgtagtcttttctttagtgtagaagtcaaagaaaccgatacagatatgtcttgataggctcatatgctataattggttggatattagaaagcctgatttttaaaaagccatgaatgagtcttcacttcatgaatctgacttgattctttttcattcaataggaaaaagctcctcaatttctgaagagaaaggtgactctgatgatgagaaaccaaggaaaggagaaagacgatcatctagggtcagacaggtaactcagatacctcctaaagcattacctcttcagtaatgctttggatatcttctcttcttcagacttgttttgagtttgtatgtctctacatttaggggttttgtttttcttttttgggacagagtctggctctgtcgcctaggctggagtgcagtggcacaatcacagcttactacagcctcgacctcctaggcttaagcagtccttccacctcagcctcccaaaggattgggattacaggcatgagccactgcctggcctctagatttctttgtggttatcttccttctcctctttgtcatctttttgttgttcgttttgtctttttatttagatctgctctgccttttagatttctaagtgaatattttttaaaagtttaaatttgaaaattagcaggctgctctgtattcttaaagcacattattagacaagatatgacataattaaccattcaatcaaagctttaaagttatataacactaagtgggcagaatacaaaaatgttatgtgtagtgtaattatgactgtacaaaggaaatgattagaggaaagaacaaaaagaaatataccaaaatgataaaaagataatcgtattaattgatagtaggttagttcctttcagccccctatccacccttttactttccagatgttctgctaatattttactgaaaaaaaaaaaaagggggtgcttgaagctaaaatttaaactacatacaagtagcttcattgtgatatttcttttggtcactttgttttgattcccctaagggctacgttagtcatgattgtctcctgtcactcctgtttctgttgctgaaagtatatatcattgaatttctccttcctaggggtgtcttcattagatactttctctcctctgttgactgtgagcaaatacatttggagccattgtgtatctgttctttcaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtcacgttcacgttctcgttcagcatcaagcaacagcagaaaagtgagtatgagagaatcccgggtgtattaatgttctgtcatattccagtggttttcatttcagcccctggagagcctgtcatgatttctgaaaggaataggaaaagcctcctttactctccttcactgattactttctcctcatttcagaatcgtattttcaattaactgattcccgaaatggggttctttttcattttgagtcccttgatagaatgttgaatttatgtactcatctcctccactagatggaaacttcttgaggatgtgggcatgcccttttacgtgtgtgtccaggatctagcatctagttaaaacttaataatttgttaaataagtggtcaaggagaccactaaatgggaataaacacagacaaaatgggagtaaacacagacaaaaaggtccagagtataaaatttggtccatggaaactggaaaactcagcaatctactgaatatataccatatacaataattttccttgttatgtgtttcattttgttttagtctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggtaggctattgtgacccctccctacacagagatggaggattaagcaagatcttccctcttgtctttgctataaaactaaaaagttaagtctggacaaggttcagtagaaatgtggtggatacctgttaatcctgcttaactcatttccagctccctggttcgtagaagttctacatgaggctgagcagcagggttatctccagggcccccagggtcaattcttcctcataactcctccttttatctgccaaaaggaagtcagccttttctcagttctctcaaaaaagaattctgtcagaacaaggatcactgaggaaaaggaaaaaaattaaaaattctgataaaatgattactggcataaatattcttgaagtacctatttttaagccatgttcctttccttattctaaaatgaaataacagatacagagggccgtgtgtggagctggtactgtgtatgtcctgccctgcctttttcaggctccaggtagaagaaaaggaaccaagcagatctaaatgttttgctctgttcgtttttgctatctcctgacaggggagcccaaagaagtgtgaagctgaagaggcagagccaccagctgccacacagccccaaacctcagagactcagacctctcatctgccagaatcagaaagaattcatcacactgtgtaagtgatatatctcgaccggggtataacagggaactatgagtgtgcgatagttcttcgctccctagggttctttgactaagcagtcctagtttccttttaaaacataaaggcagagctttatctggacaaaggctagacttcagttactatgttgggagctgccacctttaaggtaacctgaaaagtggtcgtcagggcacaaggaaaactcacctgggatcatccagccaaaatagtcaactcctttaagatttaggcaatagaagcttctgcttccacactcaaaaccatgtaagggaattgactccgggcatcttaatctttaactcatgtttacctaggaacccagtttaataaaggatattgagggtcttaataaaggcacagctgggtgctattttttagtttgtgcattttccctagttccctagttactacctgtcattaagctatcctagttctgctaggatatcctagttcttacagcatacagtacagcaaattatgaagttcctttcaagtcagaagtttgttcctgggcccttaagaccatttgattgaacttaaaatttatacaattaatgtgagtttttaaaatctttatattaagtcctagagaaatactcatatcaggttaaattagaattaaataggtatgtcattcattcttctgagataggtattataaattaagaagccaatgagccagaattcctggcttcaaagtctcctgggaaatgaaaaaatgaagccttatgggaataagattgcgtagcttttagacatcaggaaccctgaactgctttgtagaatgtcctgtgtagactgttagcctaaagttattctatacttgtttttatgccatattaacactaatgctaccagtatgatttcccctatatgtaattgtctaataatttatactcttctgagagcttcaaactgtactttaactctgacttttggagggtagtgggcaggtgacatgatttatctcatttgcctgtgactttaatgatagttttatagaccttactatatagcttttacctgggggtatacccttgctgaggggtataatccttgtcgattctgacagtcttacctctgctgccatcttgtggctgttaacattttttgtttggcagccaaaagttcactctacttcctttgaaattttttggtttttcccttctggaatgggtacgctatcctttggaaaagggtttttcttctgggaccataaagtgaaaactcagcggattctggaaggtattcaggattccccagctacatcatcgatgaggaaatggggtgacattttctcttccatatccctcaaccagacataatacctgcccccctcctcccaattccatggaggtacattttacattccattttacaaaagcatgtcctttgtgaaatggcagttttgaagtgggtattgacagcctgctactaattgggcctgaggaactgcttccgatgcaccttgggaagaaagtgattttctgaaaagctctttgctagccttaaaattctgtgggtttatgagatcctagcaacagaaaggcattttattttgttttgaagcagctttttttctggacattcccatgcaagtccagggcacatgaagcttggagtcatagagtttcctgtccccccactccaggtaaaggtggttttgatcttcattttatgactgagataatttagtcacattgattctaataagatgataggcaagtggcatcttgggcaaatacttagattgtccattgttgcctaggcccgcttcagtggagtagtgtatagaagggaaatgcagtcttcactgaggagcagttcacacacatcactcgtacctgctttccttctacctgcctatcacatgggttgttcaacattctaacaaaacagcatgcccagaagcctaaacccataggcattggatctggtaaataaatctttgagaaggttgcatacatttctggaggccctaccacaactgattaacaacacccttcctggtctctcacccctccagagtgttaagtgtgcagtctggcagccctctagagctctggccaattttgaaagcgtaatcaacaatgctaaatggaaaagaccatttatggcatggccaggcgtggtgactcatgcctgtaattgcagcactttgggaggccaaggcaggtggatcacctgaggtcaggaattcgagaccagcctgaccaacatggtgaaaccccgtctctactaaaaatacaaaattagccgggcatggtgtgcacctgtaatcccagttactcaggaggctgagacaggagaatcgcctgaacccgggaggcggaaggtgcggtgagctgagatcacgccattgcactccagcctgggcaacaagagcgaaactccgtctcaaaaaaaaaaaatggaaaagaccatttatggcctaaccttggtttttctgtctgtctcaacaagaagtcatatgactttaaaaaacagagcagtaaagtgttaaaaaaaaaaaaaaattagacttcaaggacctgtcaccatttggaagagattgactgactttttgctgtgtttggttaaatccattctgattctgattgtgcctgaggaattctaaatttatgaggtaaggtgtctttttcattgcttggagcaggaatttgtgggtcctcagtcctgtttcagttgagtgctgttcaaaactctggtcttctgccttgtatgggtataacaaaaatgtccccatatagcagaaaataatggtattctctttttacttaaaaaaaaaaaaaaaaaaaggggaagaaagaaaagaggggatttgtttgtgtgggcagctgtatcattcagctgtagttaattcagacctggatttctctagatacaaccttcctgtatgcacagacctagcaggcaatagcagttttaggctcttggtacaatgcatgtttgtccttctgcctgtgtaggaggaaggtattggttccttaagccaatatgatggtgtaattgatattccccaggggacatacaatgccaatatcccaaatgatgcatgaaaaagcagaatttgttgtcatcaatagagtttgctccactgagaaattatctaaggacatataccccaaaatcatactgttctaggttatcttgggaccagtatgcttctgagggtatctagtcccactgtttcttattaaattttcacgtcagtttttcagctcctcgtgaattttctataataactaaaatttcagcatatatgcctataggaatttccttttccattagcttctctgaatctcatattcacatatgagttgtaatgtgatattattagcctccaagtagttgtacccttttcttctgggcttctttgtgtactgtttacttatgggtagatatccccactgcttattctgtgcagtttcacagactgttaagctatgttgggctctgacacatggttaacaaggttttggtactagtcctgcaagtagatagagtccattttggggacagtttcaaggattcctctttatcttttttcttttttggagacagagtctcactctgtcacccaggctggagtgcagtggcccgatctctgctcactgcaacctccgcctcctgggttcaagcaattatcatgcctcagcctcctgagtatctgggactatagacgcggctgccacaccctgctaatttttctatttttaatagagatggggtttcaccatgttggccaggctggtctcaaactcctggcctcaggcagtcctcctgtctcagcctcccaaagtgttggtattacaggcgtgagccaccatgcccggccctcattattgtctgaaaataaaatgttcggaattgttgggtcccacagaattgatcatggggaaatagaaaacacacgcctcttgtgtcttaagagggtaaaggagaacgtggtaagattcttattcttaaaaaaaagaaattttcggccgggcatgatggctcacgcctgtgatcccagcactttgggaggccgagacgcgcgaatcacaaggtcagaagatcgagaccatcctagctgacacagtgaaaccccgtttctactaaaaatacaaaaaattagccgggtgtaatggagggtgcctgtagtcccagctgctcgggaggctgaggcaggagaatggtgtgaaccccggaggcggagcttgcagtgagctgagattgtgccactgcactccagcctgggcaacagagtgagactccgtctcaaaaaaaaaaaaaaaaaggaattttcaataacaaaatttctcaaaatcagccacttctgcagaggcatattagcagctgagagtattttaggacagtggataaacagagcattttatttgaggatggctgaaggtaacattttctgtggtgtaacattgtttgtggggattctattaaaaaaatttttttctttttttgagatggagttttgctcttgttgcccaggctggagtgcaatggcacgatctcggctcaccacaacctctgcatcctgggttcaagtgattctcctgcctcagcctcccgagtagctgggattacaggcatgcaccaccacgcccagccaattttgtgtttttagtagagacagggtttctccatgttggtcaggctggtgatccgcccacctcagcctcccaaagtgctgggattacaggcgtgagccaccatgcccagccaaaaaatttttttttcaataagaaaacttttaggttagcaagcatttagtaagtgtccacttggtacccacaatgacaccctaattcagaaatagttagggaacattactttgtgttaggccctgggctaggggccaagagatgcaatccctacccttgaggaattatgcagggtagagatggggggcagataaagtagcagttattatacagagtgataagggcattgctgaaaacctgtcatgccaatcactgaatggctttgcctcagaaaacaagcagtctactcttttgaggaaactcagagccccagaggtggcatcagatgagataatggcctattaagtgtgcatgtattttacatgtatctgtaccttcacttggggtgtcctccaagccagactcttaagagctaacacttaactacactgttccatgaaataggtattgtcactatgcccactttgcagattacaagacagatatacagaaccaggaacttgcctactatcacacaacttttaacagagtggggctagccagtctgactccagagtcttcactcttaaccctgagcagacagggaccactatgtgaaaggaaacatttaaagtaatgtataaatatggccactttagcatgcagttggcattgtaagtgtaagattttaagcagcggggagaaaatttcattcctagcttaaaagctcaaatgttacacgagacactgagctttggttctcagaagtttatcttagtgtaaacttctactgccactaggacacaaaaggaacatctctgcagtcaacaaataagcattttgagtatctactgagcactttttgaactattagcatctgtttcccactttggtctagtgaagattcccatgattaatattttctgcttagttcccagtcgctttctgcccagctgatcttccccgccccatatagcagcactctcacttcactgtcttatctactttagagcctcaccttggagcccttgcttcaagaagtggccttcaagcttcagctacccaaggtccccttgccctgtttatcctttctttttctggcccgagtggaccctggggcagggtgaccttattaaagactctataaaacaaagttgtctgtcatctcttcagagacaccaaccctgccccccttctactggtatttgaaaaaagaactctccctgctatccacttccctccaccatccctgggaaaaggacatgttggagtagtaacacgtggtcattgccggggtgagcagccagttactgtagtgattggatagtgacaattcccatcccacctccctacctgcagcatctgactggttggtctggtttcagtgttccatgcctagattactggatagaggatggtaggcacataaaacattgctcatgccccaccctctatccagctttcattaccatccttctttaatcacttttcaactttggctttatcgttcttatttaatcctttttcactcccacctctactgtttgcctgccttctattctctctattttctagaatcttccaatcaagcagctgtaactttacatgtcctccacccagccccctcccctgccccctgggaagaccaggagggagcactccagccctggggggttaagcctctgtagctgctgtaacttgagaaaagaaggccaggcctctggagccagcagtcggctccctgtggcctgccaaaggataagaaccttgctcactcagctccctccctcttttctttcccctcccctgctgcagcaaggccctcccccatccgcacacacaggctgctgggtaagtggcaagatggctcccctgcatgtctccggctgatcgctgccgctccgccaatacaatagagccagccactaccagcagcctggccctcttcctccttctccagagagaccaatccagccgaactcggggtttgccgtgaggacttaacgcttatctcttaaaagccagatctgttttagcctccccgcaccaccaccacctccccttccatttaccattttttggatccccggttgctacatctcaattttctctctctggatcgggtggctggggaggaggtggtgggatcttggaacaaggaaggtgtggttttttttctttattttttttaggattttttttgtttggtttttgttatttcttccattccagaaagggataaacagcacttccagggggagaaaaaaaatcatgttatcagaaagcaaagaagggtgagagcttcacatttccatgtatgccttttccccgccgccctagctcccttcgtcttccttctcttcctcatggctttcattccgtctttcgttttggtttgttttcagtcattctgccttccccctttgtcctgcctgcccagtttctaattggccccacatgccctttctgtatgggaaatagatattttttttgtataagccttttctctagatgtaagcagctaaatctcgtgtttctctgggggcctgtttagctgggggcacagttccgattttcccctccccctaacccccctagtgcatcccttcttgactgctctagggaggttcttctgacctctgagtgtcagtcagtcagcctgttgggaatgctgacttttctggtggtggttatcggcctgggaggcttggtttcccctctcctgagccttaggcctctgatcatcttgatttgattttttttgcttggtgtttgggtggtagagggggtgagatttgagatagaagttggggacgaagacagaaatcaaaggtggaaagatagtttatctgaagtgaatctctgggattctttgcctgaaatgggagctaacttgtgagattaagagtgggagagtgggtttggtgttcttgggggaagctgcctgtgtgggggagggtgtgtcctgactaggaggcctgctctctttatctcttggaagttggaatgagggagtgggagaaactgggtgaaagccgaatgtaggaacagtttctacacctctgagcaggtaaaagtggccctaatctctgagctctcatactcaattcagcagttttaatttttccttttgaatgagagagggtccttgaagcttgaaccttcaccaggcctgcttcttccctgcagctcccaccccccgccccgcaccccccaccccccaccattttctccatgctggtgtctccagatcctgaggatcagcaggcctttacttattaagcagttgattaaacacaggtcaggcttttttgccaaagccttggccattctttcttgtctttttaagggaatcgggcttcccttcgtttctcgtgcaattttgccatataaaggtgcctttggccagggagactgaggccacagggttgtgggcaaatcacagtcacttttgtgggactattttcagaggagggtttttctcctttcatataggagtactctggtgagttattacctgagaatagttggagtcctaaccccacaaatgacaacttttaactcatctgggcaataggtggatgtggttgctgtgatccacgctctttccccaaggaaaatctatttcccacttttcccattgggacaaggtctctaaccttgatcagaaaagcagccctcctaatcccacccaagtgatgaggcaggagggtttcctgacccagtaactaacatcttgctctctcttccccttggttcttttctgcccgcccccccaccaccactcccccctcctgtcagtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtacacagtgaggtgcgattggctgaactgaagatcccaggtgtgagatggtacctggaacatttgtcatattcctagtttattttcttctttattttcttcttctttttttaatattttattttatttttttctatatctttattttttctgatttcttttatttatttatttggttcatgtttttcctgttttaattaagacctttttttttgttttgtttttctcactaacttacccatcgagagcggcccagctaggggtcaggctggcccttaacagagaccaaggagacttggttagacgacacaaacggggctgcgggtgggggtggatgggaaagggatttcatcacgaggtttctgccctaccctttagaagagtggtagagtggtcttagtttttccagaaataagcacctacacttgaaaatactctattccctttttctctctcacttttctcccccgccccccatagtctttcgtcattcacccactgagtgtttggggtagagacttgtcccaaagatgtcttctggtctttggcagagcccctaaggcttgagccctggttggagaggaaacagtaagactctgctggagctccctgcggtggctggaaagtctaaggatctccttggggacaatctgcccttcataaaaaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctgtaagtccagccccaaatccctgataaaagtcaggaataccataaaaaccagcattcattgagaaccagaatttcattctcaatggcattcttgggtcactccctcctgccccaccccttgtgcctagcaaatctgaatcctttcctatgtagggtttcattttggaattcaaaacttgagacaatccccatcatattgctccagtcacattttaatgagatacagtgtgaggtgtctgagaccatgtcccatttagccttagaggcatttattctttcagatacctgaatactcaacaaggaatgagtttcagggactcctatgtgatgcttagcagtttatgaattattctgggtattttgttgttgtttttttgagacggagtctccctctgtagtaccctaggctggagtgcagtggtgcgattttggctcactgcaacctccgcctccgggtcccagttcaagcaatcctcctccgcctcctgagtagctgggattagaggcatgcgccaccatgcccagctaatttttgtatttttagtagagatggggtttccccatgttggacaggctggtcttgaactcctgaccttgtgatccgcctgccttggcctcccaaagtgttgggattacaggcgtgagccatcgtgcctgaccttgtttatgcgttattctaagagagcacccaaggaaatgaaagtgccccacacctcaaacagtaacaattttaacattttccccaatgaggaactctagattacaaaagtataatagatgtttataacttaaatatcaatctgtagtgtgaaaattaaaggaagaccagatcccatcatgatcttagttctgcctagatgttagtatcacatagtgttcttgtttcttctgcatttacatgtccttctcagtttttcttccacactacttgatattactgtctaccattaaaagtttaaacggctcatcaaactagctacccctcccttactgcttttagatcagtgttcagtctgaagccatggtttccccagttcccaaatatgatttcttttctttttttttttttgagacggagtcttgctctgtcaccaggctggagtgcagtcagtggcaccatcttggctcactgcagcctccgcctcccgggttcaagcaattctgcttcagcaccctgagtagctgggattacaggcatgcaccacaacgcctggctaatttttgtatttttagtagagatggggtttcaccatgttggtcaggctagtctcaaactcctgacctcgtgatccacccgccttggcctcccaaagtgctgggattacaggtgtgagccaccacactcagcctccaaatatgatttctttaagttaaccttttaccaaaactccagccagaggtaacctgtaggtattacggtttgaactagcagaggtcctgagaccatctaactgttgggtctatttcttggggacagcagctaccaagggggtgccagctggaaacagtgacacagaggggggccagcctggtcggaaacgacgctggggagccagcacagccaccacacagaagaaaccttccatcagtatcaccactgaatcactaaaggtgaggtgggaggagccagggaagggaggatgagacctgttaaggtgggagtagacatgggcccagtgtaacggggtggggggtatctgtgtcccagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtaaggcttctgcaccccagtgtcaggggaaaggtgggagcagtagatgcagagcagctagctgaggagctgagataaagtctttggagggaacttccctgtctgtgcagagggttgggttgactgacactttcaggggtcagactaccaaatccagctggctacctgttacaaataaagtttgattggaacacaaccacacgagttcattcacttttgtctgtggctgtttgttcactacaacatcaccagagttgagtagttgcaacaaactatgtggcctgcaaaacctgaagtactgctttgctctacagaaaaaatttactaactcctgtcttagttttcctcaaggcaaagttgaggcactaacaatcccaggatctggtagaagtgagccgataacgaaatacccctagcggaaggaacatgctagattgactgctactcttaccggggaaccagaggctgaaaagaatatgccagtttggtgtttaacagacctgctgtgttctctgacaccttgataggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaaggtgagtgacatattgtgagagaaatgtaatgcggctccctgaattctcagagcacctcatttggatcgctgaaagctttgaatgtttcctgcctttcattatattttttcgtatatcatatctttctcctacatattaagtaagctacttgagggccagatttgactctgtttaatctttgaatctccatgatgaggaggttagcctagcacagtactttgcagattataggtgctctgcacgtttagattaaggagtggctgcttggtataaaagaaagggaaccgtgagagttacattgagggtgaaaagagccagtattgcttcctaccaaaagctgttcttgtggtcttcttgatagtgactttaggagataccttaactcgacgttccattagccagcagaagtccggagtttccattaccattgatgacccagtccgaactgcccaggtgccctccccaccccggggcaagattagcaacattgtccatatctccaatttggtaagtcattgtttctcaccatcccagcttgcttagtggttaagtttgagctttaggcttatgcctcctaggttccactcatagttgaactggtctaccaatagattaagttactcactgatcttgagtgagttacttaacatatttacccatctaaaaatgagggggaaaagctgttgccctgcagggttgttttgaggacttgcagaaggcctcacatacaacgtctcaattagtgctgggaagcaccaccactcttctcacattcttactgcaaggttcctaaactctctgccctcccccaaaccttgaaactatactcctgtgacagcagctcgggaaatctaaagattgggtggtggtcttgccttctgctagaccctgaaagtctattttcattggcaggtccgtcctttcactttaggccagctaaaggagttgttggggcgcacaggaaccttggtggaagaggccttctggattgacaagatcaaatctcattgctttgtaacggtgaggggaagaagctgattctataggtcatggcatatatttccttttgtgaccagtgtgggcaggtttaagggtgttgcagcacgtgggaagggttgcagacacactgtgaccctccatcttctcccttcctccaccagtactcaacagtagaggaagctgttgccacccgcacagctctgcacggggtcaaatggccccagtccaatcccaaattcctttgtgctgactatgccgagcaagatgaggtaagaaacctagggagaggaaagagaggaggggcaggggaagccattatctgctagatttcagctgagatccttgccagacctgcagtctctgagcttctgttcttttctcttcttccctggctttggttcctttaattgtaccatggggcttcaaagtggtacctgggctccttttttttttttttttttttttgagacagagtctcgctgtctcccaggctggagtgcagtggcgcgatctcagctcactgcaagctccgccttccgggttcacgccattctcctgcctcagcctcccgaatagctgggactacaggcgcccgccaccacgcccggctaatttttttgtattttcagtagagacggggtttcactgtgtcagccaggatggtctcggtctcctgacctcgtgatctgaccgccttggcctcccaaagtgctgggattacaggcgtgagccaccgcgcccggccatcctggctccttgagtgggagtgatatcacctctatcctaactgtccttgtccctcctctccccacagctggattatcaccgaggcctcttggtggaccgtccctctgaaactaagacagaggagcagggaataccacgggccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaaggtaggtacttagctatggggtacgcatacccactagtaggtgggaaagggacccagatgggatgggacagagggtcagatgcatcatatctggttcacttttttccacctcagagaaagcccaggaggaaccacctgccaagctgctggatgaccttttccgaaagaccaaggcagctccctgcatctattggctcccactgactgacagccaggtgagtgctcttcttcgtgccctgctccctagtggcactgaggcttgaggtcagggtgaggggagattcatgtgactgcgagagtgagtcggcccaagtacttcctaggtttaggataaactaagcatcacaaaaaggcagttttcagttaattggtataacatagagaaaccagactcaggagggtaaagatagacacgcagatagcagctgaagtttgtggatgtctgggaagctggctgtgccgaccaggcttcttagaacttgattttaggccgtgcgtggtggctcacgcctctaatgccagcactttgggaggccgagtcgggtggatcacctcaggtcaggagttgcagaccagtctggccaacatggaaaccctgtctctactaaaaataacaaaaattagccgggtgcagtggcaagcgcccgtaatcccagctacttgggaggctgaggaggagaattgcttgaacccgggaggcggaggttgcagtgagcagagaccgtgccattgcactccagcctgggcaacaagaacaaaactctgtctcagacaattaaaaaaaaaaaaagaacttgattgtatttagctgagaaatcgtgttttataaattcatttccctgctttttaagagtttttgcatctttaacttagtttcttagtaatgggccttttgggaattttaggcttatgctactcaaaaaagagatttgttcacatctacgctgacggtagggagctagggaaataccaagggccaggcatggatggtgccagtacctgtcaatgtgtgtaaaagttgaaacttggtggctaggcatggtggctcatgcctgtaatcccagcactttgggaggctgaggtgggcggatcatctaagcctccatctaagccaggagtttgataccatcctggccaacatggtgaaaccccatctctactaaaaatacaaaacttagtggggcatggtggcagacacctgtaatcccagctactagggaggctgaggcaggagaatcacttgaacctgcgagtcggagaccacagtgagccaagatagcaccactgcactccagcctgggcgacagagtgagactgtctcaaaaaaaaaaaaaaaaaaaaaactggcggggcgcggtggctcacgcctgtaatcccagcactttgggagcctgaggcgggcggatcacgaggtcaggagatcaagaccatcctggctaacaacggtgaagccccgtctctactgaaaatacaaaaaaattagccgggcgtggtcgcgggcgcctgtggtcccagctgctcagcaggctgaggcaggagaatggtgtgaacccgggaggtggagcttgcagtgagccgagatcgtgccactgcactcccagcctgggcgacggagcgagactccgtctcagaaaaaaaaaaaaaaaggctgaaactaggagggagagaggtgctctaagaaagacaggatgcagttgttgagcccccaaccccttcctgtttaactgaaaagctgaccctgagctaggaggcagggtccaggcacaaatggaggctgtgaccaggactgagctgcctattctctgcctttcctacctggctacagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaactgtgtgagtggctttctttgggcaggttaagaagccactgtggatatctgagcgtggacatctgaggatatctggagtaggagttgctctcattccatgtgttcctttaggctgactgcttcctgcttattgaacttcccacgtcttttatcccctgccttggccctgaccaacccaaagctgtggaccttcctcattcgggaaggcatggagcaacctgtgtccgtggcggcaccccagcagggctaggagggtgggtcctcttctggttcctggtcctgtgcacggttaaattaggggtttggtcacctgcctgccaccttggtgcctcccacaactaccaccagggggcggcagctcctcgctctgttggcccctgtaaccgagcttcccaagaagggttccactgcccgcctccgacctcccgccgatgtcgtgcctctgttcccgacccgctccctgggcccgggcctcggactctctggacccttctgccgtccttaagtgtcccccagctgacctgctaccgtgctttgcatgggctctcaaaacgccgccgccttgcagctgggattccatccacaccagtcccaaaagccagccgggaaccgggagcccggagccgggtctctccgcagtgggctccgaattccccacctcaccgcgcgctcgcccgttttccgctgcgggcggggactggcagcttcgcgctcccgggtgcacccgccccgccagctcttcggaaatggcctggcgccgtggcctggacgtcctcccgcccgagtgccctgccgggcgctgcgggcccggtccgggaggggcgccgcatctgtatgcgccccgcagcccaggagcgccgagggggcggacgcgcggcgccgcctccgcccccgcccccgccgcgcgggcccggctggccggggagggtcggaggctgggctctcctctcccgcgcggcgcggagccgcctcgctcctccgcagcggagtcttcttcccccgccccctccgtctcgctcccttgttctcgccggggccgctcagacctgcagcggagccgcggcgcccgctccaatcggctcggggctgtgcccccgggacccggcgacgggggcgggcgggggcgcttcccgccggcctgggcccctcggcagtgccaggtaagggcgcctgccccggagcaggggtcgggaatccgcggaggggtaggagggggcccgcagcctgcgggggtcttcggaggggtgcgctccgtggctgggagcccgctgccggctcccttctcccgcgctctgcctctttcccttctcccctcgcacctctctccctctttcttctctcgatttctcttcacccttccttctctgcctgtttgccttccttatcccttccctctgtctccccaacccttccctctccctcttgtcctttttccatctcctctccctctttgcctttttctttctctacctttctcccctttcctgcctttctcttttctctttcttgctctcctttccctccctctcctctccccttcctgctatcctgtttcccactcctctatccccttccttctcgcctcctcatcccgccttctctctggtccccagccttcctccggtttcccccttccctcgggagcaaagggactgtcaggtgtgtgtctgctctgagggaggaggggcagaagccacagctacctgaggggtcctcccccccgcccctaggagaaaggagagcagtgggaagggtctcctctctagctcccttcccgtggcccctccctgcctccacccctcctgtctgctccttctcccagaattaagttcccgaggcctggcttgacacccccgaagctgaggtctgcccctgcctgcccggaactgcccccggtgacccgtttccaagcctggcccctaggactcctctctgccttcagacacccaggctgctgccctggtctctctcattctgtctcttgccactgttctgtt

SEQ ID NO: 12762 - DNA, 117937 bp, Human
ttcaagcgattctcctgcctcagcctcctgagtagctgagattacaggcacgtgccacgacgcccagctaattttgtatttttagtacagacggggtttctccatgttggtcaggctgatcttgaactcctcccgacctcaggtgatccacccgcctcggcctcccaaagtgctgggattacaggcgtgagccaccgtgcccggccttaaagatttttttaaaactacatgttgaagtctgtacaaatggccagttacccacatttgcctattacctacacttctcagtattatactgtcattggcacagacgatgtcatagaacaccacaacaggatcatgcaataacctcaggcaacaaaaataaattacattcattacactactcttgccaatcaggaaagattattggttcgcattaggaaaaagattttaaaggacgttttaaacaataagcctttccgcttaggccttcgttaatagcacaactgaattagaacagtccattccccaaagactgcacttaatcatgtcggttttctgcatcattttaattgctgttgacttttcattgacatttagcatagatttttgctcatttttgttttttaaagaacgatactgaaagacaagaaaaatgctatcagaggactacaaacctacaggagttgagtttcagtcgtgaaacattataatcattttctgtgctttccatatttccttgaatgagaatgtattatttttataataagagaaaatttttaaaggaaaagaagttaaaaaaaaaaaggcctcacttgtaaggtagggtatggttttttcaagtctcaggcacgtaaatgacaagggactttttaaaaaacaaaaaaacactgccatttaaagctgactggtaggatcttccctgctaaattattttggaaacttctttaaaaataaatgtagaccacgaatcatttactaaacatatgattccagtacctcactaccttttctcttcggttggctgtagtttaaattctaaggtctcctcaagaaatgacattttcacatttcttaggcatctgtggtgccagaggagcaaacccatcgcacacgccaggtctgccatggggccctgggcggtggggattttggatgtaacgtgtctaggccgagcccgcgccgtgaaaggcctaccctgccgaaagcccgggcggcgggcgcccacaagtcagggctcggtgcggcgccgcagccagctctgcccgcgagccgagtccgggctgctgagggggagccgcgctgggggcggcggcgtcggggcgggggcgggagccgggcggcagctccagcgcccgtgggggaggagcggcagcggcggcggctggagctgctgtggcgaccgacgcgaggcggtggcagaggagacccacccctgtccacatggacagtcgcaaaggcctccgctgatgcattcacgcctgggcggggtgggcggacggccgtagcggcggcggctgcagaacgagctaggggcctgggggcgcctgacggtcgcagagacctcgccgctccggcgcggcgggtgcggccattttacggcctgggacgaagggaggcgtgtttgtgtgctcgctttcattctcctttcttgggaacccacggctgggggaagtttctcaggcagcctgggtgggcggtggatggggagtcgtgggccgagaggaaccgggcccgggaagcgccgtcgtcgtcgtcgccggtcgcgttcccccggagaggcctgagaagctcgggccgcgggcctcgctgcccgccagcccgcggacaggcccgggcgcgcctggcctgcctttgtataggcccgtctgaacgtgggagcgcagcccgcctgacggctgagcccgaggcccgcaaccctgcggcgtctaccctcctccggcgcggcccctcatcccggcgagcacggcggcggtgtgggccatggattaagaaggaggcggcgtgggaggaggaagatggcggccggcaagagcggcggtagcgcaggggagattacttttctggaaggtacgtctgtttctgcccttgacggggagaagggagggtatactggaaaacgtggcccccagaaccccggatattcagttatctgcgctgggtgggtttcgggggcggtgaagtacgagggatgagcgatgacggggagggagtgtgctgcgagcgcacctggttcgagtccgcctaggcgaggggctcggctgcgagccggttcggcccagggggcgcgggtggattgagctacgagccagagttggtgggcgtcctttgagagtgcgcgctgaagtctttgacatttaaaaaattttggggtggtggcctaaggatgagagcagccagcattcacatcttgtctggtgttcatgaaaagtttcaaattgctaaggttgggtgcaactggggaccaatctaagtagggaggggacagacagtttcattgaggtgtgttttataccctctggtctgtttctcagagtttcaggcttgcttttgcagccagccttcagattaggcctggccttgtctgatattctttcggaatgtgtttttataaaaatattctgtaaaataatttatctggaaaaagagtaaggtttacagtgtcaattttggggccgtaactaaagcttattgacacaatttgagttttactcactcgtgagggaaagttaaacatttgctgtaagtagactaagccagcctcaagaaaagctgtatgtttttgttggggaaggtggtaatggggaacaatattgatttttttggcctatgaatatataaggacccccaaaatagagctaaatgttattgtaattgtagcccaagaagtgtttatattacttaatttgactatgggttcagtgtttacactttgtttagcaaaatgagtctctgctgctcagagactcattcttcttgttaaaaagaattaactactctttggataattttgcaaagatgattttcattgcaatatgtcataagctttacttcaaaaaataacttcttttagtatgtttcggaaagattactgaatcaagaaagtacaatttaacttaaaattaagaaaatccctaaacaggttctataggagggtgttgaggaatgggaatgctttggtactgctttgttaacagcacctcgaacagtgcctggaacacagtaggtactcagtgttagtctagtgaaagaatagtgaataatagaggtaatttttcttaattcttcttacttgagtatagtaaagtgaaaaaaaagtcttaccgtacaagccagcctttatctaaaagtgatgagaactttacaggagatttcctagtaagagtaagaaaagcttctgagtttttctgggttcgtttcgtattacctccattccagtttgcggaatgggtacctgtcgaggctgagagggtgcagcttgtgttacaggtagtgctatgtgtgttgtttttgttttgaaattggaaacaaaagatggcttactcgtgcttattatcttcagtatgcagatgattatacttttgtgctatcctagatttccagcttctataggcccgattgagttaaaattctaattggatgaacatagggaggattaaaacaagcacaaataaagccacagatgtagagttaatgtgagtttcaaactactacttttactttattctaatctaagggtctttgaatgtataggtgtgataaattcgagtttcaccatgtcttaagcatttttataaagcaagcaaacggtaacttctttagagcataagcataagggttctgggcacggtggcggcacgcccttaatcacacacagcattttggagggccgaggcaggcggatcacttgaggccaggaattggtgaccagcctggccaacatggcgaaaccccactctactaaaaatacaaaaattagccgtgtgtggttggcgcgcgcctgtagtcccagctactgcggaggctgaggcaggagaatcgcttggaaacgggaggcagaggttgcagtgatagcgccactgcactccagccagggcaactgagcgagattctgtctccaaaaaaaaaaagcataaggaaaaggaacaattttagttcctcataaccaattttcatatgctatattgaatctttccaaataaatgatatttaatactaatgttttctgcttatttcccatgattcttttggtgtcttacacttttaataataataaaatattccggccaggcgtggtggctcacgcctgtaatcccaacaatttgggaggccgagatgaacggatcacctgaggtcaggagtttgagaccagcctggccaacatggtgaaaccccgtctctactaaaaatacagaaattagtctggcgtggtggcgcgcgcctgtaatcccaactactcgggaggctgaggcaggagaatcacctgaacccaggagctggaggttgcagtgagccgagatcgcaccattcgcactccagcctgggcgaggagcgaaactacatctcaaataataataaaatattccaccataatttgctgcatattttgtattaccaggtttataagtgttcaaaatatttccccatacataggctcctaggatttaatattaagacatctacatattacactttctttactttccagtcgagtccttgaaaaactaaactaggttttcatttgctcatcacatttacagcatcctactctaacagtcagtgtaccacggtgaagtgcataagagagtcaaggactctgcctttatttagtcttctgtcttaggttctgtgaaagcatatctctgtaataaactgtgaaaaagtaatgacttttttttcaccatcatatttcttgcacctgaaacatatttgttgttaatgaaataaaccagatgataaacagtatgataaatacggaagacataaacagcaatgatggggaagccattttacatagcattgaagtcaagaaaggcatccctgaggaggttacacttaattaagtaaacaccttaactaagagacacttcagaatatggcagaggggatgcgtgtaaagattgatttgataaacaaaaaggctgaaatgtagaaagcaaaggagagagtgatatgagaggcaggagatctttcatgcaggatcatgaataatttttatatctttctcagcgggaagccattgacgagtttggcgcaagggggtgtaatgatatggtttatctttttttaaaaaaaagtttggctgctttttgtggaattaattagggggcaagattaaaagcaagacaataaattaggataatattgtagtagtcaaggtagaagtggtcggggcttcaattagcatgatgtcagtggagactggggaagagaagttgataggttgaggatatgtttggatgtagagcttacaggacttgatgaactgtacattgagtgtcagaataagaggaatcaaaaggttttgtttagcctgaggtattagtggtactgccatttactgagatggagtagactgatagaagaatgagaaggaaattaacaacactggtcatactaaatttgagatgcctgtttgacatttttgctctgaagtatgttttatatctttataactactaagattctaattccatttctttttatagcttctgtagggaaaaggagacctactggttgtctttatttatacaaaagcacactaaaattgtatggatttcattaagccacagcttgtgttaaaattttctactctcctctcccctctttgacttgtttctttcacttctcttcactaactgttgctcataaccccttttccacttatgatagacagttttggcaggttgctcccctgtatttattcagtcaacagatacttattgaacacctactatgttgtaggcaatgacactgcactgagaggcataacagtgagggagaagaaaccatgtttttttcatagagtgttcagtctagtgaggaaagtaaaaaataataaaataatacttttaaatgtaaaattacaactgacaagtacagcaatcagtggtggattgtttatacaagttgaacatcccaaatttagaaatccaaaatcctccagaatttgaagcaacatgacccccctaagaaatgctcattgaatcaattcagatttttggatttgggatgctcagttgggataatataataaaatttgcaaatattccaaaatccaaaaaaaaaatctgaaatctgaaacatttcttctagtttcaagcatttcggataagggacacttaacctgaaatcatgagaattggatctaatcagggtggtttgaagtgggtattagagaacagaaggtagagaggcagtgctttctaggtagagagagtaaaataggggagcatggcatgtttggggaacttaagggaggacaataatggtgtcagataggagagcggtgcaagatgatactggaggtgacatcacatttatttcaaacaaggtcaatagccgggcatggtggctcacgcctgtaatcccagcattttgggaggccaagttgagaggattgcttgagcccaggagttggagaccagcctgagcaacatagtgagcccgtgtctgtacaaaaacataaaaaaatgatatgggaggattcttgagcccaggagggcgaggctgcagtgagccatgatcgtaccactgcattcccacctgggagtacagagcgagaccctgccacccaaaaaaaaaaaggtcatcagctgctacatggagagagcttcagagaggggcagcagattatccagttaggagatgattggaatagaggacaaaggtgattgatggtggctagcttgttcctataaactttcttttgatattctaccttttctttttttcactctgggggctctaacaagcctacctactctcttatacatttcttcatttttgtactgcacttgttcatatctagttttcttttccttttttttttaaccaagtgaattccttctcctatattttctcccgtttttcctgaagtaacttttttctgccttcctttctaatatacatatactactactttagtttgttttccttttcatttcagcctgtcttcctttatggaccttgtctactaggttgaaaagagtgatgctaaactgttgcatgcaatgttgttctctacagataccagcaaaaatgcttctgtctccaaatgaaaagtgttttccatttcgccttagccagtcttttatgttatatataaactcattgcagaacccaatcagtttgccagttttactggagaccgtaaatacctaacactgtctgttgaactagagcacagcttctcccaaacgattggcattccatggaatatgaacagggtttctagtttctgcctacttaggggaatacacctctttttcttttgattgcattacttttggaaactacatcatggtgtcattccttatttactccttacttaagtatgtttatttcctgatttcatcccagttaaagtgataaattctgtttatcatgtgagttcatgtacttgaaacagtaaagtagaacctcacttggaatgaaagtgattttcaggcaaagtttagtgggtcatacctgttatcctgagataacacttcgggaggccaaggcaggaggattgcttgagcccaggagttcaagaccagcctgggcaacataacgaggccccatctctgcaaaaaatacaaaaattaaccggatgtcacagcatgcacccaaagtcccaggaattcaggaggctgaggtgggaggattgcttgttgctcgagcccaggaggttgaggctgcaattcatgacactgcacttcagcctgggtgacagagctgagaagaaagaaagaaaaaagagagggagggagaaagaaagaagaggaaaaagaggaaaggaggaaggaaagaaagaaggaaagagaggaaggaaagaaaggaggaaagaaaggaaggagaaaagaaagtgattttcgctagaaatgcattgagaatatgaactcaaaagtcagaatgctgaggttcaacatctggctttactacttgttagctatgtgatcttggatagattacttaacttctctgttttctcagctatataacaagggtaataattgtcgttaaaaataataattgtagttaccttataagattgccatgaggattgaggaaatatatattacttaaagcaattccaggcatataataagcactccgtgttacttgatattatttattttattagcagatagagaaaagaaaaagagcttcctttacttgcttgtcttctcttctatttgaattttagtttgcattgtttttctttcactgactacctttttctagatattagctgattttgaccagtgttgtaatgagagaggaaagagaatgaaattacatactttgtatgtctagactttcataaattgattattcctgttgctattagaaaagtatgttgaatatttgaggaacttgaggtatagaagggttgtttggcacagcttaagttattggggaagtcagactgtagcctgggacccgacttaatagcttcagctttcttcagcatttccttcctctccctttctccccgcttcctcatcactttgcttccctattcttactcttacctctttttcctgtacctccccccaaaggaaggggcgactgaacaagagaaggaaaaataataagttattatggagaagtattatttattgatgaagcagcacttttaagagggcaaaaatggaaagccacaaatctcttgaggcccaacttcagaaatttacagtgttaacgtcttccacattgtattggccaaaagaatacagagccagccctgattgaaggggagagggagtagattccacccttcagtgggaagaatgacaaataatttgcagctatctttaatctatacagccatcttttctctcccatacctacctggtattttttccccattctttcaacagtcaaagtatttttcaacagtcatgtagtattttaaatgacaattcttatgaaacccaaaatccaacttttggacagtttgggaagctaaagaaagacaaaacaaaatgggcaacttaattagtaatttatttcaaagatataaatagcatagaaacagtcattagtttaatgttttgtttttgtttttgttttttgagatggagtagatggagtctcggctccgttgcccaggctggagtgtagtggcgccatctcagctcactggctgactgcaacctctgccttccaggttcaagcaattctgcttcctcagcctccctagtagctgggattacaggcgcataccaccatgcctgactaatttttgtatttttagtagagatggggtttctccatgttgtccaggctggtctcaaactcctgacctcaagtgatccacctacttcagcctcccagagtgctgggattagaagtgtgagtcaccgcacctggccttagtttaacttctagttgattgggaatggattcaggaatttctgaaactaggcaagcataagtatggacaaaagaggaagaatgttagaaacttttccttccttttgttttttctttcatttagtgatgcctgggtcttgctctcattttcattacttaagctcttagaaatggtcatactattcacgatactaaaagtaaaacagtatcttgatataaaatgccagttaatccactaagtcacagactgttaatgctcacagttacagcacacttaagttgtatacctaagtcatattacttagaatgatgcaacaatggataatccattattgtgaactgcaaatgatggttgccatcatcaggtaataaaacaatggctacagttacagaaagtgatagataatctgtgccatatccatttgacactaaaaacagggttgtttttggaccctaattttttttgtctaccttagggttttgtacttcccagaatcttctgcatccattggcaaaaattattaactattatcttcagagtatatggggctttcagtgctaaaattgggatagtcccaggcacactgggatgtttggacactctgccttgtcctagtttaacaacagctaccttgaagccatctgaaatcagcctggagtagtatgaaaacagctatgttctgatcttgcctttggaggttgtttttgtttgttttgtttgggggtggggtgagggaggagttgctatatcaaatacattttatagtttttgaagatgcgttttttccccctcccaaattcactgcattacagtttttgaaacagaacgggagaaaaaaaataacaaacagtgctggcatccaatagatggtaaattcacttttcatttttaataaagagtggacgacgaggaactagaaattctcctaggcttggagaatttaaactgtttagtaaccttgttgtttcatatattcaaaaatctacaactttctaccttcataacctcctacttatgaatcaagaactaaattctggagacaagatgaaggtactacttaactaccatgacccctgctgactctgcttctgtggaaaccaataacttctctttcttcataaccccagtggtcactatttgaatgaagtgggattccaaacattttggcattcagtcttctgttttcagcccaggttggttttcattttttaaccacaggagatataaaagaatgatttagtaaatcataatagcagttaagtctgaagctgttcatcagcttctccttcacaagtttgggtatcagctcctcagtctcttttgctttcaccatttacaggcttcacttatttcttgagtctctgttaatttaagcttttaatgaaactgtgcatcttcctgaattacgtgtttgcactttcaaagttaaagtgtttctcaaatttcattggtctgtctcacagaatactgaattccctgacactttgatgatcctctcactttaaagcataaggaacatttggaactacttatctcatgcagtcatttctcggtttaatttctggctttagaagtttgtgtgcttcagcttgagataagtgtatttttaagagattgtgtattctgtgtaaaggtagcgccaactgcactgctttggaataggtatcattgctagactttttcattccatagaaagttaaggagtttccagcaacacctgtagcactaaactgctgcctgactaacgaactgaactgactatgctatcatcttgctgaaaggtacatagaagtagatagactagtgaagctggggtgctaagggaaagaacattttggttttggtagctcacagaggggtctaatttaatattacatccagaaatatagtatttaaagactttatcttgaagtagtagtgatctattagtttgtcttctataccaagagatacaggttttgaaggtcagggacttgagaaaggcttagctaggtgacttttcttcttcatgtagcatctgcagggatgatttggtggtggcttgtgtggtttggtcgggaagttccatgtctgcagtctaaagacctcttcagatggcctctgcagcagggtactcagacttgtaacatggtgactcaaggctttggaaaatcttgatagttcttaagaaagacttgggctgtagccctgcagagccacataaaattgcttttcgaacatacacatttaattctctctatattttcttttgctgcatttatatttctaagttacgtttttctcatattcgtaattgttgtggtgcgcttatggctcattgcagtctcaaactcctgggctcaagggatcctcctgcctcagcctccttagtagctgggactacaggcttgtgccaccacaaccagctgatttttttatttttgtagagacagagtgtcactatgctgctcaggctgctctcgacttctggcctcaagcaatcctcttgccttagccacccaaaacgctaggattataggtgtgagctgtctgataaccccatgagacgtagaaattaaaacatcactacagtgggagatgatgcatagaaacaggaaacaggaaaacttaaaaacagtactgaaaccactttggagatcagtttggcaatacctattgaacttgaaaatgcacatccccaaggaccaaatcattccattgctaaaggataccctaggtcaggtatcagaaaactatgccccagaccaggcgcagtggctcacgtctgtaatcctagcactttgggaggccaaaacaggcagatcacttgaggccaggagttcaaaaccagcctggccaacatggtgagaccccatcactactaaaaatacaaaaatcagccgggcatcgtggcatatgcctgtaatcccagctacttgggaggctgaggcacgagaatcgcttgaacccaggaggcagaggttgcagtgagccgagattgtgccactgcactccagcctgcgtgacagagtgagattctgtctttaaaaaaaaaaaaagaaaagaaaactatgacccagccaaatttgtccagctgcctgtttttaagaggctcatgagctcagaatggcttttatatttttaatgactggagggaaaaagtcaaaagaagaatgtttcatgacacatgaaaattacatgaaattcaaatgtcactgcccttaaataaagttttattgcaacacagcaatacctatttgcattatccctgccttctcattgaaatggcaacgttgagtaactgacagggactgtatggactacacagtgtaagatatttaccgtctggccttttacagaaaaaggctggtgacctctgccctagagaaacatacatgcacaaggaaacaaacttaaaaaaaaaagttcttaatagcaatatgagacatactaaaatgttcatagtagcaatgtatgtaatagtaaaaaggtggatataacctaaatttccacaaatagggggatgtataaataagcgattatatttatactgtggagcactaaatgataatgaaaatgaaagcactagcttttttttttttctttaactctttgaaagtaaatttcagacatgctgctcatttaaccgtaattactttattgtgtaacttacccttatttgtttaggaaatatacattctcttaagttactgcagtgtagttataaaactcagaaaattaacattgatacaatactataatctacaaacatttttccactttcattagttgacctaaaaatgttccttaatagcaaaagagaaaaaattctggttcaggatctgatacagaatgatgtattgcattgattgttatgtcccatttgtcttctttaatctggaaatagcttttcagactttgtctttcttgaccttgacatgttttaagaaaacagggtggttattttgtagtttaatcccaatttgcgtttatctgatgtttccttatgattcaagtcaggttatgcattttttaaaaatataaggaatgccataaaaatgatttttttgttcttttcagtgtgtcatattgaggggaccatgatgtcaatttgtcttgttgttggggaaattaactttgatcacttagttaaggtggtgttcaccagatttttccacagaaagttactatctttttttttttttttttttgtttgagacagagtctggctctgtcacccaggctggagtgctgtggcgcattctcagctcactgcaacctctgcctcccaggtttaagccattcttctgcctcagcctcccgagtagctgggattacaggtgtgcaccaccacgccaggcaaatttttttgtatttttagtagagatggggaattaccatattggccagactggtctcaaactcctgaccttgtgatccacctgccttggcctcccaaagtgctaggattacaggcgtgagccactgcacccagccactatctttctctttgaaattaataaatattgtgtggagagatactttgaaacctgtaaataacttgtttctcgtcagatttcacccactggttcagcatccattgatgattcatgcctgaatcccccaattattaatataatggttcccaagtgatttttctccctttactgcaccaacaataggaccttcactatgtacttgaatagacttgctgatagcttattgctggggagaaattagatgtttgctgaaggtttggggagttattcctgtttcagattaagggagtgcctttctattcctggtttgcaagttttttgttgttgttgttttgagacagagtctcacacacttttttacccaggctggagtgcagtggtggcctgatctcggctcactgcaatttccagctcctgggttcaagcaattctcctgcctcagcctcccaattagctgggattacaagcatgcaccaccacacccagctcatttttgtatttttagtagaaacagggtttcaccatgttggccaagctggtcttgaatgcctgacctcaagtgattcacccaccttggcctcccaaagtgctgggattatctcgcctatcctgctaagaggtttgttttggtttgtttgagtcttgctgtgtcgcgcaggctgaagtgcagtggcatgatctcagctcactcaacctctgccttgtgggttcaagcgattctcctgtgtcagcctcccgagtagctgggattacaggtgcgcgccaccatgcctggctaatttttgtatttttagtagagacggggtttcgcagcattggccaggctagtctcaaactcctgacctcaagtgatccacccacctcgccctcccaaagtgctgggattacaggcatgagccactgtgccctgcctgctaagagtttttgtttgttgtgagtggatactgtaaattacatttatgattttcaaatgtttacttttgctttttagaataaaccctgcttaattgtaatgtgttatttatatatcactgagtttgatttgctaagattttgtttaggttttatatctgtctttttgtgagattgctcagtaattttccttccttgaatgtcactgtcaagtttaggatcaagtattctgacttcataaaatgagctgcaaagtgttccttttttattttctgcaaaagttcagataagattgatgctattttttaaaagtttgaaagaaattagtggcgaagccttctgagcctgagttttgattttttgggaagatttgtcataatgaattcaatttattttattgatatagcagtattaaaaatcttcttttgcttcttgtgttcatttggtaacttgtgccctcatagacatttaggtttttgctttctttggtcaaccatactagttcctattcatccaccgaatgtttatcttttttcacttttgttaatctctcttctactattatctcctctctggttctttttgttcttatgggttgctacttttcttcctctttccattattgtcattttagtggaggatatggagaaaactttaggtgtttaatttgtgatatttaactgggatctctccttaacctttttctttccatctccttaattttctaactagaatacagtggacataattttctactctcataattacaaaggtcaaccataacaagttattgaaatgtagtgatactctcaaggacttttgaagattttaagtttttgtccccactccaggttgcccccaaacttttaaaaatctcttttctttttataatttattttttctctcactggaaattatcacttccatggaggttctaatctaatatcaattagggtatgattgagtttgttagaattatgtgtacacagccaggtgtggtggcacacgcctgtaatcctagtgctttgggaggccgaggcgggtggatcacaaggtcaggagttcgagaccagcctgaccaacatggtgaaaccctgtctttactaaaaatacaaaattagccgggcgtggtagcatgcgcctgtaatcccagctactcaggaggctgaggcaggagaatcacttgaacccgggaggcggaggttgcagtgagttgagattgcgccactgcactccagcctgggcgacagagcaagactccatctcaaaaaaaaaaaaaaaaaaaggaattgtgtgtaaagaaccccagttcctttagtgcataaatattacgacgtctcttttgacttttgaaacataggttcattttacattgtgtttttaaatttttatttatgtatttttgagattgtcttgctgtgtcacccaggctggattgctgtggtgtgatcatggctcactgcagcctcaacctcccaggctcaattgatcctccgtccaatcctcctatcccagtctcctgagtagctggtactacaggcacgcaccaccatgccaggctaatttttttgtatttttttgtagagacaggattttgtcatgttgcccaggctggtctcaaactcctgggctaaagtgatctgcccacttcagcctcacaaaatgcttagattacaggcatgagccactgcacccagcctttggtgttttaaaactttttcttttggaatacatttaaatttatatagaagtttcaatgatggtttggagaatttctttctttcttttttttttttttttttttttttttgagacggagtttcgctcttgttgcccaggctggagtgcaatggcgtgatcttggctcactgcgacctccgtctcctgggttcaagtgattctcctgcttcagcctcctgagtaggtggggttacaggcatgcaccaccacaccggctaattttgtatttttagtagagacagggtttctccacgttggtcaggctggtctcaaactcccgacctcaggtgatccgcccgcctccgcctccacctcccaaagtgctgggattacaggcaggagccactgtgcccggccggtttagagaacttctatataacttttactccgcctccactaatgttgccaccaaatatagccagtgtatgtttgtcacaactatgaaatttaacatttgtgtgatagtgttattactattacctgaactacaaactttattttggatttaaccagtaattccattaacacccttttcatattcgagagtccaatccaggactttggatttgattgtcttgtctccttagtatactgtgttctttcacagtttcttaatctttccttgtttttcataaccttgacagttgtacaaaatactgtatacaggtattttatacagtgtccctcaggttgggtttgtctgatgttttcttatgattaaactgggattatgagttttagggaaaggatcacagtgctgaagtgctattttcatcataccatattaaagggtacatgccatgaataagacatatcactatgaatgttaactatgatcacttggctgaggtagtgtttgtcaggtttctccattgtcagtttgtttttcctcccttttatgtctgtgtttttgacgtaagttaccaagttgagcccatactcaagggaaggaaaattcatttttatctttggagaagggagtatatgcttatattatttggaattcttctgtaaggaacatgtgtcccttctttccatttatttatttattcatctgtttttatcagtatggattcgggaatgtttattttatttaggagttataacccaatgccgatgttatttatttttgctaaaattgttccaactttggccgttgggaattctttcaagttggcttctgtaaccttttgacatgcccctgtctttaaaaaaaaataatgattttcttgcattctgaccctgtaagttacaccaggttcatattggtgttttttctgcctctggcctagaatcagtcatttcttctaggaaccctggctccttttattagagagaatggtatttagaaaccaagatctagttgtaggtgtgtttgttgctactggggtgtcactgcttctagaccctctaagaaagcagctctagctctctatactaacccgtgttacaacatacctgtacatctgtgtatgtattaaataaatgtgagttcaggctggtatgtctgactctaacctagcaccatagggttcattctgtctttcctctcttgcttatttgtaacttctttatttgacagggagaaaccttgtttccatcatctactatttatttacttatgttttcaatcccagtatacatgttaggaagtttcatgtatactgatggtttgctcattaagacttatttcctcctgttcatgatatttctgaaactttttttttttcaggcttgcattgaagttttatattttttagagaggatttatgtttgcttgtgttagtcactttcaggcttttttttttttccttttaaaagcagttttttattgtggtataatatacataacatataagttactgtttaaccatttttaagtgtatatttatgcagttcattggtattaagtacatttataatgttgtgcagccaccaccaatatttatttttggatcttttaaatcatcataaacaagaactgtgtacctgttaaacagtaattctccatttctctacttcctttagcctctggtaaccttgattctactttctgtctctatgaatttacctattctgggtacttcatatatgtggaatcatacaatatttgtccttttgcatctggcttatttcacttagtaactgttttcaaggttcatctgtcttgtatcctgtatccaattcgtatccctttaaggctgaataacattccgttgtgtctatgtgtgtgtgtgtgtgtgtgtgtgtgtacatatgtacacacatactgtattttgtttattaatctgttgatagaaatttgggttgtttccaccatttagcttactgtgaataatgctgctatgaacattggcatacaagtgtctgtttgaatacatgcttttgttattttagatgtctccctagaagtgaaattgctagctcgtagggtaattctatgtttaactttttgaggaactgccaaattattttctacagtgcctgaactgttttgcgttcccactagcaatgcacaagagttccagtttctcccacatcctagccaatacttgttactttccatttttaaaagtaaataatagcagccaggcagggtggctcacacctgtattcccagcactttgagtggctgaggcagggaggatggattgaggctgggagttcgagaccagcctgggcaaaatggcaagacctcacctctacaaaaaaatttaaaaatttcctgagcatggtggcatgtgtctgtgatcccagctactccataggctgaggcgggaagatcatttgggcccaagaagtcaaggctgcagtgagccatgatggcaccactgcactccagcttgggctaccttgcctcaaaaaaaaaaaaaaaaaaaagaggaaaataagctttcctaatgggtgagaagtagtatctcattatggttttgatttgcattttttaatggttagtgatgctgagcatcttttcatgggaggatattttaattatgggtttttcatggccttgtaagttgtgaaaattctggctacaaaccctagttaattgtcatctcttatgattagggatttcctgtcttagttcattcgggctgctgtattgaagtccatagactgagtggcctttaaacctcacatttctcagaattctggaagctgggaagttagatcaagaggtccagattcagtatctggtaaggtcccactttttcacaaatggtgccttctggctgtctcctcacagaatggaaggggcaaacaggctccattgggcctctttgataagggcaccaatcccattcgtgagagctgtgccctcgtgatctaatcagctcacacaggccccacctcttaataccatctgtatcttggggttaggatttcatcatataaatttgagaacattcagaccatagcactgaccatggggtggatgtactttatttgtctttagttcaactcagaaagccagagccaagcttaagacatcagaattatccccactgcctcttcagtgagttttttgttctgttttgtttttccctagttcaccaagtcagagcgttgcccttcagcttgtctggttttcagtctgacatctcattttgctggggccttgaggttaacctaataaagcctgggttctaggacatcaggtttttggtcatagggtaccaagagagaaatgccatctttggaatttcatttagctctctgggttcccactttctaattgttaatggcttcaaggggtttcagccatgcacttataaaattttttaaaattcataatgagcacatttagtgttctgatctagagtttttcaggttgtcaagttttaaccacattgccaaaaccgaaaacgttgtttgtttttcttctgttaaaaggcaggtatcgttgagtttaagggagagtctagcagtctggatatagttctcatgaagaaggcaagcaaactatttataggtacttatttctagaatcagtgatcaaagatgagatttagggctgattttatatatattcatacatattcatgtgccctccgtttttattatagctttctaatctgagcttctttgtgtagcaagcacatgtatggatgattatgaattagtaaaaacagattttaatgtcttctttttctctttggaggaaatcaaatgtttacaaaaaatagacaaaggcaaccaaattaaaacaaaatctagaataatcaaagagcttgggaaatgcacatatttgttttatattgaatagctctattaatgaatacttactgcagtttgtttttatttcagctttggctagatcagagtctaagagagatggaggttttaaaaataattggagctttgatcatgaagaagaaagtgaaggagatacagataaagagtaaggatttttttttccctcagatgttttataagaataaaacttctcattagaaaaacaatttctattgtatggaaatatttttaggagtatggtattcttaagaaaacatataactctttcacagtcgctttaaggaaagaaaaagcaattccttattgataaataattttactgttattttctccatcttttgaaatgtataaatatatgcttgtagtacatgtaaccttacaattaaaaattgactgtacaatggaaggcttcaaaataaggaaattgttttttgttttttaaaaaggcattctgttcaggcagcaatttggaaatccaccatttatcatgagtaagtgaacccagataagacccttgcattttgtatgaaagtttaaatactacagtatctttcttccccagttgtgaccaccacccctaccacatccatcttaggtcagattctcaccagagaaagcagaaccattataaatgataaacacaggtgtttacccagacagaagttaagcaaagtgttcattacactttgttaatctacttggaatgactgttgtgtaaaaattttaaatgatagttttaatagaactttttgtttgtcatgagatttgtttttaaagttcaacatctagttttttggccgggcacagtggctcatgcctgtaatcccaacactttggaaggccgaggcaggtggttcatttgaggtcaggagttcaagatcagcttggccaacatggtgagacctcatctctactaaaaatacaaaagattagctggatgtggtggcacacacctgtaatcccagctactcaggaggctgaggcaggagaatcacttgaacccgggaggtagaggttgcagtgaacccagatcatgccattgcactccagcctgggcgacagagtaagactccgtctcaacaaaacaaaaacaaacaaaaaaacattgtttttagttttttgatttattgatctggttttctgctggccaaaataaacaacaaattcagagatccacaaatatacacacaaagttctaccaaaactataaatatgttaaagaaatttttatacaagaagtcattcagaatatattggctaaatattgtaggtgcttcacttctgtctgggcaacagctccgttcatcattaccactttatgtgccttcaccgatgagatgttgatttgaagttttatttgaaggagagctttgaactggtaagtctctcatttaaagtcagtattttatggttttctttctttcatttcttttatactttttctgattactttaaaatataaaacaattattcagtatgcatatagttttgaaaaattagaattaaatctgaaattaagctgcatagaaaatataccactttttaaacatgtttataaaatgtttacgagagactttttaatcattaaaaaaaagtttggatgtatataaacagtaatacaacattttacatttttgtgtaaatatctaggactttacaataaatagctgagttgtcttcgaaaacgttgtatttgactttctttgatggcagatttactgtagttatacattttttaaaaactgtctttacggtgctagctgtcctgtacatttcatttctgaattgtactatttggttcatcatgagtctcaggcacatcagctttttgaacatgtatctattaacatgaacctgttaatagatacattagtttaatcttctagaatttcaggccggtgatttctcaatgaagggttgatattttcaagagtggtagaagtataactattttaccatggtaataccactggaattactttcttttcattagctaaggctttctttcctttcagttcatttctttgtttctctatctttctacccttaattttcaatctaagacaaaaaggaaaaatgaatgagaatatataaaatccataactaaataaacagaattatgtgttcatttattgtagggttcaacaaactatgatccatgggctaatcttgcgtgccacctaattcagttaataatttttattggaacatagccacatgtattgtttatggctgttttcatacaacatatgagtagctgctacagagaccatatggcctgcaaagactatggtttggccctttacagaaaaagtttgctgattccctgaattaggtgaacatagaggataaaacctcagaatttaatataaggattgtgattgctacttatgtttttttccccttattttctgtgtagtgggacaaatctgctcagtgtggatgaagatgaggattctgaaacctcaaaaggaaaaaaggcaagtgttgcttaaaatattttcttcttttacattatatacaaaaaaattgttacctcaaaagatttaatatttttaaattataaaccccagttacccactttctccactccagaggcaaatggtgttcccagtttgttatttatcactttgggaatgtttcatgcattataaagaagagaaatatttccacctcccatgttacacaattggtaatatactgtgcatggtttttctgatcttcctttaacttaatatattatcttggagaccatctgtaagagttcataaaaagcacctcattgttttcagtgagtgcatagtattccattgtattatataccattaaccaattccacctattgatggatatttacagagttgtcaactttttaatttttttctaaaataatctgtaaattagccttctatatgggttattttgcacacatacaagcgtatctgtagaatgaattcctagaggttgcactgctttatcaggacaggtccatttctaattttggcataccagatttacacttgttccatcgatatctgaacgtatctgtttccccacacatccgtcataatgtcttcaacctttgatctttgcaaatgaaaactagtatctcagtgtagttttaatttccattttattttttgtgaggttgaacatcatttcatatgtatagtctcattcttttttagaataattgtcagttaatatcctttgcccatttttctatctggtctttagaatattattcataggaattatttttatatttagtctaagacacactttttttcacattttaacatctttgaaatctagatgcatcttattaagatagcatgatatgctttaattatttaaaaaaaatgtttttggccaagtgtagtggctcacgcctataatcctagcactttgggaaatcaaggtgggagaattgctttaggccaggagtttgagactacctggacaacatagtgagactccatctctaaaaaataaaaaattttgcactgtagtacatacaataatggtgtattgtataataatgttataggtttgatgaaataaggtattttggagaaattggccctttgctgtgatactagttgctaatatatatacgtgtgtgtgtgtcctttttttttttttttttttcagacggagtctggctcttgcccagaatagagtgcagtggcgcaatctcagcttactgccacctctgtctcccgggttcaaacaattctcatgcctcagccacacgagtagttgggattacaggcatacaccaccatgcctggctaattttttttttatttttattagagaccgggtttcaccattttggctagactggtcatgaactcctggcctcaagtgattctcccatctctgcctccgaaagtgttgggattacagacgtgagccaccgtgcctggccattactaaaattttaactcagttttttcactagtcttttgtctttgcttatggtggctattgccatggggaaaatatatttccttatgtcatcagatgtatcatttttcttttaaaggcttttgagtctactgtctttgttcctaatgatgttaatttaataacttatttggggctgggcacagtggcttatgccagtaatcccaacactttgggaggccaaagcaggcagatcacttgaggtcagtagttcgagaccagcctggccaacatgttgaaacctcgtctctactaaaaatagaaaaattagccaggcatggtagtgggctcctgtagtcccagctacgtgggaggctgaggaaggagaattgcttgagctcaggaggcagaggttgcagtgagctgagattgcgccactgcactccagcctgggtgacagagcgagactcagtctccaaacaaaaaacaaaacaaaaaaacccacttttatttgctttgtcttattagatatataaaatagtttcacaatagtaataccaacataattactaataaaatgattttcaaattattttgtttccttgtttttgatgacactagcaggtatatgtatagttccactaggaatgtgtatttaaattagtatatttttaagtaatttgaaattgtttatttctgtttggtattctaccaactaaatagagagttaggtttgttgttgttgttgttgttgttttttaattttgttttttatagtgaggaattgcattttattttcattttaatttttattatgtaaattttttggatggtttcagcatcatatctcaaaagaagtaattttcagagaaatctaattttgtcttgattccctttattcttttttccctataagtgacttgttttaaaaattatgtggcttagctttttatatatatatatatatgtaagcatataccacttttcttggaaaaactatacacactgttgacaccttgatttttttacttgacagtatgttatgtagatcactctacagcaaagtatttacaaatctttatcatcctttttattgttatatagtacttcattggatggatatactgtagatattcagtttgtccctactgatgaatagagatttttttcccccagtcttttgctattacgtataagacttcactaaaaccttgtgcatagatatttttttcatatctgtgtagtatatttgtgggatagattcctagaattgaagttgctatttcagaggtgaaattcacatgtagttttgctagatactgccaaattccctatctaaaggtgttaacattagccattcccactagcagtgtatgactctatttccctgtaatcttgcaaaatatgtagtcatacttgaatttttgctgatctgaacatagcaccttcacatatttcctgtatttacagtgtaagaatttaaacaacttttaacatttacttttttttccgtctttctgggtttttttttccctctgcaacagctctattttatcataatttgaggaaatttattttatttatttatctattgagactgagtctcactctgttgcccaggttggagtgcatggtgcgatatcggctcactgcaacttctgcctcccagattcaagtgattctcctgcctcagcctcctgagtagctgggattacacacggacaccaacaaaccagctaacttttgtattttagtagagctggggtttcaccatgttggtcaggctggtcttgaactcctgacctcagatgatctacccaccttggcctcccaaagtgctgagattacaggcgtgagccactgtgcctgtcctgaggaaattattgaatttgatgtttttctcttaatactgttcagtttttctttataaagttattcatgctgaaaaactctaaggtttttcccactgcaggtttcctagcttttattttgacatctggatttcctgaagtgctattttttaggtgttttttagatagacaagaaaaaagtagaaaaaaaggagtgaacttggtagatgaaaataagatgtgagcaggcacggtgtcttttgcctgtaatcccagcaccttggtaggatgaagcgggaggatcgttcgaagccaggagtttgagatcagcctgggcaacaaaatgagactctaccagaaataaaaataaaaaataaaagatgttttctgtcactaacttatatagggcattggtcttcatgtacacatatgtagctttcagattgctttttttttgagacagtcttgctctgtcacccaggccagagggcagtggtgtgatctcagctcactgcaacctccacctcctgggttcaagggattctcctgcctcagtctcctgagtgactgggattacaggcatggtgccaccacgcccggctaattttttatatttttagtaagagacggggtttcaccatgtgaggctggtctcgaactctgacctcgtgatctgcccgccttggcctcccgaagtgctgagattacaggcgtgagccaccacgcctggcctgctttcagatttcttatgattttttgtaaaagtatgtgctttattacatattttttaaatgtaaatatttatgttttaaagtaaaacctacaggacacattgatttatttagtgaactgtaaagattattctgatatgatagtatcatctattttaagtatacatggaccatctcttaacagttagaaattttatattgtgccttttccgtcttaaattcatatttcttctgttcagttttcccatagaatcttaatatgatatacttttatgtaattgaaaatctttttattatcctatcacactttaatagagatatccttcactgaagataaacttcactgaagcttaacattaagtagaactcctgctactaaagtttatttttttaaaagctgagttgtcattataattattaatgaacacttgatctaaaaagtattattacagatatttataattattaaatttattatgcaaaataatattggaaatttatcttttaaaatgggtgaggctgatggtttccctttttattcatttagttcatctattcattaatctgtattacctgaatgaaactttcagaacaattttactctttcttaaaaattgacacataacaattgtacatatttatggagggaaatttctttttaaacttttttgttagataccagtgctgacaaatcctggttacattctaaatagataaatatggaaatagttttgctatagtattatcatacaattctttttttatttgagacagaatctcactctgtctaccaggctggagtgcagtggggcaatctcggctcactgcagcctcttcctcctaggctcaagcgatcctcccgcctcagcctcccaagtagctgggactacaggtgcctgccaccacgtctgactaatttttgtatttttagtagttttagtggttttgccatgttggccaccaggctggtcttggaactcctgacctcaagtgatccacccaccttggcctcccaaagtgctggaattacaggcataagccactgtgcctggccacagttctttccttttgagttaaatgccaaaaatgacatagtaatcaaacatttaaaaattaaaaataatttgtaatccagtcattaggtactggccttccagattttggataaatatactaaaaaagctttaccaagatttgaatagctagtatacttgttacttttaggtttctttgttttgttttgttttaaccaaatactctcagaagtaattggaaaaactgaaatcttgttaatttctatatgcttttgccaatacagcctttttttattttttatttttattttttttgagacagagtctcctggcccccaggcaggagtgcagtggcgcaatcttggctcactgcaaccttcgccttcccaggttcaagcaattctcttgcctcagcctcctgagtagctgggactacaggcgtatgccaccatgtctggctagtttttgtgtttttaacagagacaaggtttcaccatggtggccaggctggtctcgaactccagacctcaggtgatccgcccaccttggcttcccaaagtgctgggagtacaggtgtgagccaccatgcccagccagattgaggatttaaaagttgattaccatgactaaagctaccatgcttgataatccttcagaagatctttgtgtgtcccagggatatatacatatatctacttggattttgaatagcttacaggtaatgtataggtctgtcaagctaaaggaagaaactgaggcaaaattaatatagttaataagttaatagagtaaaaattaatatagtgagtttatgtgagccacatttgaggactgcaacctgggagcatagatttaggttctcccacatgtatgctttgattagcagcagttatgagtgagttttttaaggaaaaaagaagagactattcctaagttgtttaccaagaatttacattaaaatagctaacaatagatatggattggccatactttgttctttgtatcacaaattcctggaacatgaagataatgaatgagggccacaatgtgcaacttgtgataacttttttttttttttttttgagatggagtctcgctcttgccacccaggctggagtgcagtggcatgatctcagctcactgcaacttctgcctcctgggttcaagccattctcctgcctcagcctcctgagtagctgagattacaggcatgcatcaccacacccggcaaatttttgtatttttagtagagacggggtttcaccatgttggtcaggctggtctcaaactcctaacctgaggtgatccatcagcctcgacctcccaaagtgctgggattacaggtgtgagctgctcggccaacattttaggtaatttatctgctagtcaggaaactaccggcaagaaaaagcacaaaacacctttaaataattgcctttgggcatggatcaggggctatgactgaagtcccttacttatgtctctctgggcctgataaattttgcatatctcacagagctcagactgctctgagctatttttcttttctcaggtccatatggatcattggtttaaactattatagactggtttctccatttgaaaatgagtgtggaattaagagaaatcctttattaaatttagttcacagtgtcttcatatctttccccttctctttcacagaatcttctctttgtctttgggcttctgcagtttcactgtgcttcttttaagggatttatatcttttgttagttaagaaaacattttagtcattatctctgtggattttacctttctacattattatttctagacctcctaatagacataaaaccatcatttaaaaaaaaaaatccgtaacctatattttatgtttaaaagcaaaaaaggaaaaaaaatggctaatggaatgaagaagtatatctctgtaccgtattctgaataatttctttagctctatcttccaatttacttttatctttagctctaagctgctatttaatccatacattggattttttttttttacttttaaaagatttcaatgacatttatcatttatagaactgctgttggttctctttcaaagttgtattttcgatagtgtgtctaattttttactgtttcaattctttgtttttcagaatttaagtgcttttaacatacatatgtctctaacttaatggtttctattaggttctcttattatctgatattcttcggtgctaaacttcctgaatatcagtactttacttaaattacatgatgtgataattttgggtggaagataacattgataattttcacatatttagtattctcaatgaactattcattgatgcagcaaatacatattgagcacagtgttctaagtgttggagcaaaacagactttttttgttcttgtggaacttaaattctaataacttgctatgcttattagttacttaatgattaatgttataaacaggagttgtcacattaaggctctaccctgaagtctattgtctgttagctacagtggtttttacgtttttaaatgcttggaagaaagaatcaaatgaattctatttcatgacatgtgagcataatataaaactcaaatctgtgtccataagtaaagttttcttggaaaacagccatgcttatttataaattgtctatggccacttttgtgctacaacaacagatttgaatatttggacagagttgagtagatacaacagagactatatgatcaagaaagcctacaatacttacttttagcccttggcagaaaaagtttgctgatccctgtatcagtgtttattttgtataaatgtatttcatagattgatatccggaggcccccttaaagactcccagtgaatgactgagaccccagaaaatagtggatatatatcctcggatgaagcattgatgaaaccattccataaacaagtgactgtcacccacactttgattgtgttgccaggacacaggcagatattttttgtttttgtttctgggagcgtgtgggttcttaaacactctggacagtaatacctggctttatcatatgcctgacagcattgctgcatagtaccagagttaagctgtcctttcatgttttatgccctggtgcatttttatgaattagtatgtacttcccttgcctgagcattattcataatctctgaaaaatttaagtgataccatagcagaactttagagacaaccttagtagctactaatagaggagtggttaaattaaaattttttttggaacgcaattgactgttagtaactgataccacagaaagcaaaaccatcgataaagggggactactatgtagtatttttggataagtcctgtgttaaccagtcagaatagcaaactctaggcttgccaataactgtccactttctagaattgtcatgagatttatatgagatgatgtaattcacatagtatatgacactagcagttttctggaaatagctacattttgttattattaaatgcagtgttattgaacctttgtaaactgatgtttctttgcaaataatgtttatagttgcaggtctgacatcagtaaggtccatgtttgtaattggttttctagtcatttgatctcttttcgaacaaatggattcatctattcacagtagttctcttgatgctgtgcttgcattacctggaaaactgtcttaggctggggtagggcggtggatttaaagttttagggacttccagactgaatatatcatcatgattttattaatgggagtactctaatctgtgagataatcagccataaaattttaaaaacttatttacaccttatttcctcccagtaatttgatgtagattaccaaattagcacaaataaaataatggaaaatcaaaacaattaggaggtgagtagatgtgccaggatgctaaaataatttatatgttgtattttaattcaacagttgtctctgaattttctgggaactgaaattgtgtcctgtaattttataattgtatgataaaggaatctttacaaatttattttgctccttttgcctgttatatactgtgatctctctaaagtgattgttactgatatgtttatattattatttgcatctattgaagtataaagtatcaatttctgcctgtacagaaactttgatactaaggcaaaagttcttatacataagcacaagttgaaatgacagccgattgccatatttggctgtagtgttctccagatagcagcaaggcctgataagcaggggaaatgcttactttttactctctggagaaagctatcctaagatcctctaccctaattgtctcaaatatctttggaaagattcacatgaaaagaaagtaatacaataaacctccatgttcctacaaatttgcattgtctttaggaaaaaaaaagtaggcagttgaattattcttaaatccatgccaatgctatccaccatcattcccaatagctgtatgtttttactacttttaaatggttttcaaatagttgttgatagattgtcacattatagcatttttgactcatatttctggatctttttttacagttaaatcgtcgatctgaaattgttgctaatagctctggtgaattcatcttgaagacatatgtaagacgaaacaagtctgaaagttttaaaactttgaaaggcaacccaattggacttaacatgttgagcaacaataagaaattgaggtataggcacttcaccacacattcctacagaaaagataaaggaagagtttgacaccaaaaacttagaagctaataggcccaacctgtaccttttcttctgaatttgtctatagggccaagaggtagcatggtcccagtatgtggattctttgctttgaatcttaggagtaggattgattgcagtgtctcttgtttctgaataaaacattgcaagaaatactttgttagggtgggatatcatgattttgctttcatacatttagtagaatctcagtcataatatttgaagaagcacaatagagtggtgtggtcatgtctcctttaggaaatactaatcaggattgtctcaataggggacttaaaaatttcttattcctcctttttacaatagtgaaccaccattattggtaggattgggtatcagtagcaactcagaaatagggttgaaagtcacttttatttctgctgtctcaatttatacatagacaaatgaagtacataaaagctcagtaactttcaagtcagtggcaaaatcagaaatagtatttaggactcctgatttttattttagtattctgctttattttttaaattttctcaacctccgcctcccgggttcaagtgattctcctgcttcatcctcccgagtagctgggattacaggtgcccaccaccatgcccagctaatttttatatttgttattagagacggggttacagcatgttggctgggctggtctcgatctcctgacctcaggtgatctgctatttttaaatttttctttaattggattggaaacatttgaaagacaaattcaggaaatggaaaactcccaaaagacaattgggtttatccataaattttttgttgttgttggtaaaggtttttgtgtgtttgttcagattttaaaagattttttttataaatgtgtatataatttttccgtgttcaagttattttttgtttcttgaatctgcagtgaaaatacgcaaaatacgtcattatgttctggaactgtagttcatggtagacgttttcatcatgctcatgcacagataccagtagtaaaaacagcagcccaaaggtaagaattctaattgtctttggttagtatatacatggcatcttcttcaataggttttcactttttttaaccatttttttcctttgtgaaaccttactgttttcactgtctgtagagagatatatctctgaaataattcatgacatgaaattatactattttatatctgcttttgagtaatcagattctgtaaatagagaatttttcactaagacctgttgtattgcattataatccagagaatctaagatgatactgaaactgatttacaatattgacctgaaagtgtttgactgagatatcttcagttggtagtttagctctgaagagtaaaattacagttaataccgtactttctttataaggcttataagagttcatagcatcaaaacaagtcacattagttttaaatgttggagaaaatgttattttgtagttgtagttagatttaggagttctcattgatcttgaaagtactgcttgagtcaaaataatgaaagtaacatttagggaaccatttttggaatgttacatgacctttcagttgactgaaattcttaggctacaagagttaaataaataatttgtttattgcattataaacagttccttataactagtaacattttaagatttggcatatattttagatactgttcttcattttttaaaaatgtaatatctagactgctcgtcatttagaagacacgtcctgaaccttgctatatttttctgtttacatagatgggctatcagatcttttacttaaaaatgttaagtaacctcatactttatgataaaccaaccttttgtttttgccttaaatgtattattgtatcaaatagtgttcacctgagatgcttgagaaacttaaaaggacaaattactgtgcagaccaaaaattggcttactctactgcaaagtatacaagctctctggcctacatatggcaaaaacatgagaataaacaataaaaggagagtaattaggggagagaaaaagagtagacacattcttatgccctgatcatactaatagaaaccattgctgataaagctgacttaatattctgataatgtagtctaagtttgaaatactaacttaaaccttataatcaatttaggtgattcatttacaaccaaaattattacattatttttgcttttgaagttgtctgttagtttggaattactagtgacctattttccattcctcatttcctcactggtaatgttaaaaaaaaacaacccgttaatagtctggaaattgggttgcgatttgttttactctaggtctcaacacctataacattttgcatgtgtattattgctcatttacataaaagattagattcagttcatatgaactagtttatactggtaaaatgtttctttaaaaacaacaacctgagttaatttgtatttaagaaataatcctaattgaaaaattcttaatgattaggggcagcaaagaaaactgtataatcaagtcagcaggacagattctacttacatttgtcttttatttattctgtataagaataagcatttcttattccaactgcagtatgactgtcactaaaaagattttgatgttcaaagacaagtcattgagagtttttcggttttcttccttcaaaaacattgaatgattttatgctacataccaggcatagatgaggtgcataaagatgaatatgataaaatctctaccagtaaagctcaagtttgattgcagtagagattgattagggtacagaaagacaagtaaacaaatgattacatgcatggttagggcagcagtagagctatacaaaatacgtgtagtaaaaactacagagaagggaacaagaatttataaaggaaacattaaaggagtttttgagtttaccaggtagaagaagaaactgcatgcagtaggaatcacgtcttcaaaggcacaaagaaaggctttaactaagattgttgcttccagggatttagcacaattgttagacttcaggtgagggtaaacacattggcttttacagcttctcctaaattttcttattttctgaagtcttaattttttttttttttttaattatagagatagggttttgctctgttgcccaggctgtagtgtagtgtctcagtcatagctcactgcagcctcaaacttctggtctcaagcaatccttccacttcagcctcctgagtaactaggactgcaggcatgcaccaccgcaccaggctaactttaaaaaaattttttttgtagagacgtggtctcactttgttacttaggctggtctccagcttcaagcagtcctgcctcagcaccgtaaagtgctggaattacaggcctgagcactgcacctgtctcaagtcttataataatttgaaatgaaaacaaaagccatccatctggtaattcatacatagtgtattcttggggtgagtggtatatcttgtcttttaagtaaatcagtcctgctaaaatctgagtaattcgtagttctttagtaataatatgggaacgagtgctttacacctttttatctaaacagaatggtgaagtttgttaaaataccacattagattaggtagtctttgggtcataattaagattccaatctattttcttaactgctattccaaatgttaaattcatatttaaaagatagattgtttatacactaatagtgatagagaagtatggaaaaaaatgcagaaatttaaaagtctgtagttcataccatccctgcccctaacttcaatctgacttgttgaaacaacacattttatgggttgatgttttacttacactttcacattttttgactttttattaagtatagataaaaagacttataagaaccttataagaaattcttgtaattcttataaggttcttagaagtctttttatcatctttatcttttaagtcttcccccgcaacttagggggatatggatgtctatgaaagcatatataattcataaataggaatatgggctcctagaataagtaatatttaattattagtgaaaagcaccattttgagaggttttttgtgtttgtttgagactgagtctcgctcttctactgcccatgctggagtgcagtggcgtgatctccactcactgcagcctccacctcctaggtttaagcaattctcagcctcctgagtggctgaaattacaggcgtgtgccaccatgcccagctaatatttgtgtgtgtgtgtttttagtagagatgcggtgtcactatgttggtcaggctggtctcgaactctttacctcaaatagtccacccaccttggcctcccaaagtgctgggattacaggcttgtgccaccacacctgtcccattttgagagaatttttgaagttgtaaatgaggtcattgataccagaatttatctattagtctttttcccttttcttttgttttttttttttttaattttaaggccacagttatagtactaattgaaggtaatttttcttttctatattgtatgaaatagtccaacaagaatgtaagttgacatttttacaaagtcctacattactaataatgacttttccccggttttatgttttattttaacatgaaagcaactctagggcaggacttgataaaaacacatattgaaggtacctgtaagaataccatgacttgttaatcagatacattataatgaatgcattttttctcaaggataagaaaaatgagcattgatgtgtctttgtgtgtgtagtgtgtgtgtgtgtgtgtgtgtgtgtgtgtgtgtgtatatatatatatatatatatatatatatatattttttttttttttttttttttttttttaactgttttccttttcctaactcccttggcttattgggaagtattatacctaacccgtttcttctacctctgtttttctacctatttcctttcctctgtacaggtgagtataaaaaacaacagaggccggacatggttgacttagacctgtaatcccagcactttgggagggcaaaataggaggatagcctgagcccaggagttcgagaccagccttaccaacatggcgaaatcttgtctccataaaaaatacaaacattagccaggcatagtggtgcacacttgtagtcccagctgctcaaggtgggagaatcacctgagcctagggagatcaaggctacagtgagctgtggttgtgccactgcactccagcctgggtgacagagccagaccctgtcatctcaaaaacaaaaacaagagagtactaaactgttcttattttttgggcacagcagtatagaattggaagtggctacattaggtattaatgcctaactgttggttttcattttgctttttctggaaatgcagctatataagaaataaatacataggataggacagactagatttaaacttttatgtttatattttgcttcgcttctttaatagggatgtgattatattcccttgtttttctgtcatttatctaacctatgtgttttttagtagcaaagataaaatttcagatatattaatgtacatttataatattcttttccttttgaaaattttttttcaatttgtatatttttaatgtgttcatgtaaaaacaagttactatattttttttcttcatttgctaggattaaattggtattttagttgcatactccacatgataggagtataagaattgatataggaatttggggattttgtaaattatgctttgcttacagttagttccaaatatttcattccttttataataaggataaataatattagacatgaatctcattttattctaaattgagggcttatataatttcattctcgagtaattgatgttaatagctttttggagttttcatgaactatggagaagggtggaacttttatacattggacttgtgataagaagccaagattttaaattataggcttttccttgtgtcccaaatcatataccatatttaatctaagacttttgtgcaaaaatttcagccttaaaaaattttttttcttactccaaaggaaataatcatacctgatattaggatcagtctggaaccagtaaaaattttataacttctaggaaatgctattgtttcttgaagactatttctgtaacaacagtagtctcctccttatttgtggtttgatttaaccattcccttattagtagatactgaagttgtttctgaatttgctatgataacattattgaatttttcagatattgagaattatgtccaggtgagggaagtacatactatttataaaagtacaaaggaggtaccatggcattaaacatgaaaggacaagctaactcttctgctatgtagcaacactctcgggcatataataaaaccaggtgtagtatacagagcaaaaaacccatgtgctcacaaaaacatttgctcgtcttctggcaatgtaatcagaaagtgtggttgacacccattttatttatgaaatgtttttaccaatgcttcattttggtatattggattcggtactatcatcagtttcaggcacccattgggggtcttggaaaggatcgttagagaatagcagggaatattgtattctaacatatcttcaagtatttgatagttaaagcccttttaagatttttttatatttttgtgtattcatcttcctgtttgtttattttgtatattgacagaaatcgaaaaacaatttagacatgactcaaaacatagtatattatatatatataatgtatttaaaacaagttgatcacagtataattttgccttaatgactatagttactgcaactacagtgatatatcaacaatgaggtcttgcctcttatattttttttctttttcatgttttaagcagtctggaccgaaaagaaaggtaagcttaatattgaagaaattagagcatggatatagtggtaaaatataaaattatttatatgttttgaaaaatattggttgaattagagtttataattaaagctttttttaattttaaagttttagttgacatgtaataattgtacatatttataggatacagagtaatatatcaatacaggtatacaatgtgtatgatcagatcagggtaattagtatatccatcacctcaaacattttttgttcctttgtgttgtcagcattcaaagtccctttttctggctttttgaaaacataaaataaattatagttaaccatattcaccctatagtgccacagaaagtgagaactcattcttcctgtctagctgtaattttgtatttgtgaacccacctccctccatcctctcctcccctacccttcccagcctacagtatccacagttctactctctataataaaaggaaacttgttgacagtacaacatggtatttggcttatataggtggtatttgaggctcattctgaatgtacatttttctataatggttatatatatttatgctaataagtgactcctttcttttaaaatagaatatttcagtgctttagtagtaaaattgctttcagttacatcatcaaaatctttatcattatattttagtgataatacccttgtttttatgctttaatagactgggggagggagagggaaatgtattaaacaccttaagcttagagttaaaactttaaacatcaagtgtattctcttctgactgaaaggtttgtaagagaattttgtgatcagtcttctatcattatttgttctctttgtaagaacactggcagacacatgttgttcttttagaggatatttgaatggtataaatggcatggaaaagtgtttaagaaaacacacacatttctttgaacatttcaaagtaaaatgatcataattgttctaaagtgggtatccataagagtagctggactgggcaaggtggctcacacctataatcttagtactttgggagggcaaagcgggagtatctcttgagcccaggagttccagactagccttggcaacataggaaggccctgtctctacaaaaaaataaaataattggcctggagtaggtagtaagacagtaaacaaactggaaagtccagctatttttaatttccaaccaaactgttgaatcaattaaaaaaaaaaacgagtctatagtgcctttcaaatgcctgaattttgacatttgtacatcagctgatggattaatattttgaattgctatgtgatggctctgcatgggcatggtggccagtgcttcagttttgacagcattaccatccttggtgatgacatggacagcaatgtttctacaattgtttgaaatggtaaatatatttttgattacatgctgccttttaggcatacgcttttattcattccaagtatttatcgaacctgctgttacaggatacagtgcatcctgcataaggatacagtgatgaacaaagcagacaagatccccgcagtcctgtagtttacattcttatgggacaaagactaatactgaacaagtaaaacatgaaataataatttccatgtagagaagtgtaatgggttgatgtgatagactgacagtatgatttctttaaatcgcatattcagggaaactctttactatgaagctaacatttaactaaagactaaatggggaattggcagtgccacgatcataagaatggcttttccagatagggaagaggttgtgctaagttactaatccaggaatgagtttggcatgtcaaagaacagaaaaaaggggccactaaggctggagcttagagaggaaaggagacaatgttatgagacgggtttggagagactggctgggacctacgtcataaaaggtttttgtaaggtgatctgaagcatttggattttatattagtgcgatagaagctttcagagcatttgagatagggaagtattgttacctgataaatatttgagatttttaaacacagtcttttgcatgtgatttataatttggcataaatagaagtttaaatcagtggcaatcagttaaggctgggcaagttcctctctaaatggaggtgtgttacaaaggaaaatcagtaatagtctgtaagtactcaaaactatctcagcaaggtctaggagttggggaggtagaaagacagaggtaaaaccaatctttttggtgggggaggtggggattggaagggttaaggtggaaaaataaaaagattttgaaggtctcatcccattagggatataatataatttgcttgaggaaatcatttgaatcttggtaactgtaataagcattgagagggaaggtaactatattcatttgttaaattcagtaaggaagcaaaagagtatgttgtgcaaacagtgttgtataaaaataggagaaaagaggaaacaaaatgaaataataaacataaatagaaatataaaaagtaatagagtaaaatgaaaacaagtcctatcagtagttataataactgtagtcagtatatttaacaaaagacatgctgatttgattaaacccagctatactacattgtttacaagcatcatactaaaataacaatgtgaaagtaagtttaaagccacaagagatgcaaacaaaaagaaagcatgagtggaattttaattacaagggagatggagttaaggattaaaagcagtagacaggataaaggagcacattttgtaataggcacagtttatgggaacataacaaataaatgtaaagcctcccctaaaatagttaaaattcaagaaattcaacatggtaaaaccccgcctctattaaaaatacaaaaattagccgggtgtgatggcatgcgcctgtaatcccagctactcgggaggttgagacatgagaattgcttgaacctgggaggcgaaggttgcagtaagccaagatagtgccactgcactccagcctgggtgacagcaaggcgccatctcaaaaaaatgaaaacaatagaatacaattgtgggagactttaatacatcttgaaaattaaactggtttatcagttaaataggaataatgaattttaactgtaaaataaataagacttgattcattttcatagaaatgtatgtatttggccatcttttataataatggaaaaattaataaaaagagctatcattaaagcaaggcaaacaacaataacaaaaagagaaatggtgtccagatcctggtttctaaataccactctccactaaaaggaatttggagaaatggctgattctggggttgtgataggtaagacacagaatgagtatggtatcagaaacctagaaaatgttcaaaaaattaagagtgcccacttcaaaagcacctgtactaaaattggaacaatagagagatgattagcatggatgacacacgaattagtaaagcatttcatattcttgtaaactgtgtatgttttatcacagtaaaaaagaaaaaaaaaacaccaaaaggatgtagttacatcaaagggaaacgggagccaactaaaagggctcccaaatgcccaaactgataacaattggattataacttagaccgagggacactctatgaaatacctgacgagttctctctaaatactgaaaaacacaagagaggagactaaggagacatgatgacttaatgcattgtatcctagattggatcctggaacaaaaatggggtattagtaaatagctggtaaatttctttctttcttttttttttttttgttttctttttctttgagacagtctggctctgtcgcctaggctagagggcaatggtgcaaccttggctcactgcaacctctgcctctcaggttcaagcaattcttgtgcctcagcctcctgagtagctgggattacaggcatgtaccaccatgcctggctgatttttgtatttttagtagagacggtgtttcgccatgttggccagtctggccgcgaactcctggcctcaagtgatctgacggccttggcctcccaaagtgttgggattacaggcatgagccaccttgcccagccggtaaatttctaaggctagaatttagttcgtaatagtgtaccagtgttggtttcttttttgacgtgtgatggcaatattaaggtgttgacattagggtaagagatataagggtattctgaattgtcttcgtaacttttctgcaaatctaaaattatttcaaacttagtttactacaaaaaatagactttcaccactgaggcttatcgaacttttaatgaacagagcattctgatgttatttaaacaattcaggatagagaaataaatgctctctagttcattttaaacagcttgtaaaaatcttgggtttatgaaatgggacctctgaagctacacaaacgcaaaccctaagaagcaaaaatgctacccacctacacaggaagacagcagatgacagtagagcttctctgcctctggttggttaggggtagaaaagaaatagccactttgagattaaatcctaggcttgattttcaatgagtttggaatttgaaatttatacctgcaagagtaatggaatcctcaaattaagaaattaatgtaaatgctggccaggtgtggtggtttatgcctgtaatctcagcactttgggaggccgaggcaggcagatcacttgaggccaggagttcgaggccagcctggctgacatggtgaaacaccatctctactaaaaataacaaaaattagcacagcatggtggcgcacacgtgtaatcccagctactcaggaggctgaggcatgggaatcacttgaacccgggaggcagaggttgcagtgagccaagattgcgcacgctactgttctccagcctggtgacagagccagactctgtctcaaagaaagaaagaaattaatgtaaattttcattttagatcatctagcaaaaaggttttaaaactgaattttggagaaaataatatatggctaggtagtttatcaaacatttttatcttgaaatgtttatattcttgtatttaagatactctgtttctttattataatttttaaaaaacagaactttaatttgccctgcttttataggaaaaaatatagcaaatattgaaaacagtggccataaattctggaaatacagggaagtatacacattagtttaatgttacaatacttggtaagattgtagctatcatatgatgtattcagcatgttgtccctcattagcaaagatggctcagtacacaagttcaaattgcaagagcactgcattaatataacagtttcatcaatctctatacatgcatgtatgatttactgtctcagatgatttatgtcaattgtttttactaaatctaggtaaacctggatttggaaataagactatattatattctctttagtgtgaaagtgtatggaatttgaaaatatgcattttattttaatcccaagttaggaactaaaaacctaccttctttcttataagactgttactactacatctcaggcaaattctcattttcataatgcatatcttcacaaatttcaaatttttcagtgtggaaattgcccagttttaccagatgttgctctgcttgatattggtgcaatttgctgggattcagattctggcattgctatttaataattgtgtgaccatggacaagttgattaaccttattgcatttcaattttttcatgtataaagtattaatatgttatataagtttattgtgaggattaaaggaattaataaatacaaagcacacatggcacatgatgctattttctgactgctattataagtacactactgtcagccgggcgcggtggctcacgcctgtaatcccagcactttgggaggctgagacaggcagatcacgaggtcaggagatcaagaccatcctggctaacacagtgaaagcccatctctactaaaaatacaaaaaattagctgggcgtggtggtgggcgcctgtagtcctagctactcgggaggctgaggcaggagaatggcatgaacctgggaggcggagcttgcagtgagccgaggtcatgccactgcactccagcctgggcgacagagcgagactccgtctcaaaaaaaaaaaaaaaagtaagtacactactatctccacccatattactttttcttttgttattttcatattttgttttcagttcaagtgccttgactttttgtaatataagaatttgaaattcttgcaagaaaatttctttggaacttttgtttgagtaaaatgattttaatgaaatgaaagctatgatttacattactagatcaccagtgtgaatagaattacaaataaatagcctcttttatttttatgtggtttatttagagtaggaaagtagctattgtagctccctggtctgttgcactttttgcagttccccttctgtgatgcgcttttatacaattagctataaggtttttgctttttttccccccaaattttgcttttttcccccaaaattagtgttgtgtttaaatagatacagtatttggatgtagtatttagatatagtacttagttactaaggattatgtttaaaatccttgatattgtgtgtatttgaagtttaagagaggaatttaatactttacaacaaacatactttatagcccctgacataatgtaatcatactacaagactaaatacttgttccacgattgctgatcttgtacgtaacgttttttgttctgattttggaattgtcctcaagacaatctcattcaacatttattcctttatttattaatttgtttttaaacaactaaaaaatacagtaaaattttacaaattgagtttcatttattggtatagttttgttattttatagtatcactttttatatggcaaagaagctatgatttgcttttaataggcttattgtaagtatgccattaactttttcattttgaaaactgtatttcctgttagaataaaactacataaatttcttttttaggaaagaatacccacctcatgtccaaaaagttgaaattaatcctgtaaggttaagtcggctccaaggtgttggtaagtgtgcagttttgttacacctgtgaaggatttcaaattgctgtatgaaaagtacaatggagatacgatgctggctttagaatattcccaggtataatagatatatatgtagaaaaccatttttttgtaactgatttgagaatttcttcaatggtaacctgatacctggaacagttgcacagttaggtgattacagtttgaaatcttttgattattttagcatttttgctatgttacaaatttgcaaatagtgtaactgtagttgagctatagctttgaaattgagttttattgaactatgttataatgtattatgtaattgtgtttccacttactggttttgcttctaaaatttagaatacattagggaaacactcaattaaaaagagaccacacctgctaaaactgtgttaatagtagatactggaaaatcatggtgagtaagtatttatattcatattgaaatatttttcaatatactggttattaatccaaaaaataaaataagggcaaataacatttataaaaaatatatcatcataaaatcagttttcattatctggaataatgattcttaatgtgtgtccatcttgtttttctgaggcctttgtttgtttaaatagctctgatggctcttacttccaaaatagaataatttttaaaagctaggtttttctgatagcttagaatgtgcttttaaaaaacacccacatttttttttctactttgggtgaaaatcttttgtgcatgtattgaacatttctctatttcataaagagaatattccaaacatttcatcctttcttaataatgaacagtctttatagatgtgaattattatactttacatactaagcatagttaagcttactaagtttattaagtttagtaatagtgactactctcttcagcatttattctgttataccttaaatgtttattgagctcttactctgctatatgcttagtccagtgctttgcattcattatttacttttatcctagctttctgttgaagatccctataagctaaaaaacttcctcaaggacatagggctagtaaatgacagagctggtattggaacccatgtctgtttgatgccaaatcccactcttaaacactgtacattactatattcttgctctgtcacaaagaaggttactactaatcctcagaactgtacaaaaggtattatttttattttaacaaatgcatttctggcctggtatggtggctcacacctataatcccagcactttacgatgtcgatgcaggcaatcacctgaggtcaggaattcgagaccagcctggccaacatggcaaaaccccatcgctactggaaaaaaaaaaaatacaaaaattagctgggcatgatggcacatacctataatcccagctactcggaaggctgagacacaagaatcgcttgaacccaggaggcagaggttgcagtgagccgagatcgcatcactacgctccagcctgggtgacagagtgagacttggtctcaaaagtgaaaaaaaaagcatttcaaagatgttaagtgatttggcccactaataatggttttagatgcctatcagccaggcttgttaccaataatttttaaagtttattcaacagcattcattaagtaaataagcatattcaagttaagagaaaaaagagcatgcttatttactgttcttttaacttgggttttgtttgtttgtttgttgttgttgttttttgagatggggtctcactctgtagcccaggctggaaggcagtggtgtgatctcagctcattgcaacctccgcctcccgggttcaaataattctctgcctcagcctcccgagtagctgggattacaggcgcctgccaccaagcccagctaatttttgtattgttaatagagacgaagtttcaccatgttggccagactggtctcaaactcctgacctcgtgatccacccacctcggcctcccaaagtgctgggattacacgcgtcagccaccgcgcctggcccttaacctattattttgaaataattttagacttagagaaaatttgcaaatttaatacagagacatacgtttattttttcacacagcttcccttaatgttagtattttataatcctcgtacacttagcaaaactaagaaattggtataagattcttaactaagctgtagaacttatttagatttcactagcttttcactaatatcctttttctgttccacgattcattctgtgatcccacatagcatttgtcatgttctcttagtttccttaacgattttgaagactagtcagttgctttgtataatgcctctcaatttggtgatgatgatgtcttaggattagattaaggctatgcatttggggcaagacttccacagaaatgatgttgtggcattctcagtgcatcattttaggggttacatgatgttgaatatgtcttaggattggtagtgttaaccatgatcatttggttaagatactctctgctgggttttttcactgtaaaattaccgtttttcccttggtgcttaataaagattttagaagagatatactctgaaactgtgcaaataccctgtttttcttcaaactttcacccactgattttagcatccattggtgggtcttgctggcatcagttactgcttaatgtttgtctaatgttgattttctgttttcttcatttcttttacatttattgattggaaatcgtctgtagggaagatctgtaccttcctgatatatttattgatgattattaattatttatagctgtggactcattattaataaatgagggttttatgagtaatacttgtaaaccttaggagaggaatgttgatgtatttaacttgtaaactttgttttcagcttcttttgtgttaggtaggtacatgtatgcttgggtgtaggataaatagcaatgctataataatactgtatatattgttatatgaagattgcattttatttcaagatttcctttggagataacttttaaaacattgagatttcaaaccacaagatcactaattacttgcataacacttagcataattttctcctaaacgatatcatggtctttctatagttaacactcaaggtgattttctttattgttctctttgccttctttattttgaatttgaggcacttagtatatttttttataagttatagccacatatcagtacttaccagcatgataagcagttctttactataaaattaaagtttgtaaaccattaagtgtaatttttggtcagaccacaagtcctgttgcttttttatttagttgctttaaaaattttttctaaacatacagaataacaaccgttaagatctcatttttctctccacctactctctcatttgtttcttaaactcccttttttttcagcctgttttttgtatccttgttagagagaacagacatatattgtccctgaatgtacatttaattatattcttcatgtaattacattatgtaattacaactcaatcacctaatttagcactgcttaacacatgttaacttttgctttttgttcgtttttgagacagggtcttgctctattacccaggcttggagtacagtgacatgattatggctcactgcagcctcgacctcctaggcttacatcattctcccacctccaccaagtagctgggactgcaggcgcatgctgccacatccagctaattttttgtattttttatagagataaggtttcaccgtgttgcccagtttgctgtcaggcttctgggctccagcgatctgctcgcctcagcctcccaaagtgctgggattacaggtttgggccactgctctggccacatattaactttcaaccagtcatggtagctgttgttaatattttaatatataactctccagatcttttctatgcacatatactcatttttaaattgatacataatattcatactgtatgtactgttctgtatgtaacttgctttctgactttatgatatctagtttttacactctcattaaaagatgacagacatggaaccagcatggaaaacacaattaaaggaagtttaagaatcaaatgcaccagctatggtagttcacacctgtaatcccagcatttggggaggccaaggcaggaggatcgcttgagcccaggagtttgagaccagcctgggcaacatggtgaaaccctaactctccaaaaaaatataaaaattagccgggtatagtggcgtgtgcctgtagtcccatctgcttgggaggctgaggcaggaggatcacttgagcccagcaggtcaagattgcagtgagccacaatcgcgccactgtcctccaacctgggcaacagagtgagaccatatctcagaaaaataaaaagaatcaaatggattcttaaatttatggaggacttccttacaacttttttttgacctcgtgatccgcctgcctcagcctcccaaagtgctgggattacaggcatgagccaccacgcccagctgcaaatttttatatccaagtttctataatctttttttttaaataaatgtgcagtggcccactatgtttatgtggcataatttgttttcaatgttttgacatttaaaatattattactgtactggtacgtgctttttatatatttgatctatttctttgcatcagatccctagaaataaaatttgggggacaaatgatatacagatttttaagacttgatacgttaatgccaaaatgccttgtgtggccaggcgcggtggctcacgcctgtaatcctggcactttgggaggccgaggcaggtggatcgcttgaggtcaggagtttgaaaccagtctggccaacatggtgaaatcccatctctactaaaaatctcaaaaaaaaaaaaaaaaaaaagaaaaagaaaaaaaatgccttgtgtaaagatggttagctcccaacacagtattatttgagttggcctattttctcctgcttttcagcaacattagattattatcattcttttagtttttgccagtctgatcaaaatgtttttcttatattttcttcataactggtgagatatcttacttacatgattaatggccatttgaatttattttatttatgtctgcccatttatttatgtgtcctttgcctgtttcttacttatttagcaactctttgttatctttgatgtatatatctttccattttgtggtttttctgttacttttttcttttcttttttttcttttttgacggagtttcgctcttgttgcccaagctggtgtgcaatggcgcaatctcagctcaccgcaacctccacctcccgggttcaagcgattttcctgcctcaccctcccgaatagctgggattacaggcctgggccagtctgcctggctaattttgtattttttagaggaggcagggtttctccatgttggtcagtctggtctcgaactcccaacctgaggtgatccccccgcctcggcctcccaaagtggcgggattacaggcatgagccactgtgcctggccttacttttttctaatgttgtcaaatagtacattgtagttgaatctgttgttaaagttgggtttccttagtattgtatttagtaaagcttttccaaccctgggattttaaaaatattcacctttattttccaaaagtccttgtagatttatttttatttatttacatgtttttacatgtacatcatttttatttaacagcattattttattaattaaccttgttttccctcaatgcgtttgggtgaatgtcaggaatgcctactgaagtatttaataaattgctctaggaatcaatttcaacattttttctcatgtttttggaatgttgtgtttttttttttttaactagtttattttgcaaatatatttgtaagttttccactgatatcttaaagttaggtatgattattaattcaagctggccttgtgcccctataaaatgacagtgtctgttcttgggaaactccacggctagatagactacaaacttgtaaacatactgttgtagagtcagaaagtagtatgtaaaagccaatttaaaatgtggtatcataaaggagtggtcactgcccttttctggagttttaattaaatcttcacacacaaagatgaggccaagcatggtggctcacacctgtaatcccagcactttgggaggccagggtgggaggatcacttgagcccaggcattcaagaccagactggccagcatagtgagaccctgtctctataaaataaaaaaaaattagccaggtgtggttatgagcacctgtagtcccagctactcaagaggcagaggtgaggggatcatttgagcccgtcaggtgaaggctgcagtgagcacaggttgaggcactgtgatcacgcctctgcactccagcctgggctacagagtgagaccctatctcaaaaacaaagcaaaacataagtaaagctgagttttgaatcactggaatttgacataccaagtcgaggaggaaaagctttgcacctaatgaggatggaatgcaaaggcacaacaggtgaaagagtctcatcttatttgaacaaataatgtatttgattggagaatgggtagaggatagccagagttgaagccatagaagtaggtagaggtagattgtcatgctaaagagtttttacaaaatcctgtatgccaaaagtatagtatttagccagaagtgatttttaaagaagataatgagaatgtgatagatacatgactttagttttattttacactgaaaatcagtagcagctacatgatggagaaaaccatttttctagtttgtctttctcttttgaaaaattataaaaaataatgtaaaagcaaatacataatcattataaagataacagtttgtattctatcactgtcgtctgggtacttatttttcagcgtattagtagtatcacaactaaaatctcaaataagaaagttaagcctcttccttaccctgcttctcccacaacttctattatgaaaatgtttatgcagaaaagttgagacttctacagtgaacatgtgtatatctatgtggtagatagatataattaacacttttctgttcttgttttatgacatgtccatctagtcatcccttactacgttaattcatcttattttttgatgcattttaaagtcgattgtagacgcctggtatacttctaaacacttcagtgggcatattattaactagagttcaatatttgtttacagtttattttcttttgagggcttgtttggaggttctagcaggggagcacagctacttgtatacccttgaaccaagatcggtcctcctctattggggatggtcgtcctctttcacccagtgtgcagctttggaagggatgcgcatggagcgatgagggaggaagtggacacccacctagccagccagatcagcccagttacccctggcgatcaatggggtgacagatgtcgcagccagatcaccctcacattctttcttttgaaataaaatttactacaatgaaatacataaatcttaagtatataaaatttgaaaactacatatccctttctaaccaaaatccccatgaagacatagtagaaatggtatcagcaccttaggaaagttccctcatgttctttcacagttagtccctacctcttccccctcaaatgtaaccattgttctgatttttcctagcatagattaattttacctgttctaggacttcatgtaaatggagtaatgcactatatactcttatgtgaggcttctttcattcaggatcttattttgagactcatccatcctggtgcttgcatcaatagtttgtttctttttaacattgcattgtatgagtataacaagttatttatcgattttcctgataatcgataatataaataatcgataaacaacacctgggttgtttccagtttttgtctattaagaataaagctgctatgaacattctttttatgaaggatctttttttaacttgattttttaaatgtcttctatttatatcgaacctgtatatagatcactcttacccagtaatatcttccatagtctccccttttgtgcatacctggaaatagtgtagtgtatttaaaaagacattgagctaggctgggcgtggtggttcatgcctgtaatcccagcacttaggccgaggtgggtggatcacctgaagccaggagttcgagaccagcctggccaacgtggcgaaaccctgtctctactaaaaatacaaaaactagccaggcatggtgacgcatgcctgtaatcccagctactcaggaggcagaggcaggagaattgcttgaacctgggaggcagaggttgagtgagccgagattgcgccactgcactccagcctgggcgacagagcaagactccgtctcaaaaaaaaaaaaaaaaagaatacacattgagctacaaaatctagtagggagtatcctaatcttcatgttcctaccgcagggtctttggtaaatactctttattctctttctcatccctgtaagagggattcagcataatgtcacatggtttttgtcttaagtacttctctggagtaatctgttgaggatttgaggctacatcagcctagcaaaaatcacttctgtgatcagttagctagtaaaacttccacaggccacttactaagtatttgccatccttgaaccagtccaatcttaagctttttgccattttatgtttctgctgtaattttagactagttcatttttacttgagttaccaaatcttctcaagtgtttttctcttctttccctagaaaatggaatcctaatggaatttcttaaccctgaggctaacatttttgtgtttttttcttaactctctatagatctagtttcctataacactatcaatcatttaccatttctcctcatgacattggtttcaaaagtctcagcttaactttcttaattatgtcattccttcctttttctctttctttcagagccttataaataaccttgatttaggtagggatcagaattttaatgtcatttttctctacctattatcaattaaaattttgaattatatcaaagctttggacatttgtttccctctttgttatgatggtagagaaaatgtgacatagacatgatgttataggtatggtgaagagaagagtgtgattacataatcaggatgaaatgatattgtttttttaaatgtcagtctccaggatgcagcagaaaactaattagatacatgtttgagcaaaataatgtgcaaagatactgtgtggcttaaaaagattaatgaagtatgtttataaggaaaaagctttcctttgggtacattatcaaatttagtaaggccaaaaaagcttgtaggggcttatgttttaagactgctttactgtaaattaagtttttcaaataattggttgtgtgtttcagacaactgtgtttattttccgaattccaaaatgtctgccttctttttatagtgtcacatcatagctcttcaacaaagtaacttagccttcataaaaataatacctggatgctctggactggagcagctgctctgtaacctcagattttagatctcgggagaaaaaaagcactttttagttactctctggccagaggctaagtccttaattgttctatatctgtgtatgaatcattatctctgtgtcacaaaggtaatgccattttcagagatgacatagtgacaatgtctcttcctccgacccctgtaatttcatttttttatgtgtcatatagttttatgtttctcatgtaattcattaatccaggaaacatttattaagcccttgtgtagtttctagatgctgggaaaacacatgactaaaacgtaatttctgctcttcccagagctggcaatacaatgggggaacagaagtacaaataacaataaaatgagagctgtgaaaactctagggattaattgtgcctagagtggggcagaggcagcttcttaacaaagaagagtttgaattcaccacataggcagagcttcacttgtgaaaagaacagcatatgtgagggtaaaagagagaacacatgaagaaatgaacctttttgaggtaaagtttaagtggaagtaagattgaaacaggaacttctgcttgccaaaagatggaatttaattagagtattagaatgacaaagtcatgatttttaactagatcactttttcagtagtggggaaggatttaaggggagcaaaattgggatagaggacatcagtttaggcaagagttaagcgtcagaaatgtagtggcagtgggtttggagaagacagagtgaacttaagagctatttagaagtaaagatgaagggacaaggagtagtcatcgattatttaaatttctagctttggtgtctaggaaaatagacgtgcaaacaatgagagggtgatgatcacttagtgaaactttgtgattgcactaagcaagaataattataggtttcttaagatggtgttgtatatcaaattaaatattatataatattgatttttatgtctacataatcttatttttaaaaaccaaatgataaaagaatattaaatataggaaactagaagtatttaacaaagctgtgtttgtgcaggttattttggtttacagattcttcacttatgttttagaaacatgtttggcctcttggatacttaatcctttgctgataaagtcagattatggtaaattttaaattggcctgttttggagttcatcaaatcatttaaacattataattatatttgtaatgaaaattattaaatttacataaaaaatatcgagaaaaattctcttgcgtgttccaaagttagaaaattagcttgtggcaggcttagtttagtttcgtttacccaaacaattgtactgtttgaattcagatttttctcattactactcttagagtaagtgacttggaaaaaaagaaggaaaccagcctgggcaacatagggagaccctgtctctacaaataataaaaaaattagctgagtgtggtggcacgtacctgtagtcacagctagtttggaggctgaggtgagaagatcacttgagctaaggtgtttgagattagagtgagctatgagcatgccactgaactccggcctaggtgacagaatgagaccttgtctccccaaaaaaaaaaaaaaaaaaaaaaaaaaggggaattgtgagtatgtgagtggttaggcacaggaagggcttctgttaccttagtagaacaaaataaagtgaagaggatattgatacacttgatgaagtggtccatatgtggagatcctgctgaggagtgaaaaataaataagagaagagtaatccaggatataattattggtttagtcttatgttctgattatttttttgctgaaacactagcttattttaactaaaacttaaagtttatttttttctccttcctttagaacgtataatgaagaaaacagaagagtccgaatcacaagtggagcctgaaattaagaggaaagtacaacagaaacggcactgtagtacctatcagcctactcctcctctatctcctgcttcaaaaaaatgtttaacccatttagaggtaagtagagaaattattctttgttgctaatcagattgtgttttgattaatattagtttcagtacttattaaattctaggtgatcttttatcataggaccagaagagacttggaaaacttatttaggcagctttttctgccttcagtagaccatttttatgcttgttcaaaatatagaatttatttttctgtaaagaatttatcagtgcttccctgcaacatacttcaaatgattgctctctgccagaatttttttcaaataattttaagaagccaaaaagttacaaaaaatagtagaagaaaatctatatatttatctcccagattccttgttgttcacatttgctttattgtcctcactctctatgcctttttccctccttcctcctgcctacccataaacgtgtgtatatgtatttttttgtactatttgagttgaagttgcaagcatgatgcccatttaccatttaatatttaagtatgtgtgtttttggttttttataatcagaatacatctgtcaaaatctcaaagttaacattgatctaaaattaccatttaatccacaagtcccattcaaatttcagctaaataatgtcctttatgcttatagaattgaattcagggtcatgtgctgcattgaattgctgcgaatctttagtctctttcaatagaaataatttcacagtcttatctttttcataatcttggcatttgttgaggagtataggacacttactttgtgcctcaaattgggtttgtctgatgtttgtaaatgatgtgtgtagttttcaagaatgcttcagaaatgatgctgtaatcttactgcattacatcaggagacatacgatgttgattttcacattaatgatattttaccttagttaagatgttctagatttcttcactgcaatgtcagttaataggtatttgactaattcattaataagatttctaacatgagctagaagtatttcttattccatatttatatattcatttatatcagcatgtacatatgaatactttacttaaaagggttatagtctgtaactttcatgatgtttcatgacttaccttgatgcttcaattgtcccagattccatgtgagtcccttcaagctggcctctgttttttctgacatgtccctatcattctttgaagacattcatgacattcacttctctgctttttagtataacaagatggtcttaacttatcttgtatttctttttttttttccccgagatggagtcttgctctgtcacccaggctggagttgagtggagcgatctcggctcactgtagcctccacctcccggttcaagcagttcttctgtctcagcctcctgagtatctgggactacaggcatctgccaccatacccggcttatttttgtattttagtagagatggcgtttcaccatgttggccaggctggtcttgaactcctgacctcacgtggtccacccacctcagccttccaaagtgctgggattacaggcgtgagccaccgcgcctggccattattttgtatttctgtctcagccctagagtcattcatttctctgaggagccatgcatacaaggagaaggaaatatcttctcctttaagtggagggaacatatttgggcactagttatgttcattcacatgggtattattgtttctcggccttctcagtggacaaagctaagaaatacatgtgtgtgtattaatatttaatctatattagaatccataagttcacactgataactctaattccagtccaacactgagtttatttaatttttcccacgttgcatgtttgtaactcccttctccagaggtaagtaacttgactcccatcacccctggtgtatttacctgttagcttagtttttctttatgtgataatgtcctgccatgccaacctaagtttggctcaggccatgctgatatcacctactgcttagcctaggtaaaggaggaggaaagctcctccctaaatacaacatcttttgtccactggacatgcccactgaaaacctctgtttgtttgtttttaaagttcaggggtacatgtacaggatgtgcaggtttgttacataggtaaacgtgtgccgtggtggttgctgcacagatcatcacatcacctaggtattaaacacagcaataattgttttttaatagaagtcttccttcttttactctattcctatgccaattgttcttactttcttcttagtggagataaagaattgtagccagcctctatgtaaactttaattcctagacaaggttagtggttttttctttccatgtatagtctctgaaattctacactatgtaccacttgtaagaaaacaagatctgtgggccgggcacagtggctcatgcctgtaatcccagcactttggcaggccgaggcaggtggtggatcacctgaggtcaggagtttgaaaccagtctggccaatatggtgaaatcccgtctctactaaaaaaacaaaaattagctgagcatggtggtgggcacctgtagtcccagctacttgggaggccgaggcgggagaatctgttgaaccctggaggcagaggttgcagtgagccaagattgcgccattgcactccagcctgggcaacaagagtgaatctccttctcaaaataaataaataaataaataaataaaacaagatctgtgaatttaatgggattaacatctttaggatatttagtaaaaatgacatagtctcaaagacagacttattaagtgcagttggttatttatgggtagagtcttgcagatagtatgtgatatgtaatttggaattatttaattttgtaaaacgccttccacttctactgaccaaagcagggaatgagattttaatcagttttttttttctcttcaattttttttgtttggagagattggatgtcgctatgttgcccaggctggtcttgaactcttggccctaaagagtcctactgcgtcagcctcccaatgtgttgggcttacagacctgagccaccatgtccaggtttagtcagtttttgttttccaaaagaaactacacttaacataaaatttttatgaaaatttatttacagtattctctactaaaacagagcagtattgagattctagtttttagagagttaggttaataaaatgttaatctctagtttttatcatgaaaattttttttatcttattcagcatagtgtatctgcattttgttcgtaattctcacagagttccaagataaatgtttcttagctgatggaaggcatatggtaatagctcagaacatacttctgttcatattttaatattggggattttaatagtaggaatgtgttttttctgttttagtatcaattttatgagaggaaacagcacttttccatggaattcttttcatttagatttgccctctttacctttattatagatactaaagtaatggagccagtcagtactcagcttgatcatatcctcagattcttggagacagaattattttatatatagctgactgctagactagatagtcttgaaaatttcttccagcattttgatattaaatcccgactaacattacttatttaggctctcatggtagccatgatggtaatgatggggaagagagggacttaattttgagactttgaggggattccttaatgatgcagtaaaatgccaaaatcttttatttcttttgttcttttggaacttaaagtttatgaacaccgtgaatgttcaaaatgtggaaaggaaaaagaaaatcagaccaaatgccaaagttgtggtgttcttttttctaaggatttgcaaagaaattgcagacaagctattactttgaatgagtctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaagtaagtattttactccctttaatattgcttatatcaatccagtatttttcagatatatttttacaaccactctccccaaccccatatatatttttaatataaatgtgagcttaaaactaatcttgttctcatcctgtccatcttaaatagttaaaaaaaacaaaaaaaagaaccacagaacttgaccctagtcttagatgaagtgctagttataaccagcattctgacttcggccaggttaatttaatctttctgatctgtaaatgggtagatttcctgctgatagtggtttttttttttgtgggggggggggtgcctaaaataacataaaatatgcatagcccaataaaatatttgacatacaatatccttaccacatttgttcctaactctatatcctgtctttttactcttatgtgtatgtgtatggcatgcagtccttgtttataataaatagcaaaagattagaaattattggggactggttgactagagtatacagcgtgtatactctaaaggagtgaaagatctgataaactgtgtaatttccaagatccttaattaagtgaataatgcaagctacagataagagtgtatactgtggagaatgaacataatttcttctaaaaaatagaaattgggcacagtggtgtcccaactactcaggagactgagatgagagaattgcttgagtccaggagttgaagtgtagccagggcaatatagtaggaccctgttgctaaaaaaaaaaaacaataataataattataaacagaacactaggctttccttttaatatatacttgtgtagtttttcattaaaaatatagttcatgggcctttttaaaaaatctatatacatgtacacacatacgtctgtatgtatatatatatacatctatatatgtcaggtactgtgctaagcattttacataccatttgttcttgcaacgattctgtgaaatagatacccttattgtccctaattctacagagaagagaaattgagccaaataaccagtaagtggcaaaaccccacctctcaaatgctatatatgtaaatctgtttagatcgtctaatctggcctgttaggttttctgctaataaaagaccagtgttgaaagagaaaccatgctcaatatttgttcctgagactggacagtaaaattaaaaagacaggtagagaaatactgagatgatacttctctgggacatgtacattactcagtaaaaattaagcatttatgtttgaaatactaataaagtcaacgcatgacttttgaatgctttttctgtgtcaggctgtttcaggcctggggatatagcagtgaataagacactgtccctgttctcttatagtttatgtgtagcagggagaaacagataaacaagtgaacatccgcaacaaggaacaacagaaaatttaaatcagttaatttgactgtgtgtgtgcttactttattgggttatcaaagtgatatttaggctgggcgcattgggtcatgcctgtaatcccagcactttgggaggctgaggcgggcggatcacgaggtcaggagatcaagaccatcctggttaacacggtgaaaccccgtctctactaaaaatataaaaaattagccgggcatggtggtgggtgcctgtagtcccagctactcgggaggctgaggcaggagaatggcatcaacccaggaggtggagcttgcagtgagccaagatcgcgccactgcgctccagcctgggtgacagagtgagactccgtctcaaaaaaaaaaaaaaaagtgatatttaaactaatacttggtggccaaaatgcataatattgagggaagtagaattcaggcaggagcaagcttgtggtgtttcagggacagaaatactggctagtgtgcctggaggataaagagacaaaaacagaatattatgagaaaattggataaataggcaggggccagattatgtaaatttacaaaccatagcaaggagtttgtatttgactcaaatacaatgtgagtggctttgtggaattaagatatagagatagatttgctacgattcagtaatgagtacaaggtataagagcaaattaccatcatagtgtcttttcttgctcacgtccatttactcaacaagacttattgaacataaggcactggtccagatttttccaaggaccagttaagattttagtagcttcctgtgtgagataaaattacttggctacagccaggtgcggtggctcacgcctgtaatcccaacattttgggaggctgaggcaggcggatcacctgaggtcgggagttcgagaccagcctggccaacatggagaaaccccatctctactaaaaatacaaaaattagctgggtgtagtggtgcacacatgtaatcccaggtgctggggaggctgaggcaggagaatcacttgaacccaggaggcggagttgcagtgagacaagatcgcgcactgtactccagcctgggtgacagaatgagattccatctcaaaatatatatatattttatatatatatgatatataaaacgtatatatgatatatataaaacgtatatatgatatatataaaatgtatatatgatatatataaaacgtatatatgatatatataaaacatatgatatatatataaaacgtatatatgatatatataaaacgtatatatgatatatataagtatgatatatataaaatatgatatataaaatatatatacgatatatataaaatatatattatatatatatacttgactacatggagtttcacacatatttacaatgcattctattttgtgaacaagttgtatgcaaattattttttacaccttaaattttttgggactctgaaatagacctactgttcttcttgtaacttgctgatattgctgtttgggtgagtggtgatggactgtaaaatcaaattttatatttgtatcatattttttaaaagataccaagtcttaatgctttcttcagatttaactttttatcagatagagtggattgtatcttcattcatttttattaattttagatctggaggaggtccaaagcaaatttaggatattttccactttggtaatttatttgcatttttaatggacagaaatgaaatataaaattataactatagttttaatataaattataaattattaaaatacttttagtcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccaggtacttttcacttttgttgacatttgttcagattaatgcctccattttggggtgtaaattttttttagaaggcagtttggtagtgccaagaaaaaatgatggattattaagtggggcttaaataccacatgggagattatttggaagaacattaagccatatacaaaaataagtttcaattaaacttaaggcttgaagtataaaaaattcaacaagaaaacacagtatcaaccttaaaataaaatgtcagtatgtacaaaaatttcttataaaatctagcagaggagagaagtcattttgacagagatatattttactgtaatactatgtttcattatgttttatattttactataaaaatttcaaaaagttcacatggaaaaaggtaatatgaacgatgtcaatagacagtgtatctaggacaactatttgtaatgcagatgacatagtattttaatgtctgtaatagactgagaactcttaaaaattacaggataaaaacaaaatgaacaaaggataagaatggacaaaaagaaaattcatgtagtaaactaccacatgaaaagtgcaaattaaggaaaatgaaatataactgtattcaatggactttaaaaattgttaaaaaatcaattaatatgtgctgttgtcaagaatccaagggaaaggacactttcccaatttgctgatggaaaagaaagttactatgatcttttgggaaagaaatgtaaaaatgaccattaaaaaatttttaatgtgtactatttgaccaaataattaattccttagactccatcttccccagtacgtaaggctttatatgcaaacatgattattggcaaacaaaatcgttgcctgttaatatggatatggctgaaaaagttaaggtatatccatatgatgcagccattgaaaataaaaattagaacttatatcagtgacttttaggagttctgcatggtactgttatgtgagagtaccaaaataaggaaatatgtgtatattactttagtatgaatgtttttataaaataataaacttgtatgttaaattctatatgtatgtgtttatacatgtcagtgttcataggagtacagatacaaatatgggaacatatatacttggttattaagatgggaaccttaaaaaatgaaaaacaacaaaagcaatcataaggataatagaaaaatatatggatttacttatttacttacttatttaaaggggggatcttgctctgtcacccaggctggcattacaggtgcaagccgctgcacccggctggattaatatttttatataatcttacagaatgcctttcccacatggtagcacgagcaaaaatagtaaatgaaaagatgaatatatttgattaaatgaaaagtagaacagtgtagcaaaacactctaaacacaatttgataggtagatgcaaatggaaaaatagtaagctatgtgacaaagtgtaaagtggtcctttatatatttttaatttttaaaaaataaagaaatagaggcaaaccatagggaaataaggaaaggaaatgaatagaattcaaaaaaaatagtaatccaagtagtgaaaatgaaattaaaataccttttgtgaacttcagattgctgaaaaatttaaaactatgatattgtctcaatcttgatcagtgtttggagaagtggaatgttgaatgtataagttggtgtaactgttgagggcagtttggcagtaattctaaatgtgtaccacaactggctggactgcaaaaatgctctttgaagaatagtttgctatcgcaagagattggaaagaacttagatgtccagcatatgagttcagttaaattaatgatgaatttccatgtaatggaattttcagatgagcggttttcagactggcacactgaatcataagggtacctcagtgtgtactgtctttgatgatgctccatggagggtgtggaccattcatattctagactaaatcctttattgtagattcagctggagcagctctttcctgttttattagtgagctaaataacctctcatttgaagatataactctacagctaaaaacaaaacaaaacacttttaaacctctctaacaggtttctttaataataagggaaaataggccggatgcggtggctcacacctgtaatcccagcactttcggagactgaggtgggcagattgcctgaggtcaggagttcgagaccagtctggccaacatggtgaaactctgtctctactaaaaatacaaaaaaattagccaggcgtggtggtgtgtgcctataatcccagctacttgggaggctgacgcaggagaattgcttgaaccccctagggaggtggaggttgcggtgagctgagatcatgccactgcactccagcctgtgcgacagagcgagactccatctcaaaaaataataataatggaaaatattaatgataaatctgttaataagcctgaaaaagcagtttacaaaatcatatgatcatattttgtttaaaatacattttttttttcctgtgacatagatggtagaaatacctttagaaggataatgggaatggtggacattcttttcccttattttctgtcaagatattgttttattcttgtgatgataataaagatactaatataattacttgtaattaaaattacatacctatatgaagtgtttatgataaatttctatttggaagtgactggaatcataatttaacagatgaaaatagtttaaaatatgtaaatatataaggaagggttattttgtaatgcaaataacaattctcctaaattgcttgctttctaaagaattactgatttaattcaagtatcactgccactataactagcagcattttactgtgcatgaagcaatctgctaaactgctttttatgcattaactcagttgagtgggtactcttactctgcatattttagagtttagggaaccaaaacttacgtaagttattaagttttacaagatcagatttttttttttaagaaggaatttcgatcttgttgcccaggctggagtgcggtggtgcgttctcagctcactgcaacgtccacctcccaggtttaagcagttctcctgcctcagcctcctgagtagcctcctgagtagccgggattacaggcacctgccaccacacccagctaattttttgtacttttagtagagacgaggtttcactgtgttgggcaggctagtctcgaactcctgacctcagatgatccgcccatctcggcctcccaaagtgctgggagtacaggtgtgagccactgctcccggccaagatcacatctttaaaaggtggtgtggctgtttgaatccaggcagtctgattcccagagtactattcctgactgccatactattactcaaatttaaataacaaccaaagtatagctaaataagatacaaggatttactgttatataaaaaccatgaattttaattttatctaacactgttgaagggaaatccattttatgttgtgatatttacatttcttatattgggtctttgcatatgtttatacttagcttgcagccttattttagtaaattattaagtgaacattttcttttcctttttagtttggcaattctattatcaacacacctctgaaacgtcgtaaagtgttttctcaagaacctccagatgctttagctttaagctgccaaagttcctttgacagtgtcattttaaactgtcgaagtatacgagtaggaacactcttccggctgttaatagagcctgtaattgtaagtacatcttaagctctttactataccaattataacattaaaaattccgttgctaaagctaatatataatatttaaaatttataagttaaaatatttaatagaatatcagttagttcaagatttcacattgctttaagagtatataaatagtagctccttgccattaaaatgagttagaaaaccttccaatatgttattgtttattatcatgccagcttcgtgcatgaaactttcaatgagttagaaaaccttccaatatgttagttttagtatcatcccagctaagtgcatgaaaagaatatattaaagaactgtagtgagtgaatgaagattccagaagttttggggtttgctggaaaatgtattatagcatcaagactcctagaaatagattattgtactataatggctgcccaaaggactttgtgtactttatcttacccatcatacctgtgtacttactattctgccaccaatccaagtttttattttctatttgaaattttaatataatctccttaactagccttcttagtcattatttttttctctaatgtattctaaacattgttgctagattaattgtaaagcactgtatgtgttctgtaagcctttgttttataatgccttaacttgatgtccctatttgtttccatctcttctttcaaactgatattgtcctttttacataaagcacttgtctttaagagaacttattgccgggcgcggtgtctcacgcctgtaatcccagcactttgggaggccaaggcggctggatcacgaggtcaggagtttgagaccagcctggctaatatgctaaaaccccatctctactaaaaatagaaaaattagccgggggcagtggcatgtgcctgtagtcccagctgctcgggaggctgaggcaggagaattgcttgaacctgggaggcagaggttgcagtgagccgagacggcgccactgcactccagtctggatgacagatcaagactctgtctcaaaaaacagaaaaaaagaaagaattatatcacagcaggaaagttgtaaggtattttattatttaatgtaatgaataataactgtttcttttctggtaaaggttcatggttctaggatacaatatgatcaaaagaaaaaaaattgtttataggagaaaatgaaatgtgaacctgatttcttagcagagcacagctctatgagaatccggcaaatttttcttttccatcaaaaaccctaagcttctcacaatttaaaaactaaagtttcagaagtaccctggagattcgaagcaaattatatataaattgtctaccctttattgcccaataatattgtaacatatgtcagtgtttttagggatttatgaaatttgtgttttgttacagccctcatactgcagactgtctttcctggtttctgtcaattaacaaaaatgtcactgtgtgtcacttagcacctcaaaaatgttcaggagtgccctgtaacttttacggctttctcccacattaatgctgttatttataactcttcagtgtgatgagtaaggttttgctggtgatttagacatttaattagaaagttgcatatttagtcttaaagctgtttatgaagaactacattaaaatttggatgaattttttctaataggttatatttgctacagtgaagaaaaactttgtaaatttagttaaaaaaataaaaggcagtatatgtaacataaaatgtgtcagtttaaaaaattataatgctaaatgaaatattccagccaaaaaatataatgtagaaatttgcagtgtggtattaaccttacttgtagcatgagatttttagcaaagggcattcttcattgaagaataattagtggatctgtatcttcttcagatggcgtaaataaaaagatgatttgatattttcttcttgaacataacttccttatattttgtagtgaaatgatttatctgccaagttatgattaatctgagaaacaggttttaaatgttttactatgtttaatgttttataaaattctacacttgcttattattagataatttaatcattttaatttgctcagtgatataattggcattattatttttatgtatttatttattttttgttttgagacagagtctcactctgttgcccaggctggagtgcagtggcgcaatctcggctcactgcaagctccgcctcctgggttcatgccattctcctgcctcagcctcccgagtagctgggactacaggcaccggccaccacgtccagctaattttttgtatttttagtagagacggggtttcactgtgttagccaggatggtctcgatctcttgaccttgtgatccgcccatctcggcctcccaaagtgctgggattataagtgtgagccactgcacccggccaattggcattatttagaagcgtccattttatttaaaagcaagtgcttttttaaagaagtaaaatggcatatattattaggaataccacatatgcacaaattcatttttcaaatgagaagatataaaaccaaggttttcattcagtttaaatttggaaactttcacaatgtagatgaaatagaccaatgtctacttctttcttttttttttcttggagaccgagtctcactggttgtcagcccaggctgggagtgcagtggcgcaatcttggctcactgcagcctccacctcacgggttccggcaattctcctacctcagcctcttgagtagctgagattacaggtgcctgccaccatgcctggctaatttttgtatttttagtagagatggtgttacatcatcttggccaggctggtctcaaactcctgacctcaggtgatccacctgccttggcctcccaaagtgctgggattacaggtgtgagccactgtgcccagcccagtgtctacttataatattaatgtgtgacttacttagatatttctaaatgacaaatacttagatatcacttccttcaattcctttatcttatgcaacaattttatttaaatgctttatgtcagccaggtgtggtggctgtaatcccagcactttgggaggctgaggcaggtggatcacttgaagtcaggaatttcagaccagcctggtcaacatggtaaaaccccatctctactaagactacaaaaattagtggggtgtggtggcgtgcacccgtaaccccagctactagggaggctgaggcagaagaatcacttgaacccgggaggtggaggttgcagtgagccaagattgtgccactgccttccagctcgggtgacagagtgagactcattctcaaataaataaatgaatgagtgaatgctttatgtcatcattattgacactttttgcatcagctaacatttttccaaaacatataatgtcaacatccacgtatgctagaatgtttcgcaagctactccttttttttttttttttttttttaaaaaaacgataaggtctctcttcgttgctcaggctggagttcagtgctgcagtcatagctaactgtaaccttgaactcctaggcacaagcaatccttccacctcaggccccagagtagttgggactataggtacatgccatctatacctaggtaagtttttctttttttgagatgatgtctcactatttttgcccaggctggagtgcagtggcacaatcttggctcattgcaacttctgcctcctgggttcaagcgattctcctgcctcagcctcctgagtagctgggattacaggcatgcattaccacgcctggctaattttttatacttttagtagagatggggtttcaccatgttggccatgctggtcttaaactcttgggctcaagccatcctcccaaaatgctgggataacagttaaaagccaccgttccctgccagtacccatgcttaatgtccccaaataatttgttatttcccagagaaaccagttaacacattcctttcagatgcaatctttagaaagtatgtttagtgacattctagactttgcaattaattattgtagtaattgctaaatttattttatatttgctttctctttttatattataaaaatcttcacactgaaaagttgaaagacttttgcagtgaacatttatataactccccgctaaattttactattagcattttattgtatttgctttccatatatctattcatccctgtatatattcatttatcttgttttttaatacatttcaaaatacttgcctccttttttgaatgtctcttctgtaaaataattaattcaggctataataggcttaatgtgtcttttccacattgaaataattagttagaaaataccatgttgtaaccaccagtaataagtaattcaggcaaggaccttcagtgatgggaaaccattgagtgaaagtcagacccccatgacatgcaatttacctgtataacaaacctgcacatgtacccctgaacctaaaataaaagttaaaaaaagaaaaaaaaaagaggaaagaaagactgatggaagggatgtgacaagaatgttaacagtttaacagttagtgggtttagataagcaatgtttaggtgttcattataatgttataccaacttctctgtgggattttaagagataaacgagtaatataagaaacattctaagtatttgaataaaaaagtgaagcctgcctttctttgtaagtctagagcaatactaattcatctttttttttagttttgtttagattttatcaagatacagctagacggtaagctattttatgtctttttacttaccaaagctttctttacaccaaagcactttacaggaataaaagattaaataatattcatagaatttattaagatggttagttgttacatatatcttcttatcaaagggcatatatcttggtgtaatttcattcagaaatatcacagaacctaactttttagaaaccccttttcatttggaaaaaataaaaaagtttctttaaggcagttataaagattttttttattacccacaagagtaatgatttatagagcataataaatatgtgcttacatttacttaaacttgtatttcctcacaatttcccccattcatgatattaccctcttaagaattatttttccatttcatttgttttcctccagaaccagaccatgatcctgtagagattatattaaatacctctgatctaactaaatgtgaatggtgtaatgtccgaaaattacctgtagtgtttcttcaagcaattccagcagtttatcaaaagctgagcatccaactgcaaatgaataaggaggataaagtttggaatgattgtaaaggagtaaataaattaacaagtaagttgtgtaaaacagattataatagataataatagatactgtatttacaatatctgttaaatagcaaaatgtgagtgcactttgacagatgccttaggtgtatattatctacaattgtcacagccaccttgtgaaatagatattactttctccattttacagatgaggaaaaactcacagaaagtggaagggctgaagataaaacccagacttactcatttacaaagtttctaagtggattaaaacccaaaagatctgcactcttaactaacactgtaatctgagtaaaataaaattttttaactgataggaatattaaatgtaaatcagccatataaatctggaaatcttgaaacttggcctgaataggaagttgttaagttcctaaaatgggccttaagtctttataatacatagatgtggttctccaggtttttttccttcacctttaacacttaaagcatggcttgactgcttagaagatatacacatttcagcagtaattgctgcttcagcttaattatgaaaaaatgttagctaccactaaatttgcaagagttggcacattagtgaaaagctgttttgcagttagattctcttgagatactaccagttcacatggcaattttctatttgtgtttgacaaaaatgttaactattatatctttaagactatagatttagatttattagatgaagtaaattagttacatacgtgaatagatttgttcttgaactgttgttagagtaatgtattctggttccttccaataacttaggtgacattggcatgtaacacatactggtctttccagtgattgttgtgtatccactgtatgtcagacattgttgtggacctttatactgggatttctgattatcctcctggaaagaattaataattactccttttaaaagtatctatttacttcttttgtgtttttttttggacttatatttatttcttttcagatttagaagaacaatatataattttaatttttcaaaatggccttgatcctccggcaaatatggtatttgaaagtatcattaatgaaattggtataaagaataacatctccaatttttttgcgaaaattccctttgaagaagctaatggcagacttgttgcctgtacaagaacctatgaagagagcatcaaaggaagttgtgggcaaaaggaaaacaaaattaaaactgtaattatgttttttaatttaaaaatattcttaaattgtgggtagttttaaagggaaatatgttttattttaatactgttcatttcagtgttaaatctttttaattttatttcagaattacttacttttatgtgtgatttgtaaactaccttgtgtcaaaacagtggtgggtaggtgccaaataccacttgatacaggtctcagaagcatttttggttcctccacattctatccttatctttacttttcatcatcattttctctgtcatccttttttctttataccctacttccaacatatatatgcacacactgctacattcaaatggattggttaccctgtgtcttacgtttgaagaaattgtggtccgtggtgtacatttgtatgtaatataggcatatatggttgaaaacttgagagatgaagaatacatgctatttgatctttattgtcaaaacatgtatctagtactaaaataactattcatataggtaggtaactctgaagccacctgaagcaaaggccacaatactactaaacacatagtataatggtaaataatacaaacataattttaaaactctaagtttatttcctattacagcaacttagctttgctgacctaatttattgggagcagatctctcacactgcctacaaacttggaaatatggctatccacagcgcaatcttggtgatagttgagcaaggactccccagagaagagctgtaaatatagttaagtgggttgagaaaagaacaaaagaagaaagggaaatggttctttttcttttgcatagtttgcatgggagacagtgccagaggaagaaaagagcagcataatgccactgggatggactcaaacttcagaggaaggttctttcctccaaggaacccctgtttcacttagctttatggagggctgaaactcattagactgtgttccctgagcctctgcccctacatcttatagattgcctagccattgaactaagaggcaaaaaccactttggtttttttgaaaggttatttgaattttaccagcattatttaatttcatgtagatagtagagagagaagtaagatactggaaaattactgttacataagttgggagagtatcactatctagaagctacagataataagaaagtggcccctagttttgcctgtttcttgtttttaattgttaagtatcatgcatactttttagttccacatttttaatccttttgcattgaaaagcattcttgccttgtgcttaccctttttattgaaacttttcctaattgactgtaaattgctaatttaatttcctttaccaggtatcatttgaatctaaaatacaacttagaagcaaacaagaatttcagttttttgatgaagaagaagaaactggagaaaaccacaccatcttcattggcccagtagaaaagtgagagaattcctttatatttgcaatgatcttaaatgtctttctctgttttattacatttcagttgtgtatatatatatagatttgtttatttgcttgccttctaattttgttacaggttgatagtatatccaccacctccagctaagggaggcatctctgttaccaatgaggacctgcactgtctaaatgaaggagaatttttaaatgatgttattatagacttttatttgaagtaagttaattttccactgatcttttattaaatctttaacattccgtcatatcttatgtctttgttttccagagtcaggctttttgagttttaaattccatctctgccacttactgtgtgacatttggggagttattttttctgtttctgtctttgcacattttaaaaatgagaattctatctaaaaagttgtgaaaattgggccagggagatatctggcttatgtctataatcctgacactttgggaggtcaaggtgggaggatcgcttgagcccaagagttcacgaccagcctgggaaacaaagtgagaccttgtctccacaaaaaatttaaaaattagccagtcatatacctatagtcccagccacttgggaggctcagacaggaagattacctgagcccatgagttcgaagttgcactgagccatgatggcgccactgcactccagcctggtcaacaaagcaaaactctacccccacacccacccccgaaaacaggagttgtgagaattaaatgagatcgtacatatcaagtagtaggaaaaatgcctagtacagtgttagaagtttatggtcttgtaggaagcacaaatacagaattaaagcaatgatagaagcattaacatggtacagtcctagcagatgagagaatgcttcattatctttggaggttgggagatatgagggaccaggaagctttcctggaagagcttacattatgacccaatatacattatgacccaacataacacatgtatacacctatgtgcaatgtgtttatacatttatcaatttgtatgtttttactggtttgtgatataaaatggacatgtatatgaaataaaacagaacttagcatcagtatgcatagttctctgtaatattttctagtttcttatactgtgtttcattaaacaaaacaaaacttttaaaaattgatgctggaatctgctgaattgattttatagcctattggtggttgcaactcagtttggtgggaaaacacattgttataaagagcaaagttttgatcagagaaatgatatcataattgaatttctgttaagaccattttgataggcatgacatcgtggaagtctagatgagaggtgatttaaggaaatttaattaagatgatttaagaagcctatttaagatattttagttgaaatgatgagacattttatgaggtagaattgtttactatatagaattagtagtactccaggactaattaagtggatattaaggaggagaggaaagggtaccaggtagctcctagttttctggctcacaagacctgctaaatgatgttggcactaaagcagtgaatgcagaaggagaacaggcttgggtgaggaggggataagttcccttttagaggtctgtgatataacaaaaggacagtgccaataagcagttgagcaaatggtgctagagtttggttgagttctgaccaacagagatggtaagatgttgtttaattgtgagaatgaatgaaattgcttatgtagggatatagaatgagaaaaagagtatacggacagatcctggagattacattttaagagatagaccgggaataaaaaggctcccatgaataatttccaaagctgttgaagaagtaagaagagaaattgaagggaagtgagagctttaaaggagattatactcagtgttaacaatatagcagagatcaaggcagataagggctaactaagtataattttgagttcacaatgaccccaaggtaattaagttaactatacagcctggacttgcacccctgaactccattagagatggtatcagtggaagcctattggaggagtcccacccccatccatcagtaacagggagctctctggtatcagtggaggtctagtagagaacatgtacttttagtcccacctcacaataatgaggtaacaccctactacccactggagtgtggtgctagaggaagtctgctaaaacacaagaattatattgctctacatagttgccagcaaaaacaaaaaccatagtactcaaaatgtccagatttcaaaatgaaaatcatttgccttacccagaatcaggaagatctcaaactgaatgagaaaagaatatcaatagacattaacaccaagaagacacaaatgtcagaattatttgacaaagattttaaagcatctgatacagttgaggtttgtgtccccgcccaaatctcatgtccatttgtaatccacaatgttggaagaggggccttgtgggaggtgattggattctgggggcagatttccccctttccatccttgttacattgagtaagttctcacaagttctggttgtttataaaagtgtgtagcacctccccctttgctctctgttactcctgctctggccatgtaagatgtatgtccttcctcttcaccttccctcatgattccaagtttcctgaggcctccacagctacgcttcctgtatagcctgtggatctgtgagtcaattaaacctcttttctttataaattacccagtctcaggtatttctttttttttttttggagatggagtcttgctctctcacccagtctacagtgcagtggcgcgatcttggcccacggcagcctttgccttctacattcaagcagtccttccacctcagcctcccaggtagcttggattacaggtactcaccaccacacccagctaattttcaggtagttctttagagcagtgagagaacggactgatacagcatccatcataaaaatgttttaatgaacatgatgacaactcttgaaacaaatgaaaactcaaaacaatataaagaagaaacaaatggatgggtcatgcctgtaatcctagcaattttggaggccaaggtgggaggatcacttgaggccaggagtttgagaccagcctgggcaacatagcaaaatcctcatctctacaaaaaaacaaaaatataaaaaacaaggaagaaacaaatggaaattttagaactcaaaatacaaaactgaaataatgacttcaggggctgggctcaatagcagaatggaaaagacagaggaaagaatcagtgaactgtctacaaggaatgtcaaagtaatgatattaaataggttgaaagaaaaaggatggaaaagataaaccatacaaacattaaacacaagaaagcagagtctgacaaataaacttctgaggaaagaaaattaccagggatcaagaaggatgttatgtaatgataaaggaatgatccaccaagaaaacatactaatcctatgtactaaacaacagaactataaaatgtgtgaagcaaaaactgatagacctgaaaggagaaacagacaaatccacaaataaaattggagatgttagtacccctctctcaacaattgatagaacaactagaaagaaaatcaacaaggatatagaagaactcgacaacaccatcaaccagcaggatctactcaacatcaggattatattcttttttttttttaattatactttaagatctatggtacatgtgcacaacatgcaggtttgatacataggtatacatgtgccatgttggtttgctgtacctatcaactcatcatttatattaggtatttctcctaatgctatccctcccccagccctccatcccacaacaggccctggtgtgtgatgttccccgccctgtatccaagtgatctcattgttcagttgccacctatgagtgagaacatgctgtgtttggttttctgtccttgtgatagtttgctgagaatgatagtttccagcttcatccatgtccctgcaaaggacatgaactcatccttttttatggctgcatagtattccatggtgtatatgtgccacatttccttaatccagtctatcattgatggacatttgggttggttccaagtctttgctattgtgaatagtgccgcaataaacatacatgtgcatgtgtctttatagtagcatgatttataatcctttgggtatataccaggtaatgggattgctgggtcaaatggtaattctagttctagatccttgaggaatcgccacactgtcttccacaatggttaaactaatttacactcccaccaactgtgtaaaagcattcctatttctccacatcctctccagcatctgttgtttcctgactttttaaagattgccattctaactggcatgagatggttatctcattgtggtttttgatttgcatttctctgatgaccagtggtggtgagcattttttcatgtgtctgttcgctgtatagatgtcttctttagagaagtgtctgttcatatcctttgcccattttttgatggggtttttttttcttgtaaatttgtttgagttcattgtagattctggatattagccctttgtcagatgggtagattgcaaaaattttgtcccattctgtaggttgcctgtgatgatagtttcttttgccatgcggaagttctttagtttaattagatcccatttgtcaattttggcttttgttgccattgcttttggtgttttagtcatgaagtccttgcccatgcctatgacctgaatggtattgcctaggttttcttctagggtttttatggttttaggtctaacatttaagtctttaatccatcttgaattagtttttgtataaggtgtaaggaggggatccagtttcagctttctacatatggctagccagttttcccagcaccatttattaaatagggaatcctttccccgtttcttgtttttgtcaggtttgtcaaagatcagatggttgtagatgtgtggtattatttctcaggcctcttttctgttccattggtgtatatctctgttttggtaccagtaccatgctgatttggttactgtagctttgtagtatagtttgaagtcaggtagcgtgatgcctctagctttgttgtttttgcttaggattgtcttggcaatgcgggctcttttttggttccatatgaactttaaagtagttttttctaattctgtgaagaaagtcactggtagcttgatggggatgacattgaatctatacattactttgggcagtatggccattttcatgatattgattcttcctatccatgagaatggaatattcttccatttgtttgtgtcctcttttatttcgttgagcagtggtttgtaattgtccttgaagaggtccttcacatcccttgtaagttggattcctaggtattttattctctttgtagcaactgtgaatgggagttcactcatgatttggctctctgtttatctgttaatggtgtataggaatgcttgtgatttttgcacattgattttgtatcctgagactttgctgaagttgcttatcagcataaggagattttgggctgagatgatggggttttctaaatacacaatcatgtcatctgcaaacagggacagtttgacttccccatttcctaattgaatacgctttatttctttctcttgcctgattgccctagccagaacttccaacactatgttgaataggagtggtgagagagggcatccttgtcttgtgctggttttcaaatggaatgcttccagtttttgcccattcaggatgatattggctgtgggtttgtcataaatagctcttattattttgagatattttccatcaatacctagtttattgagagtttttagcatgaagggatgttgaattttgtcaaaggccttttctgcatctattgagataatcatgtggtttttgtcattggttctgtttatacgatggattatgtttattgatttgcatatgttgaaccagccttgcatcccagggatgaagcccacttgatcatggtggataagctttttgatgtgctgctggacttcgtttgccagtgttttattgaggattttcacatcaatgttcatcagggatattgatctgaaattctctttttttgttgtgtgtctcccaggctttggtatcaggatgattctggcctcataaaatgagttagggaggatttcctctttttctgttgattgaaatagtttcagaaggaatgataccagctcctccttgtacctctggtagaattaggctgtgaatccatctggtcctggactttttttggttggtaggctattaattattacctcaatttcagagcctgttactggtctatttagagattcaacttcttcctggtttagtcttgggagggtgtatgtgtccaggaatttatccattttttctagattttctagattatttgcatagaggtgtttattctctgatggtagtttgtacttctgtgggatcagtggtgatatcccctttatcattttttatggcatctatttgattcttctttattagtcttgctagcagtcagtcaattttgttgatcttttcaaaaaaccagctcctggattcattgattttttttgaagggttttttttgtctctatctccttcagttctgctttgatcttagttatttcttgccttctgctagcttttgaatttgtttgctcttgcttctctagttttttaaattgtgatgttagggtgtcaattttagatctttcctgctttctcttgtgggcatttagtgctattaatttcccctctacgcactgctttaaattaaggtgatttaaatgtgtccaagagattctggtacgttgtgcctttgttctcactggtttcaaagaacatctttatttctgtcttcatttcgttatttacccgtcattcaggagcaagttgttcagtttccatgtagttgtgcagttttgagtgagtttcttaatcctaagttctaatttgattacactgtggtctgagagacagtttgttgtgatttctattcttttacatttgctgaggagtgctttacttccaattatgtggtcaatttttgaataagtgcgatgtggtgctgagaagaatgtatattctgttgatttggggtggagagttctgtagatgtctattaggtctgcttgttgcagagctgagttcaattcctgggtatccttcttcactttctgtctcgttgatctgtctaatgttgacagtggggtgttaaagtctcccattattattgtgtgggagtctaagtctctttgtaggtcactcagaacttgctttatgaatctgggtgctcctgtattgggtgcatatatatttaggatagttagttcttcttattgaattgatccctttaccattatgtaatggccttctttgtctcttttgatctctgttggtttaaagtctgttttatccgagactaggattgcaacccctgcctttttttgttttccatttgcttggtagatcttcctccatccctttattttgagcctgtgtgtctctctgcatgtgagatgggtttcctgaatacagcacactgatgggtcttgactctttatccaatttgccagtctgtgtcttttaattggggcatttagcccatttacatttaaagttaacattgttatgtgtgaatttgatcctgtcattatgatgttcgctggttattttgcccattaattgatgcagtttcttcatagcatcgatggtctttacaatttggcctgtttttgcagtggctggtaccagttgtttctttccatgtttagtgcttctttcaggagctcttgcaaggcaggcctggtggtgacaaaatctctcagcatttgctttgtctgtaaagtattttatttctccttcacttatgaagcttagtttggctagatacgaaattctgggttgaaaattctttcctttaagaatgttgaatattggcccccactctcttctggcttgtagggtttctgccgagagatccactgttagtctgatgggcttccctttgtgggtaatcaacctttctctctggctgcccttaacactttttccttcatttcaaccttggggaatctgacaattatgtggcttggagttgctcttctcaaggagtatctttgtggtgttctctgcatttcctgaatttaaatattggcctgccttgctaggctggggaagttctcctgggtaatatcctgcagagtgttttccaacttggttccattctccccgtcactttcaggtacaccaatcaaatgtagatttggtcttttcacatagtcccatatttcttggaggctttgtttgtttctttttacttttttttctctaaccttgtcttctcactttatttcattaatttgaccttcaatcactgatactctttcttcctcttgatcgaattggctattgaagcttgtgcatgtgtcgtgaagttcttgtgcaatggttatcagctccatcaggtcatttaaggtcttctctacactctttattctagttagctattcatctaatcttttttcatggtgtttagcttccttgcgatgggttcgaacatcctcctttagctcggagaagtttgttattactgacctcctgaagcctgcttctgtcaactcgtcaaagtcattctccgtccagctttgttccgttgctggcaagaagctgcaatcctttggagaagaagaggtgctctgatttttagaattttcagcttttctgctctggtttctccccatctttgtggttttatctacctttggtctttgatgttggtgaccgacagatggggttttggtgtagatgacctttttgttgatgttgatgctattcctttctgtttgttgatgctattcctttctgttttccttctaacagtcaggtccctcagctgtaggtcttttggagtttgctggagttccactccagaccagcagaggctgcagaacagcaaatattgctgcctgatccttcctctggaagcttcgtcccagaggggcagctgcctatgtgaggtgtctgtcggcccctactgggaggtgtctcccagttaggctacacaggggtcagggacccacttcaggaggcattctgtccgttctcagagctcagatgccgtgctgggagaaccactgctctcttcagagctatcagacagggatgtttaagtctgcagttgtctgctgcctatttttcagctatgccctgcccacagtggtggagtctagaggcagtaggccttgttgagctgcagtgggctccacccagtttgagcttcctggccgctttgtttacctactcaagcctcagcaatggcggatgcccctcccccagtcaggctcctgtctcacagatggatctcagaccgctgtgctagcagtgagcaaggctccatgggcgtgggagccgccgagccaggcacgggagagaatcaccttgtctgctggttgctaagaccttgggaaaagcacagtatttgggcgggagtgtcccatttttccaggtagtctgtgaaggcttcccttggctaggaaagggaaatcccccaacctgttgcacttcctgggtgaggtgatgccccgccctgcttcagctcaccctccatgggctgcatcccctgtccaaccagtcccaatgagatgaactagttacctcagttggaaacgcagaaatcacccatcttctgcatcggtcatgctgagagctgcagaccggagctattcctatttggccatcttggaaccgccaccccacccccccgtccaggattatattctatttagtttaaactgtgcccccatttcaaggacaccatttttccttttggtgtgtttcaaagttcttcatagctgaccagacacagtggctcatacctgtaatcccagggctttgggaggccaaggtgggaggatcacttgaagccaagagttggagacccagcctgtgcaatataatgaagccctgtgtctacaaaaaagaaaattttaattagctgggcaagccaggcgtggtggctcacgcctataatcccagcactttgggaagccgaggcaggtggatcatctgaggtcaggaggtgaaaccaacctgaccaacatggagaaaccccaactctactaaaaatacaaaattagccaggtgtggtagtgcatgcctgtaatcccagctacttgggaggctgaggcaggagaatcacttgaacccaggaggtggaggttgcggggagccgagatcatgccattgaactccagcctgggcaacaagagtgaaactccgtctcaagaaaaaaattcagctgggcatggtggtgcacacctatagtcctagctattgaggaggctgagatgggaggatcacttgagcccatgacaagagtttgaggctacggtgagctatgattacacaccactgtactccaacctgggtgacagagcaagacactatatccaagaaaaaaataaaatctttatagataagtcaaaagatgttatctcttttttaagtgatccatacaagtggccaaaaagcatatgaaagatgctcaacatcagtaatcattagagaaatgcagcatcaaaacaatataacacagtgtcatctcacatccattaggatggctactattaaaacaaaaacaaaaaaaaacagaaaataagtgttgatgaggatgtggagaaattgaaactgttataaaatggtgctgccactgtggaaaacagtgcgtaggctcctcaaaaaatttgaaatagaactacaatatgatccagcaatcccacttctgggtatacagtctcgtgccacataacgtttcagtcaattatggaccatatgtgatagtgagcccataagattataataacgtatttttactgtaccttttctctgggcacacaaatagtttccattgtgtcacagttgcctatggtattcagtacggtaacatactatacaggtgtatagtgtagaagcagtaggttataccatatagcctaggtgtataggacactatgccacctcggattgtataagtacactctatgatgcacaacttcaaattacctcatgatgcctttctcagaacataaccccattcttaagcactgcatgactggatgtccaaaagaactgaaagcagcgtctttttgttttgagttagggtctcattctgtcacccatgatggagtgcagcatcacagtcacagctcacgatagcctcctgggctcaagtgatcgtcctgcctcagcttcctaagtagctgggactacaggtgcacaccgtcacaccctgctaattttttcacttttatacagatggtgtctcactttgttggccaggctggtcttgagctcctgccctcaagcagtcctcctaccttggcttcccaaagttctgggattacaggcataagccactgctcccaaccagaaagcagagtcttgaagacatatttgcacacccatgttcataacagcattcataatagctgagtggtggaaacaatcctgctgtccattgatgaacggataaaccaaatgtggtgtatacatataatgcaatatgtatacatttccttccttaaaaaggaaggaaatactgttacttgctttaacatagatgaaccttgaggtcattgtgccaagcacagtaagtcagtcacaaaagtatgatttctgttatatgaggtatctaaagtagtcaaattcatagaaacagaaaatagaattgatgtttactgggatttgaggggaaggggaaaaggagttgtttaatagacatatgttcagttttgcaaaacaaagttactggagatctgtttttaacactgtgcatatactttacactgctgaactctacactcagaatggttaacatgataaattttatatgtttgttttggtttttttgttttttgtttttttttttgagatgagagtctcgctctgtcacccaggctctggagtgcagtggtgcaatctcggctcactgcaagctccgcctcacgggttcatgccattctcctgcctcagcctcctgagtagctgggactacaggcgctcaccaccacacctggctaattgttttgtatttttattagagatgggatttcaccttgttggccacgctggtcttgaacttctgtcctcaagtgatcccccctgccccccatcagcttcccaaagtgctgggattacaggcatgagccactgtgctcagcctaattttttttttttttttttaatagaggcaggatctccctgtgtgcccaggctggtctcaaatttctgggctgaagcgatcctcccaccttggcctccaaagtgctggaattacaggcgattaccattcccagctaaaatttttttttttttttcaaagacagattcttactttgtcgttcaggttggagagcagtgacgcaatcacgactcactgaagcccagacctccctggctcaagtgatcctcctgcctcagcctctcaagtagctgggactacatgtgcgagctaccacactctgctaatttttaaaattttcttggagatatagggtcttcctgtgttgcccaggctattctcaagggatcctcccaccactgtgcccagcccaaaatcactgtttaacttcatcttatagttaaaggagttctgatgatgttagattttccattttatggaatagcaactaaacagcttcaccagcattcaatatttaaatgatgtatgcacttagagaaattggtgcacccaaatggaagaaattcccataaggcttttttttgttattgtgttttgttttttgttttttgtttttgttttttgttttttttttgagacggagcctcgctctgttgcccagtttggagtgcagtggcgcgatctcagctcactgcaagctccgcctccctgaggcattctcctgcctcagcctcccgagtagctgggaccacaggcgcctgccaccaggcctggctaattttttgtatttttagtagagacggggtttcaccgtgttagccaggatggtctcgatctcctgacctcgtgatccgcccgcctcggcctcccattgttttttggttttttttgagatggagtttcactctcgttgtccaggctggagtgcaatggcacaatctcggcttactgcaacatccgcctcccgggttcaagctattctcctgcctcagcctcctgagtagctgggattacaggcatgtgctaccacacccggctagttttgtatttttagtagagatggggtttctccatgttggtcaggctggtctcaaactcccgacctcaggtgatccgcctgcctcggcctcccaaagtgctgggattacaggcgtgagccaccgcgcctggcctcccataagtttttgtggtaagcttgggttttccctttaattctaaaatgagagatatgattattattttaaagttaatagttgtgacacatgtacacttaaaaaatctagaactgtagtcacagaaatcttatgggtgcatatcagaaaaacgaaactagttactttaaaagcataaattaggccaggtgcagtgactcacacctataatcccagtactttgggaggccgatgctggaggattgcttcaggcaaggagttcaagaccatattgggcaatatagcaagacccttgtctctacaaaaacatacaaaaaaaaaattagttgggcatggtagtgcaggcctgtggtcccagctactcaggagagtgaagtgagggatcacttgagcccaggagtttgaggttgcagtgagctgtgaccatgccactgcactccagcctgggcgagagagtgagactttatctcaaagaaataaataaagcacaggctgggtgtggtggctcaaacctgtaatcctggaggcttcccaggctagtgcctgagccccacatccctcgccccccatcctccccgcatcccactcctccctcacacctggccctgtggctcttcctccttcccttcccccgccaaaaaaaaaaaatctgtaatcctagcacttgggacgccaaggcaagcagaccacctgagcccagaagttcgagatcagcctggacaacatggcgaaaccccatgtttacccccaccaaaaaaaaacaaagttagccaggtatggtggcgtatgcctgtagttccagctactctggaggaagaggtaagaggatggcttcagcccaggaggcggaggctgcagtgagccactatgtccagctcagttgtcttatatcacaaatacatttcctttttttaaggtgaatatccctttattcagttaagttttataaaacagccattgtaggccaggcacagtggctcacgcctataatcccagcattttgggaggccagggtgggaggatcatttgaggaatggagttcgagaccaacctggccaacatggtgaaacctggcctctactaaaaaaaaaatacagaaattagctgggtgtggtggagggtgcctgcagtcctagctactcaggaggctgaggcaggagaatcacttgaacctggaggtggagattgcagtgagccaagattgcaccactgcactgcagcctgggagacagagtgatactcagtctgaaatttaaaaaaaaaaaaaaaaaaaacaccaaagtagccattatagtttgggccagcaaaagtctcatggttcactcattacagtatagtccctggactgatagctatttatctacatagtgtgttttgaagatactattgtagaattcagcaattaatataaactgtgtcttgatctgactcactgtcttgtattatcttctgtaggggcacactgagttgcctgaaagcaagaaatcttaaattatgtcattttcattgaaacttgagctttggaattattgcatattagtgataaaagtaacagatctcaagaatgtgccctctagggggccagatgttttaagcatttgctctttctgtgtaagatttcacaagactttcagactgtcctcattttgataatattaatatggccataagcttgaacttgcataagtcctatgagaaagtttggatcataaataaatttaatatatcataatttccctttgtgatataaacgactattgttacttgttttgctatagatgtataaaaaaataactaaggcaataaaaacttagaaccaggccaggcacggtggctcacgcctgtaatcccagcaccttaggaggccgaggcaggtggatcacctgagatcgagagttcaagaccagcctgagcaacatggagaaaccccgtctctactaaaaatacaaaattagcctggcatggtggtccatgcctataatcccaactaatcaggaggctgaggcaagagaatcgcttgaacccgggaggtggaagttgtggtgagccgagatcatgccattgcactccagcctgcctgggcaacaagagtgaaactcttatctcaaaaaaaattagaaccaatgtaagatcactttacagagtcattgttaccacctcaccactgtacaagttctttctctttattttctattttcataaaaaatactatgctgctggatcttcgtggtttattaactgaactgtttaaaatgaaataaacaatacataatgataacagctttacttagatataatacatataacatacaattcacccatttgaagtatacaattcagtgtgtttcattgccccataaagaagcctagtacccattagcaatcactgttttcttccaatccctcctccaggcctatgcaactgtcagtcttttctctatctctggctttttgtattctgaacattttgtacaaatagaaccataaaatgtgtggtttttatgagtagattcttttagttggcatgttttcaaggattttctatgatcatgtattatcacttcatttctatttcagatatttcattgtataaatgtaacactttatttttccatttgtcagttggttagcatttttcttatgcttttgggctattatgaataatgtggggacatatgctctactctagatttagagtgtgcccttggttttttttaatttatttttattttcttgagaccaagtcttggtctgtcatgcccaggctggagtgtagtggtgtgattttggctcactgcaacctctgcctcataggttcaagtgattctcccgcctcagcctcccaagtagctgggattacaggcactcgccaccacgcccggctaaatttttgtatttttagtagagacagggtttcatcatattggccaggctggtctcgagctcccaacctcaggtgatctgcccacctcagcctcccaaagtgctgacattacaggcatgagccaccgtgtgcagcctaacaaggtttttggttttttgtgtgtgtgacagagtctcactctgtttctcaggctggagtgcagtggctcaatttcagctaactgcatagaatgtgtccttgttttaaaacattagatctttatgttataattttattttcaaatagcaattttcattgcctgaagataatcggatagttatcaaactttgctaataacttccttggttctaaagaagagagattgatggttctaaagaaaaaagatttactgagtttttaatacaaagcgaactgtggccgggcgccatggctcacgcctgtaatcccagcactttgggaggctgaggcgggcggattacttgaggtcaggagttcgagaccagcctgaccaacatgggggaaaccctatctctactaaaatagaaaaattagctgggcgtggtggtgtgtgcctgtaatcccagctacttgggaggctgaagcaggagaatcacttgaacccaggaggtggaggttgcagtgagttgagatcgctccactgcactccagcctgggcaacagagtgagactctgtctcaaaaaaatagaaataaataaagtgaactgttacattaattatatttgaattattttctatcaaatagatacttggtgcttgaaaaactgaagaaggaagacgctgaccgaattcatatattcagttcttttttctataaacgccttaatcagagagagaggagaaatcatgaaacaactaatctgtcgtaagtcaaactctgaaaatatttaacagatgtaagtcactcacatttaactaagtgaaaaatcacgtacttgaaagaaaacacaaatctctgcagttctcttgcttactttttaaattctccagccaggaagagaacacactaaataaatcagttccattttcattcttcatgggttcatattcaccttccttaaactaactttgtgctagttttggaattttttttaacaacttatttatattgaggcaatatcatttagttctcttatcagtttacaaaattaatataattcataatattctaatactttcagaatacctggaatttataaatgttctgggtcaaatatctagaatagtgtttcccaaatgtgactagtaggtttttttaaaattacttagatacttactaactacagattactctgttttatcctagatgttcatccataatatctaagaaaggaacctgtgaatctatactcttaataagctctttgggtgattcttctcagacaaattaaggaaatactattgtacatagtaggcctgatttgttttctttttttcaagacagggtctcactctgtcacccaggctggagggcattggtgtgatcttgtctcaccacaacctctacctcccactctcaagtgatccttccacctcagcctcccaagtagctgggactaaggcacacgccactccacccagctaatttttgtattttttgtggagacagggtttcaccatgtttcccaggctggtttcaaactcctgggctcaaggaatctgctcacctctgcctccccaaagtactgggatttcaggtgtgagccaccatgccccacctttttctttataattcctctccaatagtgatggcatctagctctgataatttgctggtaattgatcaaaagatacacttaagaattggtacttttaaaatttaaaactagtgttagatgtcttgaattgatggctgctatgcataataaataattaataataataatatattctcttatttcagcaattcctaatgttgcatcttagaggtgataacagtcattggttttgaccagtgctcatggctatattgcttcatctaccatcagataatgctcacttttcctactgtcttctccccagttaccctaagtcgtgcttggctacacctctcaatatagttgccaggaccaattctgcagtaataaaaatagtaaagagaagtctaggcaagataagcactagaacttccacccctcagatggagtaacaggagtaaaatatctttctccaaattcaacaatgggtagtcccatgccttcctagtttccatccaacaagttctattttctttccccagtttgtcaaaccattttatgcaactgtttgagctattacatctgaatcttcttaatttataaatcactacatataagctggagcactagaaatatttcagaagcttataatttatctctttcttacagaatacagcaaaaacggcatgggagagtaaaaacatggacccggcacgtagatatttttgagaaggattttatttttgtaccccttaatgaagcgtgagtaagaatttcctttaaaggaaaatctttaaatcatgtaaatgatggcaatttttaaataatgagtatgaggtgaagaattcattttaaaacatctttctgaaatctcttgtgtatattcatatttgtactgcctgttttacaagaattaatgcagtttcacagtgaagcatgtaagatattgaattttagagacaatagaccagatacctttctaatctcattttattcattaatgtcaaataataccatttttaaaaatatggtgcttattgtctagcaagtaacctatagaaaagtattattttatacaaaaagatgattaggtcacataaaggaattggaatcttaagtttaaaatacacttctgtttttagccagaaaggagaaacgatggttggatttatgccatttttcaattaaaaaccatgtggactacttgaagcagtttctgagtaaatggaggtgtttaaagatttgtattattctctcccaatgactagatagtagtattttacaatggagacttaaaagttttttgtgttttattctttcgcttttctatgccctcaatccaaagaacaccagaaatacacttgtagtcggaaaacttgggtttatcacttgcatcaaggaatgacacacaccatgggccactctggagcctctcaataaaaggatgtttcaaagaacctgtgacagaatctgggctttccttgagtgatatgggggagggtctaaagtagtggtttgcctaggtaaagaagtagcattcactcattaataaagaagaagaatgttggctattttgtggtttccaactgtgaccttatgtttttctctgcttagacaaattatgatatggccctactttgtctcattctatcatggttgcagaatatgctttcctggagttggtattctatgagattgtttatgtctaataagcctagctgtgccaagctagcttctgaattttttttttttaacttttgtagaggtgagggtctcactgtgttgctcaggctggtcttgaactcttggcctcaagccatcccccaacctcagcctcccaagtagctgggattatagacatgagccactgctcctagcaaagctatatatttttaaattcatattatcatagtaaaatttaaaataacatttaaaactagttaatttcttcattctcttcaaaataaggttttggctgggcgtggtggctcacgcctgtaatcccaacactttgagaggctgaggtgggcggattacttgaggtcaggggttcaagaccaacctggcgaacatggcgaaacctcgtctctactgaaaatacaaaaattagctgggcgtggtggtgcgtgcctgtaatcccagctactcaggaggctgaggcaggaggatcgcctgaacccgggaggcagaggttgcagtgagccaagatcatgcccctgcactccagcctgggcagcagagtgagactccatctcaaaaaaaaaaaaaggaaaagaaaaaaaaagacagaaaagaaggtttcttgactgggtactaatttgtcttgtaaagtaacatgtgaacagcttactaggtgaaagggaggaaagcgatttgtcagaaatgagttataaaaattttaaatagaaatattatttgattatacacgatttaggaatagaggcgcatccctcttagtcactatacctctgcatggaagttattatcagtgcttccagtcatcttagtgagaggtagaaaatgaactctgtaagagagctctaccatttgtagattaaaaaatagcctataaatcaagagagcttgtttttgtttttgcttttttttttttttttttttgaagagacaaagctacaaatacttatacactaattatgttagattggctgccatatatttgtcatctgttttgtttttattttttctggtagtaccagttttgtttttcttttctttctttcttttttctcgagatagggtctctgtctgtcactcaggctggaatgtagtagcatgatgtcggcttactgcagcctcaacctcccaggcttaagtgatcctccgacctcagcctcctgagtagctgggactataggtgcatgctaccacgcccagctaatttttgtatttttttttagaggatggggttttgccatgctgcccagtctggtctcaaactccagagccgaagcggtccacctgccgtagcctctcaaagtgctgggattacaggcatgtgccactgtacctggccctaatttttttctgaagtttctaagctgtttattaaaaattgttatagtaatttccagaaacacaaatttgatgtgtggatctaatctatcttaagtgaaattgcctaggtattttcttttgttttgttttgttttttagagacagagtctcattctgttgcccaagctggagtacagtggtgcaatcatagctcactgaagcttcaaactcctaggcttaagcaatcctcctgcctcagcctcctgagtagctagaactacaggcgcatgccacaggcccagctaattttttaaaatttttttggagatggggtctagctgtgttgcccagactggtctcaaacttctggcctcaagcagttcccccacctcagcctcccatagcaccaggattacaggcatgagccactgcgcctggccaaaagtctgtgtaaccctctctcttgctgttaaagttaacgtagctgttattaaaaggaatcataaaagcaaaaccctggcttaatggaagtaattgttggaagtaattgtctgattcagctttctcttcttaggccaaaaaggatttttcctagtttttaggtgaggatatttgtagcttagccacattggcatagctaagaaatattaagaactgtgataggctttattacagctgtaggttgagagtcactgtattatactatatttcatcaattttattttatttattttgagatggggtctcactctgtcgcccagactggagtgcagtggcaccatctcggctcactgcaatctccgcctcccaggctcaagctatcctcccacctcagcctccaaccccagtagcttggaccacaggcacgtgccatcacacccagctaatattttgtgtttttggtagagacggggttttgccacgttgcccaggccagtctccaactcctgagctcaagcgatatgcctgcctcaacctcccaaagtgttgggattacaggtgtgagccaccgtgcccggcatcatcaatttttaaaacacatttttttcacattgcaacatgtctaaagttgagatgtgactttataaataaaataaaattagctatgtgttagaagtgatgaaatgaggaggttggtgtgttagcctgatctaaatccatagggtactaaggaataataatgaagaacaggagagaagcaagctttcatccatctggacttcgcaatacagaagatgaagccagccagcctatgacagccatttctactggatgctgtttgatgaagagatagatagtgctgtttcttagtactaacttgggtactctaatattctacaaaaatgagaaagtggaataatttttatccatggcaagataacttgtttttcatccagcaaatatttattgaacaccctaccataggacaaatattattgtgcttgaccaataagctccctgacatctatagcctgttccttgtatcccagcacagccctgtgtctagcaaaaaatgaatattagccaggactgtacagcttcttgcttgtgtcctatactctactgttgggaacagtgatacctgaattcagctgtatcataagcacctacttgatagctggaactctctactaatacttaaatttttgtgcaaggactaggttagatatgttatttctttttaatgtattaaatttcaatatagcatgagataaaacattacttatatacatatttttgatattaagcctttcctatcttaataacacacagtaacagtaaaaagaacaaaactatatatgcaattcttagaatgttgaaaaatcatatgacctaattagactgctgaagacagtttaatccttttttttttttttttttttttttggagacggagtctcgctctgtcgcccagggtggagtgcagtggcacaatctcagctcactgcaacctccgcctcccgggttcaagcaattctcctgcctcagcctcccaagtagctgggactacaggcgcacactaccacgcccagctaattttctgtattttagtagagacggggtttcactgtgttgcccaggctgttctcgaactcctgaactcaggcaatccacccgcctcggcctcccaaagtgctaggattacaggcgtgagccaccgcacctggccgacagtttaatctttaagatggatagctttccatctttttacataaagagaaggcaaaggggaatgacgagttgcaaagtgacattacttgccagaaaaagcaatgaatttttcattccaaaaacaagaaagcgttcagggattgtttgcaaaagtaaatacaggctacataattttaatacaaactgtgttatttttgaatagacattgtgttctgttactgaatcagtgattacataaaacaagcagattaatttgagaactaaaaaaaaaataggctttttttttttttttgagatggagtcttgctttgtcacccccaagctggaatgctgtggcacaatctcggctcactgcaacctctgcctcttgggttcaagtgattctcctgcctcagcctactgagtagctgggattacgggtgcacaccactgcgcctggctaatttttgtatttttagtagagacagggttttgccatgttggctaggctggtctcgaactgctgacctcaggtgatccacccacctcagcctcccaaagtgctgggattactggcgtgagctactgcgcccggccagaattaggcatttttaataaattaattggcaagaactttagaaaaaaacattttaattgatatgtattgccaaatataataaacttttctaataacatatttagtcatttcatttgttttttacagtgcacactggtttttggctgttgtttgtttccccggtttggaaaaaccaaagtatgaacctaatcctcattaccatgaaaatgctgtcatacagaaatgttcaactgtagaggacagttgtatttcttcttcagccagtgaaatggagagttgttcacaaaactcttctgccaagcctgtaattaagaagatgctaaacaaaaaacattgcatagctgtaattgattccaatcctgggcaggaagaaagtgaccctcgttataagagaaacatatgcagtgtaaaatacagtgtgaaaaaaataaatcatactgcgagtgaaaatgaagaattcaataaaggagaatctacatcccagaaagttgctgataggactaaaagtgagaatggcctacagaatgaaagtttaagttccacacatcatacaggtatgtatctaaatgttttgaaagaatgaaaaaattcagaataatctggattttttaataaacaggattaagatcctgttttaaaaaaaaatcaggttaatgactgggtgtggtggctcacgcttataatcccagcactttgggaggccaaggcaggaggatcacttgaggccaggagtttgagaccagcgtgggcaacatagcgagacccaatctccaacaaaaaaaaataaatagaaaatttttaaagaatttacttataacaatatagtaacacaacttacttttaatttatactgaggtataattataatagcattcactcatttaatgagtgtagcttgaactttgataaatgtatacatagagtcatgtaatcactactgcaatcaaaattgagaacctgatcagggcacagtggctcacgactgtaatcctagcactttgagaggccaagatgggcagatcacttgagctcagaagtttgaaaccagcctgggcaacatggtaaagccctgtctctaccaaaaatacaaaaacttagccagatatggtggtgcccatcggtggtcccagctacttaggaggttgaggagggaggatcgcttgagctcagggtgctgaagttgcagtgagtggagatcgcaccactgcagtccagcctgggtgacagagtgaaactccatctcaaaattaaaaaacaaaaaaattgagaactttccatcactcaaaaaaaaatcccattgtgccctttttgtagtctgtcacttctgtcacccctagggtgcaattttgaaattgcagtacaaagtttatattttccatttattggaacttggatctatttttatttcataggaaatttacagtattcagcattaacagtagttgtgcagtcttagatgtataagacaaattagatctcaatttacacattggtaaattgagatcaaataacccaaggcagaaattaaagctttctcttcaaaatagttgtgaacagtcctgaaggggtggcctgcccttccacacctgtaggtatatctcgtcaggtgggacgagagactgagaaagaaataagacacagagacaaagtatagagaaagaacagtgggcccaggagaacggcactcagcatatcaaggacctgccccgtcaccggtctttgagttctctctgttttggttgattactattttcactatctcagcaagaggaatgccgtaggagagcaaggtgataatagggagaagatcagcaagaaaacatgtgagcaaaggaatctgtgtcacaattaagttcaagtggaggtactatgcctggatgtgcacgtaggccagatttatgtttctctccacccaaacatctcagtggagtaaagaataacaaaggagcattgctgccaacatgtctcgcctcctgccatagggcggtttttctcctatctcagaattgaacaaatgtacaatcgggttttatactgagacattcagttcccaggagcaggcaggagacagtggccttcctctatctcaactgcaagaggctttcctctttcactaatccttctcagcacagacccttcacgggtgttgggctgggggacggtcaggtccttcccgtcccacgaggccatatttcagactatcacatggggagaaaccttggacaatacccagctttccagggcagaggtccctgcggctttctgcagcgcattgtgcccctggtttatcgagactagagaatggtgatgacttttaccgagcatactgcttgtaaacattttgttaacaaagcacatcctgcacagccctagatcccttaaaccttgattccatacaacacatgtttttgtgagctcaagtttggggcaaagaggttagggcaaagtggttggggcaaagttacagcatctcagggcaaagcaattgttcagggtacaggccaaaatggagtttcttatgtcttccctttctacatagacacagtaacagtctgatctctctttcttttccctatacattccaattaaagcttggttcttcattcctcactctccttcactgttttcagtgggaagaggagcactggtccaatctttgtttgtttaaatctctcttcagctctaataacttgatttttgtccttgagtcagtcctgtagttgtagaacctgttaaatctagttttggccaggtgtggtggctcacgcctgtaatcccagcactttgggaggctgaggcgggtggatcagtaggtcaggagtttgagaccagcctgaccaacgtggtaaaaccccatctctactaaaaatacaaaaattagctgggtgtggtggtgcccgcctgtaatcctagctactcaggaggctgaggcaggagaatcacttgaacctgggggcggaggttgcagtgagccgggatcgcgcaactgcacttcagtctgggcaacagagcgagactccatctcaaaaataaataaattaattaattaattaattaaaaactagtttctgttcaaattcttaaatttgatatcaagtcaattgtataatttcctctccaacctacaagtaaaataatcctctccataaaaacccataacatgctatagtgtgtgccttgcaaacttcttaaactgtgaatagatctaatacatttttcttctttttttttaacaccttgctcatggaactaatgaatcttatttggatgaaaaatattggtataggacatagaataaattatgtgaattcagaaagaacctatcaaaaattgtgaatatggaacatactcctgttacttataccagcttatattattttagtgagttagaaagctatttttgagcttttttttttttttttttttttttttttgagatggagtctctcttaatcacccaggctggagtgcagtggcgtaatcttgtctcactgcaacctccccctcctgggttcaagagattgtcttctcttgcctcagcctccctagtagctgggattacgggtgcgcaccacctcacccgacctgttgagctcttgtaagaaatctcctgagcaggaaaatctggagtagattagtggctgctcggggcttttgggggtgggcaggtgaggtgggtgggaatgtaggaagagagtgatagctaagtggtatggggtttctttttgagatgatgaaaaggtttaaaaattggttgtgatgatggctgtgcatatactaaaaaacattagactgtatgctttaaatggctgtatatggtatgtgaattacatttcagtgtggctttttaaagtctccttttgaccaataatgttacatactttaatgtgaattcaaatgaattaaggtacttgacttaaagcaatgggacaaaagcctagggtttcatatacacaaactccagagatttctagtgccctcacctacaaattaattttctggtcaagtaaaagccagttaaatttgagtaaatagcctcaaaaatcctaatggagaccaaagccaaaaataacttgttttatgtagtttgccttcttaatacttgtatatcccatttactcatttttgaattatagtttgtacatttttgttttgtttttagtatgtgtataccatatcaactatctcttcctctgaaacaaatgtttcacaaaaaatcacatacagtgatttcacatagagtcaacaagtgttgactacttatgtcagataacaggctgtagtaaataagtggaaattaggtttttacagaaaactagggaaataacaatgtgtggaatcactactttcacttgctgttttttcacttgacaccttatgaaatagttgacttgccatggtgcatgaaaaatgtgtacgcttaaactctagaatcacactcaacatcttcacatggtctccttatatgagaagttctcaggaactgacactgattgagagaaccactgatcaagtcatcacctctcaatttactccagatcacttgtttatgggggaattgactgcatcatttaggttatttttctcctgtttttgaaaggcatttctggtttagtttgtgtaaggtagatagatatttatatgaccacagtttacatagataatgatttgctgctggaagtaacctgattataactgactaattctgaattacctgaagattttggacaaatgttattcaaatataggtgttttagctttaaacagacttaaaaatacagatttttggaaaagataaattgaagaggtcattatttttttctttcttcttcttctttttttttttttttttttttttttgagacagggtctcactctgttgcccaggctggaatgcagtggcacaatcacagctcactgaagccgctacctcctggactcaagcagtcctcccagctcaaccccctgagtagctgggactataggcatgtgtcacctgcccggcaaaatttattttctgtagagacgggctcactttgttgcccaggctggtctcaaacttctgtgttcaagcaatcctcccatctcagcctcccagagtgttgggattacagatgtgagccactgcgctcagcccatagtgcttttttgttgttgtggtggtggatttttgttcttttttgagacagtctcactttcatagaagttaagagtacagcaatacaatcacagttcaccgcagtctcaacctcccaggctcaagtgatcctcccacctcagcttcctgagtaactgggaccacaggtgcccaccactacacctggctgattctttattttattttgtttgtagagacagggtctcactatgttgcccaggtgatccttctgaactcaggtgatcctcctgcctcagcctcccaaagtgctagaggattacaggtgctaggccactgtgcccggccccatagtgcttcattggtttatcggttattttaaatagtgtgcttctgaacacaagagttagatttatgtatcttttctcttctccttttttgagacagagtcttgctctatcacccaggtcggagtacagtggcgcagtcttggcttactgcaacctctgttgcctgggttcaagcaattctcctgtctctcagcctctcaagtagctgggattacaggtgcatgccaccatgcccagctagtttttgtatttttagtagagacagggtttcaccatgttagccagtctggattatatatcttttcagattttttgcttccttttcatcccatcttgtttatattaatatcttaacacctttttattaacttataccaaaatttattttatcctgtctacaataactaaaagtcatgcttttcaaatttttgagaggaaaataaataaataaaaatcagctgggcatagtggtgtgcacctgtaatcccagcactctgggaggccaaagcaggaggatggcttgagcgtaggagttcaaggttacagcgagttctgattgcatcactggactccacctgggcaaaagagtgagagaaatcctgtctcttaaaaaataaataagtgaggccaggcacggtggctcatgcctgtaatcccaacactttgggaggccgaggcaggtggatcacttgaggacaggagttcaagaccagcctggtcaacatggcaaaaccccatctctactaaaaatacaaaaatgccaggcatggtggtatgtacctgtaatcccagctactcagtaggctgaggcaggagaaatcactcgaacctgggaggcagaggttgcagtgagccgagattgtgccactgcactccagcctgggcgacagagcaagaccccgtctcaaaaaataaaaataaataaataaaataaaaaattgaaatggtagtaaatcttacatttctttgaaacatgttgtgattagcttctttcagcaaaatagttgcttattatttgtctaaaaacagacctattacttacttgtagttaatgttcatttttgccctgaattatataattttccacgttttcgaaattttaattataaaattatgcagttgcattttcttttatgttctatgacatgctgtttctgttattggacataggttattttcagactgtcatagctttcattactaaagatacctgacttgcctaacacaaaagtacttatttgtttacacatatacatatgtatatgtatttaagtatatgtatacttaatcatatagctgataactagtttttaaattttaatgaattttagcatctgggtagtggaaacaactgtaattgacatgtcaatccaggtttttaaaataacttactttatgtttgtgatattacacactaaggcagattttgtgttcttgactactgtatcattaattaactactagcattaatttcagcctcatatactatgagtgatagacatggccttttttattatgtaatgtttcttattgatacagatggcttaagcaaaatcagactaaactatagcgatgaatcacctgaagctggtaaaatgcttgaagatgaactcgtcgacttctcagaagatcaggataaccaggtaaaacttaatgcttggcaaaaagttctaatgttttatctaattaaaagtttttcttgctgaacatggtggtgcacacctgtagtcccagtgacttgggaggctaaggcagaaagatctcttgagcctaggagtttgagttcagcctgggcaacataaggaaactccatctcttaaaaaaaaatgaaaaaaggaaaaagaaaaagactttataaagtcttgtaaagcaatttcttcaactagtaatttatcatggcttctgaatttggatcatatcttaaaaaacaaattcagctttcaagtcagaagttgccaggataaatgtatacatgctgttgttgctgctactgtggtgtggactgaactttaatgtaatattgattaactcaccctaactcagctaccaccaccaatacccaccttcctctttcaaagcatttatgggtcatacttaacctttaacctgacttgacattcaagaagcaaatgtttaaaccttcagttatatggtacatgagtaccaaaaatattatattgttttcccacttttccagttatttttttttctcctgcctgattcgatttatatgtgtcatggcagaagcagataatatttaattaaagttaatatagatgaattctgacttttccttggagtctcatttgccctaacaaacagtatgaacagcaagaataaagtatatctgtgaaaatactttactttttagcttctgttaaaagaggattttatattgagaaaagtttataagaatcctacagcataccattttgttaattctctgacctttcattagttgttaggacatactgagttgtatagtagtgaagatagctttatactgcaccatctttcctttttgcttaatcttccagtgaacaaaaggcattttaagatatctcttggtttacaatgtatggcaactaaatatagcttttcaatccaacatatataggaattacattcatgatttataatgagcacttaggtacttttggttatagcagttacctgtgatgtgaacaagctaatgtaactgctttattattactattattcctactattgattattccattcgtaaagttgccagaagctttctcaaagaacaacaatgaccaaaaaagccttgtttattttacattcaagagaatctacagaataaggactcagtgtccttaagttagcttctctcaagtgagatggataagtgggtttctcaaggaaaacagtgtttccaaaaaccctttaaatatttctgatgtgaaaacattattcatgtaaaataacatgttattttatatcctattgtgaaatagctgtcttagccaacaaactaaatttttgtaaaaataaactaaaatcagagcagtaatatttggtgggagaagattcagtcataatatattcagtcttaaagatttattctagattgagtaaatagatgtaacaatttgttataaacctctggtagtttattttccttaaaatgtcagtgttgtagcattggataattggaattaagtaacataccacatctctagtgtctaatcacctaaatagagaaaaagttttgacaatcattacaaatatttttgtctccagtgtgctattttgttaggttattagttatttagattatatattttcagtattaacagtaggctgtcttttataggatgatagcagtgacgatggattcctcgctgatgacaactgcagttcagaaataggacagtggcatttaaagcctactatctgtaaacagtaagcattaactgtgtatcttgaaaactacataatttttaagtatgctcataaaacataacaggacagttttttttttaaataaatacttaagcaaaactcataaatgctgtcagagtcagtgaggaaacttgaggcatgctatctagggattaaaatgggaagaatgggtaatcatttcagtcctccatttgccagtttccccagcctctgcatgcacatgtccacacacaaatgttttgttttgtttaaattttttatgtgtatattttttgagacagagtcttgctctgtcgcccaggctggagtgcagtggcacgatcccagctcaccacaacctccacctcccaggttcaagcgattctcatgcctcagcctcaggaatagctgggactacaggtgcgtgccaccatgcctggctaagttttgaatttttagtagagatggggttttgccatgttggcaagactgatctcaaactcctggcctcaagtgatccgcccctctgagccttccaaattgctgggattacaggcgtgacccatcgcgcccggccacaagttttgatagtgaaccactattcctttttacctacaatgttttggagcagaaatcactatatatcaaaacagtaacatggggttggagtttacactgattccttagctactctttgaaggctgtggagtaacccaaggcagacgtaagagacatgttccaactgagaactccaaataagggtgagtcagttttgcttttcagaagtacgtgtttcttctgagatgctgaacttcttaggtgaagtattacctatttctaggtttaatctcctttgacttttttttatagaaaatgttgacagaaactctattaagagactttgaaaatgcagcatcattctacagaaaaatagagacctagggtagttaaacaatctgctccaaactttataaaattttagcaggaagaagctagatcacttccagacacagtgggtcacactttgtgctagcacttctgaagaccaaagcaggaggaccgcatgaggccaggagtgcaagaccagcttgtgcaacacagtgagacgccatctctggaaaaagttaaaaaaaaaaaataatagccaactgtggtggctaaaaaataacctagattttttttaacatttgaggagtttgggctctacattagacttccttacttgagtttacaacataactttacagaattaaaatactgaaagttgaatcttcagccatcaatatttatatacagagttatatggagtgttctacagagtgttctgaagtggaatcttgaaaaaaaaaagttctaaactaattatttcatgtgatgattacctgttttgttatctacaataagttttagttaaaaatgagatttttggttgggcgcagtagcacatgcctataatcccagcactttggaaggctgaggtgggcagatagcttgagcccaggagttctataccagcctgggcaacatggaaaaacccatctctacaaaaaaaaatacaaaaattagctgagtgtggtcacatatgcctgtagttacagctcctcaggaggctgagttgggaggatcacctgcgctcaggacattgaagctgcagtgagctgttattacgctgcttcacatggtgacagagtgagaccctgcctgaaaaaaatgggccgaggttggggggattattttctttatactttttcatggtccttttgttgattttggaatatggggatgttcaatttttcagaattgttttgactttttactaattttgaagtacttttagaaaccaactacagaattttagtataaaatatagctaagatatggttaagttaatattctataattcaatatttaatatatccatagatatttaagtattattagattataaggttcgtatgtgtctataaggttcattttttttccctcagtagtactgagtcatacaaaggggattttgaaggttttaaatttgattgtttataatatgccacttttaatccttttatgcatttgtaatattatgaagtattcgacttttggtcatttttaccctgcagaccttgtatcctacttatggactcactccgaggcccttctcggtcaaatgttgtcaaaattttaagagagtaagttcacactttatttcgtattctgatggggatgaagaactatgtatatttatatatgtgtgtattcttaatatatatgaattattgcaggtatttagaagtggaatgggaagttaaaaaaggaagcaaaagaagtttttccaaagatgttatgaagggctctaatccaaaagtaccacagcaaaacaacttcagtgactgtggtgtatatgtattgcagtatgtagagagcttttttgaggtgggtttcaatttgttggatctgctataataaataataaaatagtgcatttgactttaccttagtaaaaaacacaataagcaaatattttaaagagtttcaaaattattgtttcaaaaattattccatggagcaaaaacttctaaatggaagaaccttcaaggcataaaaatagtatatttacagttcatcaaatccaaggcttgttgagctcattctatcactgaacaatcaacctgccctctctactagctcttgccaccttaagaaatctctcccatgattcacactgcctcttttagcctcttttctcctcttcatagatacatttcttaagaagtgtttatattcactctctaattctacagattctacttctcaaatctctaaaatctggctttatccttaaccttatgttaaaattgctcttgactttccagcaccctttgacagtgtcaaccatttcttcctcactctcttgctttgacttcagaggtacagtaccacacataacctctcttggatattctttactctgatcttggctcctatcttcatccaccatacagtagatgaccactaggttctgtgaattgtgtcatttaatgtcagatagatttacttgtttatcgtcgagtgtcgctattctgaactgctataccaatctctaacagattcctatgcctcctgccttctggttttcatggttgtttcccaaaaacataaatctaatcctgttactttcctgctttaaatcttatagtggcttcctgtggctgttgatttacagaccaaaatctttcacatgattgataagcacctatgtgatctgaccccctatttaagcttctagcctcattttcccaccattttcactctagctttaatacaacagccagccacctgaatgccattgtttcatgttctttcttgcctctaggccttgattcatatttcctaacctggaatacttttttgttgcttctattataccttgtctgtctaacatgtattcattcttcaggtcttagcctaaacatcacttcctcttggaattgcataaaaccccagatatgtattttcacagtactctatacttctgtcataatacttgccatatttcttgttttaattgttgaattacctgtctttctaaactggagctggcaaacttgttaataaagtagtaaatacattaggctttgcaactgtgcagtctctattgcctcttagttctgctgtggtccagtgaaagcatctgcagaccatatgtaaatgagttagtgtggctgtgttccaataaaactttattacagaaacaggtggtgggcagaatttggtccactggcaaaccctgatctagactataagatctatgatagaaactgtgtcttgtatctccaatacctaacacagtacttggcatgtgatagataatacagaaatacatattgaatgcgttgttgggttttcttatttttaacttcggaatgtttctgtgattgaaatgaaaggttatttattacagttttctaatacgcatttaattgtattttcagaatccaattctcagttttgaactacctatgaatttggcaaactggtttcctccaccaagaatgagaacaaaaagagaagaaatccgaaacataattctgaagctacaggaagatcagagcaaagagaaaagaaagcataaggacacttactcaacagaagcacctttaggcgaaggaacagaacaatatgtcaatagtatctcagattgaccatttctgttacttgtcatttctactttcagaaactaaatgactttcaaatttgggtatagacaataaagaactgaagtgctcactactcagtgatttggaaattttgatgcttgtataaatgtcagataattaatttccaaaggcgtatgtattaagtaaaagtctgtaaatatgttaatgaggccaatttttccagcatttataattatttttttcacttgttaggaagcttttgttatgtattttctgttaatagtacctaaaattgcaacttctaaacccaaataaaaagaaaatatttataggaggaaatgattaatttgatattctttagtgaacttgtttaattcctcagtgggtgtgacatatttcatgggaatattcaaatatctatggtaatattttgaccctttatatttgttctaaaataagtcaaaatgtgaaaataatattaaatctaagatattttgaactaagcatctttatatgcttgtgtaacaggaacaaagtaacagcctttcaattcatatactgccttgtgttcagtgaacccaagaaatgtaataaatatttgtaattttacacaaatatttaagaggaaagagtattaagagcaattcaaaaaaagtaaccttatactactaaaaaaaaaattcttgcatatattatcatcaaatgcatttttgaagacatcaaagactcaggttaaaactattttggtaagtgcagcttgaatttcaaatatcccgtgttacctttctctattacagcttaaagtatgctacaatctgtgtcatatagttaattgataagcatttttaatctgtgtaaacacaggaatttaaataggaatttactatttttttataaagcttttgctattttttcattgctcattttgttcttattattttgataaagtatcagactttttgcttgagttcttcagtgtaaattattttttacatgtaaaagtactgtattcaaccagttgcataatacagcaaaaatctttgaattcccctttaaaataactaaaatttgatggtttccatgacagatttatagcacatatagggatcttgcatgtatctgcagaaacttcattatttttcaaatgaaatggtgtatacttctttcaaatgaactttgagacttgaaacatattttagtcattttttgttaaatattgaatttttaaatacacatatatcaaaaatagttgagaataaaaagaaagcctaatcatcagcaattattttatttttaatttggccatctctgacattgcagtcaatatcttagggtattttcttgaatttaataaagtcccatgggtgggttcagggtgaatgggagtattaacaacaaccaaaaaatatctattgagacacagtagagtctcagtaagagaaatattaaaatgtaagaaaggtcaccattagtgatatcaactgtagtttgttactttgaactatatttctgattaactctttatagtaataacttagagctgttagctcagatatcttaattagctcatatgaaaaacaagtttaattttattatttactgaacatggcaaaatgcttttcaatctataataaaactgggataaaaaattgaagttgttttttttaaaacctaatagcaataagcaaaattggcatacataatttttttaatgaactatattttgtcagaatctgaaggtactgaaaaactattctaaaatgcctacttgtttttgcgttaatttgtaatgcttacattttgcacccttagataatgtttgataagataaaaatataatttatcccttgtaccaactcaagtcaatcagattttaacatgaaaaatatagattaatgtatgtcagctttctagaggtagaatactcagctatttgatggcatttttcccaccccatgtgaaattttatttttggaagttatgctagtgacattgcaatatatattgaaatcttcggaggctgccaggttgagcttcaaaactagacttgagaatctttcgtgtatatgcacattcacttgataattgtgtattctatgtagtttaaagtgggatcaagccttttaaaatgtgttattagtacttagaagttgtaaaacagaacttatagaggtttgttactagacactgaaactgcatgacaagtatctggtgtcttaactaattagatagatctgttgtattggttttcttgttggatagaataacagttaatcatttttagaagagttttagattacttgccataaaatttgtatgtctcagctcttgttggtttaggagcagaagtggtgtttagtcccttcccgttaatgttgctgtgctacttcagacagctgaaaacttaatggtattatttcaagttcacataaccctaaaaaaggttttctttgtgtagtaacttgtgcttaaacttttagtcaattaaatgtaggaggttttatttgaaaacataaaatgattctctaaattacatcttgttttaagccaccaaaatgaatgcagtaatttttctttaaaaaaatgatctctgaaaactgtgagacaatgtaaaaagaataagttttaattcccccaaaatcaaaaattgtacttaaaatctcagacaattcactgaacaggaataataaagaacatattttaatatataatatgaccaagagtttggtggagcaaagcgactggaatataacaatggaagggaataccttggtcagaagaaacaactcttaagactcagtgtagtgctgtttgtctagaagagatacagataacaaggctgctctttagataactgtaaggacaaaaggagagggagattattgttaaggtgaa

SEQ ID NO: 12763 - DNA, 52199 bp, Human
ttctgagctatccatagaggtgatcaagatagaaatgtgtgccatcttctattcattccactgtcatcaactacatgtactcatcaaaccatgccagttctacctccttaataactgtagcttaacacctgaataactgaacaaaaacttacaatttaactctcttaacacttatctacctcaattttatttttataatttatacataatctataattatttttatataattggcacagtgataattccagataaaactcactgaatttctatttccatccttgccaatgatacacacacacaatgtaatgctgagagggttgggaaggaagaatgggagaaaggcagaagttgacagttaaaaaaaaaaagtttccagatggttttcttagtgtcatctctgcaacctcatcaaataagggtccaaaatttatgttacaacatttgtttgatgccttatttaaattgctttactggacattttccatctgttaagctctctgaaagaaacaaaattgccttgtcatagctagacctcatgatcctatacacttacaacgggcagactttgcaggggcccacacctttcaaggtggtttgggaaaatgacacagaaaagttttacatcagctgaaaagaaaaatgcataactcattttggtaatttcagttttaattcttaataggataaaggaaacatgcacattataaatcaatgctctgtgttaacaaataatcaagtaagcagagttgcaagtattggctaaaatgaattttggatatttttagctaccaaatttctcgaggcaaggcagacatacatctggacctgaatatctgcattattagggaatttttgtttgtttgttttatattgttttgttatttttaaaagtaggtgccaaattaggtcacctgctgtctgggcaatgttattttttgccataaccacaaattgaagaaaattgactgctctttttccttagtcaacatgctgtgcttccagccccaaacatctttgagaagttgtttagattcatgagcaatgcctctgtccccaacaggctaagacattaggcaggtccctgcacctctggagtcctcagttccctgcaaagtgaggaagctagactaagtaatcgttaggctcccttccagaccgaccaatctgatggtattagatgcaattgctcctgaattagggcatgaaatgaattcagctttggtgcaccaatgtgatgactctgcttcatcaaagcctgagcacgcgataggcctagcaccatctcacacagagacaaagggcaaccctctgcttccaaaggaatgacacaacctgtttctgaagtgattcacatcatctttacttttgaacaacccaatgctcagaaaacaatctaagaatcttcgctgactttagggatgtaagatacggtttcttgacagtatttgggattgtggaaaaaagcaattgaggaaagggcatctccacaacgcaatattgaatttagtgcccaaggtccatcacaggaatccctaacgatccctacaatctctctctctctcttttttttctctctttaccctgaaaataaactgagaagttagtattgggataactattccccttgacccaaataaaaagtcctgggcaaacacaggtacaaattgccaaatggaaaaagttcttctccatcttcagctagagggaggctggggatcccagctctttagaagccggcccgtggacgcccagagaatcccttcggagaccaggtcagggtcactgagcttgcccagcagggcgccgcctcggacgccgccccgcctctcaccttgccagcgccgcgctcgggccgcgaaggtgcgtgcggcgctcggtgattggcggcggcccggagctgcccggctgccattggctgcccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaaggtaggggggcgctcgtggcgggcggcggctgcttcacctgcgcgggtcgcgcggcgcgcggcggccggaggtgccgaggtgggtggggctcgcgggccccccggtgtgagcccggctctgggtctgcggtgccccgggcccagggacctggccccctgggtagaggaggtgctcggcggccccgccagctccccacactcgggagcgacagaattggaagcgcgagcgagggcgggcgcgggactcttctctccagtctcacggaatcccagtggttgtaggtgttggaaactttacttaagatgtttcagctctgcctgtgcctcctcaaaaggaaaggacgagcttagggcgagtgcgggcgagaccgtgacacttcctggctcaggaagttgaatttcattaagcctttgtggtttggggctctgctgtgctttgacagctctgatctcctcccttccggctgggctgtctggggcgctctaaaatgagtgttgatttaatgcactgccttcgcacccgtgctggtgataacttctaatgtgatttttttttcggtcattcattacttgtctaccgaccgaggcagtgcctccctcttagggaattatctgtcaaagagcgcattctccttgtttggcaggtagtcccaaagggcggttgtcaccagcgtctcagcgcagggagacattttcagcttggctgctgcctcgcaggcactggaaccgacggccctacctgagccactcccgggttatgcggagcctggtgtcgcctgggagaaaagggtggggaccagactatgactcagaaggaatgctgatgtcacattcgagtgaattgccctgtgcgaaagttctcctcgttccaggggatttgctcatgttttactttgtggtaaatttaagctagctgtcccttatcaaatagagaagttttgcagagagaggaagggaaaaatacagaaaacagtttttgtttttctcatactcatggttcctaatattttatcttctaaacacaaagtttttgacttgagcattaattctattttatgcccagaactggatttttgaaaatggatacaaaatattgtgttaggactgcagagttttcggttaggaagctattgaccaataaaaactcgaaatgagaaaacagtttttttcattccttgcgactaaaattctcaggcactcaaaaaggtatccaagaacagaaaaacataaattgttaatggtagcgtgattgcattctattctcttcccatttggtttctttctttttttcttttaaataactgtaatatttttggttaatcttgcttgtcatgggggaaaagcggggaaagcattttgcccgcttagctttctgttgatgaatactactctcatttagttttcaagtaggtaagagctacttaatttagtacttgtctaaaacttggggggtcttgtccttgcttttaagtatttatttgaagacaactttgcaaaagtaaacatattttgggctgccgaggatgaacaggtgaagcacaggatttttagggtaatgacactattctgtatgatactataaaatggctgatacatgtaattatacattaatcaaaatccatagaatgtagaacaccaagagtaaaccctaatgtaaactatgtatgttggggataatgatgtgtcaatgtgtttcatcacttgtaacaaatgtactgcactgatacgggttgttggtagtccgggaggctgctggagacaggaaggcatgggggaggtacatgggaacttcgaattttctgctcaattttgctgtgaagctaaaaaatgctttaaaaataaagtctgtttaatagggggagaaaaatcaaagacatttttgaaactttttgagacaaggagtaattctgagggaagaagttcaaacttaaaaattgtatatgcttgcaaaggaaaaatccagacgttgtttataaacaatttccttagagtttgaaaatgtggattatgataaataatgcccttgacatatggtgtaattttcctcgtttatcccccactttacttttaaaagttatattttcaaccaagaatcttaactttctctaatcctcctcttctccgcctctaccaccccagaaagaattccataaattaaaggttttagagagaatcccatgatataacaaatccctgtttcactacgttgtcttcactgatgattcttagaatcctcaactggtaaattggaagctattaaaaaaccgcagagatgtcccgtatgactccaatttgtgagtcccttaataggcttgatagtctaacaaaaagtttcccagtacaaaatttggaaatctcaggaatgtatttcacaatcttagccatactctcaaaaagaaatttatgttccttttagcaattgttttctaacacgtccaaagaaggaaatattacaagactatctgatttaccagcagagtcctcaccctattttggtacctagttttcaagtctcctttctttttgactcagttattcaagaaaatttatagtttgaatgtaccttgagaaaaggaagattaaaagttggaacaaagatacaaccatttaaatacaactaatatgacttctgttttaagatgtatgacattttttccttctaaaacttttacattgttgatttcatgaggaatttcttccagacagatgaaaagcatcattgttccacattaacatttcatgtaaaaagaattaaggaggactgtctttattaaacagtgattgagatagatgatactattataaaattcttggtttgtaaaaggaaagctcgtccacatcagttgtacaaattgggattaattaccagttaaaacccaccatcacaaagacaaggggtttttataattagattttgctatattttgttttgtttgaagaaagcgagctgttgctaggatgtgggagctagtttggttatacaaagtttttgttttaataatactttagaacagaattgattctatgtccttgccctgtcttctgagttacacatctagacctctttcttattttttaagtctcatcttaattggctttgtgtcagtatggtccatgtctgcttgggaaaaacagtggactttgagaagcagaaacagtctcattttgcggtgaatggtaaatcatggccaacagccagctgttttcctctttcctttctgtgttactctcccatgagaaatattttttttcaattaagaacataccaacagagaaagagaactacaataatttcccttttactgcctggaattgctgcagggctttttcattttaccgtgttcattttttctctcctctaacccctttattttgattaatcctaatattttgcatacttttcttaagactcttatttctttaattttactttttaaaaatatgatgcattttaaagattacatgttactaaaaatcccctttctctgtatccaaacttgttttcaaaacctttgtcattagccaaaaaagcatagtgaaaccaaatgaatactattggaaaaaggactaaactacaaagattatttccattggaaattagaatgagttatttgccttaggtagcccctggttgaagtggaaaaggcaatatatggtgacctggatgctcaaatctacaattgcattccaggcttgaagccattcttgctgcaagaaccattggcaagactaagggtaaaggtagggcaaggcacatccagggctttgctttagaggtgttctgcctctctgaacaagtgcagaagaaaatgagtggtcctcggccaggcttttataaaactattctaacccatggtgtgattcattacattggtagaatatgaaaagtccctttctcttaattgtcctgaatattggttggagaaaaaaactatagtaggttttctattgattctgttcctttatgctgtcctatgaagtagaaataggaatttatattgctactggctattacctatgtcccatcaactcaccctatgactttgcttgtgcatgcccatactccatctacagttctaaattttttccatccttcaaggaccaacccttcacactgcacactcctctaggaaatctttctccatgctgccacctagatgaaaaatattttctccttttctcctgaattcccaaaacatgttattggtaacacttaggacactaatcactctccacctctggattatacttatctgttgtatgtttcaccttcttaccttgcttacaaacttcttgagagatgaatccatatcctgttacacttacgtggttattttgtttgctgttcaaagcaaccttaggaagtaggccttagccccattttcaggatgaagaaactaaaagtttagatagcgtaatctgaaaccttactatagagaactttactatgaacttgaaccataatttgaagaatccatgctgcttccatcatgccaactaggccgagtcttatattcttcatcttgctcactaaatatatgtggaatgataactgttataaaaagagaaataaaataaggtacatttcaacactttcactcattttttaaaggaattatatttgaggaagtggtttatattccaataaaatcaccatcctgctagttttctatattttgtttctactttgtccatgttgtatgtattccctttagtgtaagttgccattgacattctttgggcagaggcaaagtatacgaaaagtaaaagtattgtgaaaaggagtttctgggaaacttctacagtcaaagaaatagcataaactccaataatattctgtaccttatcttctaagattctcccaacttcctgacttttggtgtgagccaatggtaatgctgtctcctaactatgtaaaatggccctaggtaacagtgaccctgtatttggctctttgttttgttaagtttaaccaatggcatctggaactataaagggatgctcgtggtcttttctcgtgttgagctctgcagttgagagaaagccttacacatagcatgagtaggctaaacctcttttcccttgtagcaaagtgttcagagtgcctctggagtggcagaccagacagctaagaatggagcagctaaaaagaaacaaaaaacaaacaaaaaacctcttaatattgggagaactatttttttgttttaatttcccattcttcatgcaaaaacatttcttatgaagctgagaagctgtgggaaacaccaaaatgatcagatatttcatgaggctctcatggagctccagagtgacatccagcattgttagcatgcgatcaacatcatagaccatcagtgtgcaacacgagttaccaagaggggctttcttagtggaaagagagtgataaattggtaacatggaagctacttcctgtgttctttttctgagaactagaagaaggaatacaagttggccccatgctaatgtgtatataccttttttacataccaatcactagtgtgtttagaaattaggaaaggtcagtaagtctccagtatatataaacatctatagtgtatggaaaggtcttccatagtgtatccgttttctcacttccatttatcagtataatatatttaaaattgccctaagctgagagttggtagatccgagtccactattttttgtgatattaaccactttggctatcaatttctatttatataaaaatcagtaggggaaccagatgatttctgaggtttctccaagtcctgtgactctttgatcgtgggaaataatatcagtagtctaccatgtgtaatgttccacagtgctttaaaatcacacaaatgaagaacatatatgtataaatatatacataaaggagatggcatagtttaaatgttagtgaattccatgaagaacctatagattgaaccaaataatttttttccacaaatcttagctattttcaacttgtttgtacttaattttcataatatttgtggaggtatttgaagatattaggttaagtttaattaatttaaatctgtagtataaggctctgaaggctgtaatagtgtgggtcccataagtctaggagtgatgtattacttaccttggtatttaattatgggaaaatgaaaaataatggaacatttattttctttaaaagttatctctctcaaaataaggctgttaaaataattttaaaagattaaaaaaaaactatatgagtgcttttttacgtaccatgcactgttctagactctggggttatagttgtgaacaagaatgacactgaacttaagcttgtatcatagaattatgctattgcaagtgttgatagagcaatgtaaatattgaaagtaagcacaactggaattatacccgtcagtgaactcttgataggttagcagtacgctatgtttctaacacagacagtgagcaattttgatggtgatccctgggcttgattcttggttttgcaaactttgtaattagggattcttatttcatttgtcttaagtaatagcaaatgtaaaagatgggaaaatgagaaagcagcttttatgtattagaatgtgaaaaagattatgaatgcataaagctatacaaatagacttacacctataatatacacaaactataagtcttctccctgcctacaaatgccttacaaaagagtcattcttggatttcctgtttgcagtcatagctaatttttgtttggtaactactgccatggtaaccaaaattatgattttaaaagaattgtttattaaatcattaatatacaggaaattattttactttttacaaggtggtggtatccagagaaattatattattaattatgaaatcaactttttctaggagaggaagataaggaaacaaaagactaatcaaaaacattgcaaaactgcagattttcaggattttaaagaaaaataatttggtaattgataacttcactactgttctttgagtaaatatccatgtttaaaatttgcctcaagcactattagaggattaaatttagaggttatgcttttcaactgcccaactacaatctttgactctcctacaaaagagctgccatttagcatggttttgtcaattttcagttctaagtgccctgtctacctaacattctagttagataatggggaattagagcgataaggatatgcatgactataattttctaagtatcactgtatttattttggtcaaattcaaaaaagtaaaaaagcatagtttagaattgccaatttctctgttccttagtctgttagaatggtggggagtcggctcagatttgagcatggcttaaagtgggagagcgttattagaagccagcctagtggggattgctgagatctcatctgctgaatgacagcaaagttactactctgtaaatatacttaatctgaaatgctgaattatcctcaaaccatgagtgattcagcttgtgtttatcattgtgacattctggccactgtgaaaagctgtaaacaggagtttcagggtgttcattgcatagcttatctgagcagcgagcccagcagaaaagatgggcattcagcccagcagaaatgccttgataaggagtccattaatgcatctctagccacaatgaacttttcccttgctttgtttgatgataaagtgatatcatgtttcattgaaaaatgaccatgtagatgttaggtggatttttgtttttatatgaccacaacgtgacagtcttaacagaatgagtcacaaagtaaggatcaaggatctgatttttcctttatgagatactggcctacaataaaaataactgggggttaaaaaaattaccctttgtttttcgtagagaatattaaaagtgcagtttagatttaaaactacagactctaaactccatatctatcagtatcacctcttgagcaaaataccgatgtcacctttgatagatttttttttaaaaaaggaaggaagatgagtgagcaaaacagatgtgtaagttaactacagtgctggatagaatgacataagtgctataatacaatttcttatctgggatgaggaacctttttataaacaaaaattaatcattggttgatatttttaaaaacacaataaaaatttattacttaaaagacaaatacagggccaattaaaaaaattattaaatgcaagagacacaaaattactttaagtatatagtagttcctaattgcctactgtcagtttctctgcctatctcatcacagactagtgacttacactttgtgaactgccactttgagtagcacagcaataatagaaatacaaacaactgttatgaagtcttagaagcagaagtaactaactttaattgtgtgggttgcgattattttatcaaggaaacacctcctatagaataaagaagctttcattaggcaaagaaagcattccataaagaggaaatagcatgaaccaaaggtacctggctgtgaaaagtcagtaaaaccacccttgacattttcagttttgtctcttctaaaataaagctaaagtagatgagctgcagtaatttgtaatttttccacagtacaggtttgaattaaagaggtatgtcactgagctagtataagaccctagcccacagctgaagagtttctgatctcccttaactgtgatgattatttaatacattgtgtcatctattgagagagaggaggaaatttcacagtagagtctagctcatttaggctggtctggactctgagctgtggactgggaccacaatgttgccaggttttcatccttcttagatcagtgaagccaacagtaaaggtcatgcccaactgcaggagcaccttttaagcctcttcttatgccaaagcagtcacatgtccagttctgaagtcaaggagagaagtccagtctagcaactatgaggctagggcagggatatgatgttgaatactattacgtgggaatgaaggattgggaccattacttcagtctaccacgtgtgctatagagggacagttgaatgtaggggcttgaggatacttttctgaagatctttcatgtatcaagagtattctgagatgatattctgtatggtatcagactacacgtttcaaagcagagtagtttttggtcattctgaaaaactgtagaggaaagttaactttgcagtatcccttacttgatatttagggtttcctttttttaatctggtcactcttctgttagctttgaaacataggcctctccaaattcattccagccgggtcatgtgacttccgtgttaaacgaagacatgtaaaactcatttctttgggaaatggcaagttgcctaaggttttgaaggggaattacaaaatattaccttttatatactgcaacaaatggaaaatatattctgtgaacattccaataatatgtgttagactctatctttggtaatggaatagaaggttatcccaagataattggcagaatttaaaggtaaaaagaggcaagacagatttcagtggcctaactccacagctcttttaagatgtcccaggtaaaccagtagtgatgttattcattgttactttctcatggaccagataaaattaagccagagggtaggatcatcctgtggaccactgttgcccacttttctctaacagttagggaatttaaaggaagcagcgcagactttgacttttccagacatagatttggatcccacctttgatatttactcagtaatttggcaacagttgctccttggtttcagagatctaatctgcaaaacatggatagtacttctttattggattattgtgaaattaaataaagtagtacatgtaaatgtttagaacagtgcctgacatatagcaagtacctggtcagtgttattaatgttctctgatcagttttgtttagttagttagaccttagtaccaataagtaaacattttgagaaccagaactgcattaaagttgggtatcagctttagaaccctgggttcagtttttggccctggcgtttattagctgtgtgaatttgggaaagctacttagccctgtaaaccttagtatcctcatctgaaaatgggtttcaactgtctacctcacagggttgtaaggataatcgagatgaatatcttaaagcacaaagtatggtgcctacacatagacaataaacaaatgtgtggtaatcctcttcaagaaattcaatctagagggaagaaaatcctgcatagatcttcatgctatttaacagacacctgaatatattgtcaagaattttatgatggcatgctctcagtaaattattgccacttggtactttgttggacacaaatatccatttaaagttcgataactgggggatatattaaattactggatttaatatatccttttgctaatttaaaaatttaatatatttaatgtatccttttgctaatttaaaaattattctgatttatatttttataatgaaattaaaatttataaatatttctggaacttgagtacctaccatgtgccaatcgctatgcaaaggattcaaagctgggtatattaggttccctgagaaagcacttgattgaacactgcaacgtattgtggtcccgtatagggaattggtatgtttccctgattggaatcttcctcagagtttctgaggtaaattacagaaatggttactattctttgcagcacctcccattaaaaagtggagtctgttttccttccctttgaatctggactgctttctgacttacttggatcagtagaatgtggtagaagtggtgtgtgaatcctaagcttggacctcaagagaccttgcttgcttctattgctctgttgctgggatttaagtcttcacagcttcccacagtgaaagctgtggaaggagtcttacagaagactgtccccactctgaattactctcatattcctctgtacatctgaaagaatcaagaatcaatgtactgaaactgctctaatttcattggtggcttaagattgagcccactttctgctctagacgaatctgattttgatttttgtgcttgttgttccattaaagtgaaggaaaattaaattaacatgcaactgcaattttatcttagttgtaaataggtggtatatgcatattttgaaaattgtctgatttccttgaatcactagacaaattttaaatgatgtctgtgcaccttctttagtggtatagtctaaatatagagcaaaaagtatggtaatccaaaccacttctctgatacatcaaaagttaaaacatgggtcaaaaattagttaaggctctttgatttatgcagcacaacatatcaataaacagaattcttttttttccagaataagggatggtgtgaaaagggtatgcaataaataaataagcaagcatgaggacctggcagtagggttcttacatctctcccttcctttcctggtttccaagacccctctccttgctataagactttgtttttgttctaaatgcctgtgaatgctaatttggggcaaaagagaaaaacgagaagactgtctttttgcacccccttttctgttttctttgctgtctctgttgggcattactctctaggtttccttggatcctcctgctcctctgggcagcctccttcagtgaagccctcagccaatgccatgagccttttctttcattctccagtctgtgaaaacacatctgtactgccgtctttttctgcatgtgctccagttagatagttaaagaattagtggcaataaatcacttaattgtacagtcaatctactcatcccctcacccatgtattatgatgggttacccctgaagaaataataccatagcctttaggcatcgcaagaatgatcgcagtattcaagtttggggataaagagccttaattaagacctctcaaagcagctctctgtgggatccaccctttagaagcagctgtggagatagtgacacaagaccaaattaggaatggttgccatgatccagattcttttatggaactcctacagatgcgttttggaatcaggtttttaaagtcccttttatagcaaataaataggaggttttgagggctgtttatgagcgcattccattacagtgtctttcagcggagccagagctcagccaatcctaattaagaagcaatttcagctgcagtcattgcttattataataattgtgacatttttatagccctacattgtctttctcaaagtaacggattcaggaggagtccttttctgagtagagtccacagaagaggtattctattggtaagcatttcaaatgacttccttcatacagtagtataaaaataatttgatagcagtccgtttgaaaaatgtttataaggaaccagcttaaactgatcagatggaatatattttcatcagtcgcttacctgaaataagtacaaaccttttttattttttaaaaggggggcctaaatttcgctcctaataatattgtaaggttacatattaagtttcaaatagataagtagtactgtgagggaaggaactgctaactgtaaatactacctaatttgaatcaagtaattttggctcctgatgtcacatggaggtactgaaatttattttcttttacttaattccatctccaggtggatttatataatggaatttaaaagtttatgtaaatcttttccaatttttattctgtgttctttaaggatgactgtggcataatataaacattgcgaaaattttctcccaagtatatttggtattttaataatctggtttgcagctgtcttctgtaacacaagtgtgtgtgtatgtgtgtgtacccaagtgtgtgtaactatatattgagaaagaaaatgagacttagaggctaaaaatcatattctaccctgtcttctgaaagatcatttcctggttcttactgagtgaacaactaacaaattgaagggaataagtattaatgaggaaggaacaaagttctgctttagatgcccattgggtgaagagaatttaaatatttgaaatgggcaaaataaagagaagtggtagataagtaccccatatacccctgttcccctttataatatgtctgtctcgtcacaaatcacttagtctttggatttaaaatcaaaacagaaaagaggatatagtaggcagcatctaagatggttcccaattactcccacctactagtagtcacacccttacatattgccctgccattgaatgcaggctagcctgatcagttgccaaaaaatgaaatgtggcagaagcaatggcatcacttccgagattagggattacagcttctatcttgtggttctcttgctctctctgggatcacttgccctggggagaaccagctaccatgtcctgaggtacccatgtgggcaggcccatgtgagaaatcttagaagtgggtctctccctagtcgatccttgcagcccagctgaccccgattgcaaacttgtaagagaccgtaaacctgcccatctacctaagccacttccaaattcctgacacacacaaactatgacatgataaatcgtattttcaaaccctaagttttggggtagtttgcagcgaatacagaggtgttccattatgaatctagaaattcagtgatttgaaaaatttgaaaagaatgatattttgcttcattgccctgagtactgcataatgtatgtaatcttacatataatatagcagataatttttagtactagtcgtgtctacatgttttgagtaaacacctttcaattttgaaatataatttgttcatttgtatttcttgctcattcttttaattttttttttctcttgctgtaacattgaaagagacctattttgcgtcaggaccctggagatttttgttgactcacacctcattcttctgaggatccccttgtgtgtgaatttatcacctcggggacttccatgttagtgtagctgatgtgcagacattcagcttcctcataataagtcccaggttttgcctaggatggaggaattcctgcctagcaaacaatgagcagtctttaagatcaaaattgattactctagagaagttacagaagaggaatattaccctttacattactatttacctttttagtttcagtttggagggaaaaaaaaacagtgactttgtagtgagtgcatagagtttgagtgagaaatgccaagatgcaaatctcacttctgccacttgctagttgggtagtcttaggcaagttaatttctccaagtctcaatttcctttttatgaaatagggatgataatacttttccaataggttgttggggattaaatgtgatggttatatgtattttagctggcaggtagtaacattttaacaaacggtggttgaggtgtttttactaacacttccaccatcacaaccctcagtgctcattttttaaagtatagttaaaaacacttcaacatatcctgccaaaactaaaatttattattgtttcctagaatgtagcaggatctatttctgctcttcttcaaatatgttactgtatgtattgaggtatagatgttttgagtaatcagctacaacttgattacatctcaaactcaagtagagaaattgtcttgatgacaatacctttgtcattaacttaatactgttactgccttaagaaatgtagggatagattgagtaggaatcatccactttaatttgttaaagtcccagaaaacttgacgtactacctccagaatatattttattacaaaatatttaggcagaaagaacacttgtttccttttcattcctaacataatagtctatgtgattatttactgctgtctgtgaacaaaaaagatttctgaccatttggcttacagtggattttgtgatagagatgcatacagggcttctggctttatacatctaagctgaaaaggtgaggggatgtggaaatgaatcctagaatctgcagtaaatagttttattcctgtttccttatggatgagccatgttgacaactaaagacccttaactgattattctattcttgagctataatatttggtcttcagttaaaaattccattacattctatttttaaaactgatttaggaaatagggcttctttatcagggcgttccattttatgacctatcttgaggcactatttattggttaggagcagtcacagctctgtcccagtttcttcatgtggataaaaatgtgggtagtaatagtatctcagactctcataagattgttatgaggttaaaatgagataatccatgtaaaatacttagaaccctgcatggcagtgtaagtgctcaataaaaatcagctgctgcttttattatcaccaccccttccagtgtctttttgtgtgtgtgtaaaaaggcagtggaagttccttgggataaagatatgttatgataaagattgtttgataattaaaacaattaaataaataaaactttctagcactattgtaaatctcagacactggcaggtactaggagttcaaatatgaacaagaagctcacaatctaatgggggtaaattgatgtgcacacaatcataatatagtaaggaaggacttaataacacaatttgtgccaaggggatagttaaagaaaggtatcacagagttactgacattagaattgagtctgtgggcccagtagagacaacgactttggcagatggagaagaagaggagcagaggttcaagcaaagtgaaaagctccgcttaaaacagagagcggctggaggggagtggtgtgaggaaggcaggtggcgccaggctttaaaggatcttctttgcatgctaagaaaagtgaaattcattgaacttattaaaaccatctagcaaggggagtgttatgattatctttaggtttattaaaataattttgagaatagcaatacaacgtcatacaaaatgatcagttaggagagtgtggtctcaggatgatatgatgtgagtttgaacatgaacactcgagtgcagatgagggagcagactgtgtggtttttagaaaagagacactagaatttggagcatcgtaagcatggctagacaaggacaaggaggcctctgggccccaggttgggtgaccaagtgggtggtgacaactttgtcttcagtcttcttctcatgtatttcagccttgagtaagtgagagatgggaagtttttgtttttattagcaaagaaagagaaatgtagcagatttattaagaatgactaattgtagctcttaatcacactagttctttgtattcttacctaagaaagttggcaaactaataaaatgtgcaactatttttatatttaagtttggttttctgtgtaacctacactttttattttatttatttatttatttatttatttatttatttatttattggagatggagtctcactctgtcacccaggctggagtgcatggcgtgatctcagctcactgcaacctctgtcccctgagttcaagcgattctcctgcctcagcctcccgagtagctgggattacaggcatctatcaccgcgcccggctattttttgtattttttttttttagtagaaacggggtttcaccatcttggccaggctggtcttgaactcttgacctcatgatccacccgcctcagcctcccaaattgctgggattacaggcatgagccaccgtgtctggccaacctacacttttttggtaatgcaaatcttgttagagatttggaaacaggcaatgaactaaaacgttcaaattttaaatcttgtgtcagatcttaataaaaatatattgattgggtgggggacttcacagatcacactggatttctaagagagccatttgctaagaggaattatttagatatgtagttcctttgtccagaatatttatctggatgaacaaaatctaaaatgcttctttaggagtgtaatatgaatatatgtgtgtgtatatatacatgcatatgtgtgtgtatatatgataggtggataaacatgcatgcacacacacactgagaaagcgggagtgggagagagagatgtatatttcatatgatctaccttcattccaatattattaaagaagtcttagtaatgcttgtttagtaaccacataggattctttactccagagggaaatttggttatgaaaacagcatgaatcagatgatctcaccctgaatactgcataatatcttccagacccaaattgtctccagatcaactcagaccatgtttgaaataccagatgttccatagtcttttttttgtttttttttttttgtttttttttaagtatctgacatgcagtacctttttctgggtcagaagggtcacctgaaatgttgccaacctattcgactgctgaaaattatgaatatggatacattgattccattcccatttcttattctaaaataagcaggggataaaagggtgtttggaggcacagatcatgggaatgtaaattcagtttatggagcctgcagttaaagatacttaagacctatttgtctatgattcgtgtttcacagtaaaattatgtagtcacttttatttttttcttaggaccttgatagatagtcccaaagcctgactgtaatttctcccaatatagtcaatccaaaggacctgttttcttggacgctgaagaagaaaaattattctgtcatatccttttattgatgctggccagaatgtgttactaaaattatatgaagtagacagctttgagacttgtgcgcttatgaaaaacatgtgtttttaggcactaagtgttgagtctgcagggaataccgtatcacatttactgttgaaattatgttaaaataattacgtgcaacaggactgagttttatcattcacagcttaagtcttttgtttcctatgcatactttataaaactactccaccagagttacaagtgattctgacttctgagagtcattaatatattagctttttcaaataattattttctatttagtgattaaactttgagcagatgaccatgctgaataataaccaaactaagacacagttaatctgacacatgatttgcaataaaattaaaaggtatcttggagccaatctagtttaatttcctcattatctagatgaagcctaaagaagaaagatcactttcaaaatccctgaacacgccagtgacactctgtgaccagaacacaggtttcctgactctcctccagggatctttctacattttcaaagttccccgttagctctctagtatctataactatatatatatatatatatatatatatatatatataatcatttccttaatatttggtaattctcacaacatagatatgacatacaggtacacctatcttggttatatttgtccaagggtctagatttcactttctaaacagctagttcgccttagctgaggagctaagcctctctgggctcaccttcctccctgccactctctctcgcaccctgggcatcattaaataacaccttccctatttatatccctcaccaagagttctccagcccagacatctgtagacatcttgtaggcagaaactaacctacaagatttggatgtccaagaatagtcatagccttggctcttcaggaaaggagaagaacactaaggagaaggtgtggtctatgctgagggtaaagagaagagatgagaagaattctgggtcctggacttcagggaatcctgaatacaaagtgaataatggagagaaattagagaagcccttagagtagatggggttccaaatccttgaactgaaaccaagaggagttgaggaacctcagttcttgtgacactctgcccaaaataggccctaagaaactgtacttggggcagttctggctgtgaaactccttttaccacagattagagtccatatgcttcccttcatctgatatgcatttgacttatgaaggggagaatagcagatgattagatgcctcagttggaagaaatttgcctcacactggtagaggtatgtctgctactgtgtaattttataatataaattggatttaacaactgcattctaaattataattcaatctgaaactaggcacatcctaaacaaggaaaatgctagagtgtgaatcacgtatcttctttcttggaaaggcattgtttttgtttcctaacagagggttgataaagaggataaaaatatggaaaaagttctcacccaataatgtggcataagtcagagatcttcagtgctggtatcaatgagatttaagttttgtagctatatacttatagctataaaataaatttcttactgaaatgttctcaggaaaacaagtttattgccagtctgaaactctaatttctctagctgctaaaagtgattttgaaaacttggtgtcatttttgtttgtgtttggtgtgtgtgtttgtttttaattaggactgcttccattgggttatagtaggagaaagtgtatcatattgccgtgacccattccactctctttcacttacttgctctctgtctgtgatgtttaaaagttccctcacacttaggtctgagcatgtggggaaaatgaaagtgtttgtgtttggaaaggtagaggggcactttttccaggcagtcacaaatctaactggaaagagtccataaagagattaagttggccttccaggcaggtcccaagggcaaaagaaccctggaacaatactttctgggttttccagagcggcctacagagccaatttctcaagttactgcttttcccaaggcctggtctcctggtccctgtgagggcttcctgagcttctgctagcagagcttgagaggtgctcttgctcctcaccctcccctgttgccctgtggctttcctctttaccagtctctcctgtctctgaggatgtcatcctctgttaagctggtagcctaagacatggcattgaatgcttcaagaggtttagtttcttccttgggaaaatgaaaaggaaaacaaaacaaagtactccgcctgctacaaggccagccctgtcactctgaaagtgctttacaattttttggctcttcctttgccctcttctgccacaggccttgtgtatggtgtttcctctgccctgaatgcacttctctgagccaaattagatactgctcagcctttccattgtaattcatgcacctctccttcagcgaagcttccccagccttccttatttatcttgtcttcctttttaaagctctcagaaagtcatctacacttagagatggtgcaagagtgtttctggaaaagaaagttcttttctttggggcagaaattagctagtgactctttggaagacaagagctcccatttgacacgctagtcctctgccccaaaagaacagtagagcaggagccagatgctgagttttaggtctggtttgctattgagtagctgtgcaaccaggagcaaattatccctcctctctggattctattttcctgatctcttacatgagggagatgcctagtcctgtccagaataagaatatgtgggagactttaaaagagcagcagttcatgaaataccaccagctctagtaattctaataaataaaatgatagctattttaagaatatattgatgaaaagtgtcaaactctgtaaaagtatttgaagatcttattctgagccaaatatgagtgatcaatggcctatgacacagccctgaggagactctgagaacatgtgcccaaggtggtcaggctacaacttggttttatacatattacagacatccgtcaatacatgaaagatgtacattgcttcagtctggaaagacaggaccactggaggtggggggcggtccttccaggtcatgggcagattcacagattttctgattggtgattagttgaaagccttattatctaaagacctgaaatccaaaaaaaggaatgtctgggttatgataagggggcttgtaaggaccaaggttttatcatgtagatgaagcctcctggtagcaggtgtcagagagaatagattgtcaatgtttcttatcagagtctgttctgtcagtcttaggtctctgtgtttctgctaatgctggtcagctgtgaagcagcgcccacccacccccagctccccatttcctatcatggcctgaactagtttttcaggctcactttggaatgaccttggccaagaggtggggtccattcagatgcttcatgggtttataattttatttttgatttacaaagataaaaagttggtaggagaaaacaacttgcccctttgcaaagttgactttgtaagtcagtagcgagctactccaaagccttagtgtaaaaactgctgactcatggaggttctagttacatttgctgaactttcaagttggattcagaaatagtgaatgagatggtattgttccaggatgtttgcagtcttttataagcccagtgttgttcagaccaggcaattccaatctgaaggcatgcaagaatttaagtggccatttaatttagaggcagaagcatatttctagatattatctgtccacaaatatcaggattttatacacacatgtaagtttgtatgtgtatgtgcaagttctttgtcatgaggtaaaatttattccatgttgtgaattatataaaagagagtttaaaagcctctgatttaagctaagctatgtgattaagccttaataatgtaatcaaaattttcatttgggattagagtttatttagcaggagatgcatgaacatagtatgaatcatatccatactccaggcacattcagaactaactcttctgtaatggaaaattagaaagggcctgaaaaagaaaacttttttggatttgcttttcattttactatggatattgtaatggagaaaacatgtaactatgcttattacacaagaccagaaaagtttccctctgtcttttgtttaacctacattatttccatactgtgtgaactgtgatcatcagtgacaaggaaacaatttaattgctttaaaaaaaagcttagtgttgacactaaatatacaatttaaagactttcatttcttttgaaaattggtaatatggacatggcaaagatgataaagcttagctaatgctggacagttgtttattctttagagagtatactttatatggtctaacttaaaagtattgtgggttttcctaagcaactgtgtggaccagttgggtttgaatatggccttaattatggaaaaaggatgtggtcattttctttaggacaaaaggaaaggcttcacttaaacttcaggacatgtcagactgatctttcaaggaaccagttacaatgtggttttgattgcatagtgacaaacacagcttggtaaagttacaaaagagggccattgaaaaatacctattacttgtccagcttgaactgctactctaggcactaaccagtaactaattcctcatggtcactgatgtgatatttaaaacacagagtaatctgattactggtggtttgccactgtactgatgtaaggctggctactcttttttttccaatatcagtcgttgggtaaaagagcttaattacaaccttgtgtccttctgccatctgcaccccactccttccacttattaggccatgtctcagcaagttctcaaagactattgtttaatatggtaaagaagaaaagggtttgctatagcaagggtgataatacagctctccactccttgcctccctacaacttcaggcagaagagcacaggccttggagtcagaaagacttgaactcaaatctctaccatttattaacattttgatcttaagcaagtttcatagtctctgagtttcagcaaaaacatttcaaaaatggcaaatcatattgcctactttgtaagcattttatatagttctgtaagattttaatgagatataagtaaagtacttacctctattccttgtgtcttagtctattcctgctgccataacaaaataccttagactgggtaatttataaataatagaaatttatttgtcaagttctggaggctgggaagttcaaaatcaaggcactggcagactcagtgtctagtgtgggcttgctttctgcttccaagatggcaccttgttgctgcatcttcacatggaggaaggttcagaagagatggaagagaggaactcactccctcaggggctaatcccatcaatgagggtggagccctcattgctaactgcctaatcatttcataaaggcccagcttcttaatattggtacattggggattaagttgcaacatgaattttggaggagcacggacattaaagccatagcactggcattcaataagtgtatattgtagctattataataatatttatcataataaaaataatatttcagttgtaattcctaaaatctttaattccttgtttgatgtaaaatatgttattcaggatgagacttgctttttaaggtatagttttctgagtgttgtacctattgtgctatggggctgtactatggggcaagtagtggccaaagacataaattcatgagtttttgttatttgcaatatttgtagttttctatacagttatattctgatgcttttcttttcatgataaaaagcaatcagaatataaaatatgttatgtatgtacttggaactgccatgtacatacctgggtatcatcattgactaaatataagatttgtttgaaagttatctcaacacaagtggtaagtggaattaaaagtgcaatttattgaatttttagatttgtaaagaatctaataacagattcatgatgttttctttttaacagatgggcttaggtcacgagcaaggatttggagccccttgtttaaaatgcaaagaaaaatgtgaaggattcgaactgcacttctggaggtattgttttgaaaactgcaaccacattagtaatttatactttttgcaatacttcctcagacagtggagatatcttcgagttctccagcatggttgctaagttgcagacctgttactgtcttttctgagaaatgaatacaacataaaaagtgttctgtcttactgtcattaagtttgacttagtgaattggaccataataactatttagagttgttggatttgcttgctgtctttaagatttccttcgagcctgaaatactgaatatatcatctttctggtggtaaataagtttgtggtaatcctccaggactgtttaataatttatttgttactttttttttgagacgaagtctcattctgtcacctagactggagtgcagtggtgtgatctcagctcactgcaacctccgcttcctggttcaagcgattctcttgccttagcctcctgaatagctgagattacaggcttgtgccacgacacctggctaatttttcttttttgtattcttagtagagatggggtttcgccatgttggcaaggctggtctcaaactcctgacctcaagtgatcagcccacctcaacctcccaaagtgctgggattacaggcgtgagccaccatgcctggccctgtttaataatttaattattctcttcttaaaaattggtaactttacatctcatgtctacattttccgtaaacaaatatgaatactgaatcaagcatgtatatgttagttatcaggaaatgaagttgaatttagatctctttaaaatttttagctgtaaagttactagtgaaaaaccattgaaacacttgaatttttttaagaaaaaaattaattgtagtgtcttggtttgaatgaagtgcatatatacacaagacaatgttagtgagtcaaaaatgtgaattttctatagatcttatctttaggttgttttgaaagtactactgcatatcatataaatctaaaatcagtatttgaaacctgtgcttatgaatgactgtcaagtccatagtggtaattcacaagtctgctcaaagttagaattagcaggaaaaaaaaataaagataactatacagttttaggatggcagctaccttgttaggatgactctcatttgagaaacacttctgtactacagatttccacaggaaaccgtttagaatactttcatcagctcttggagatgtgtacagtgtaaattaaaggagaatataaacaaataaaattttagacattaatctcttttaaaaactagtttattgaatcagttttcagaaacaaagataattgtttaaaataggaaagtcagtagaaacctgctagaactgatacagttcttcagttttgatacaattcttcagttttagggagctaaagttttccagaatttttttttacaagacttaagcagctctcccttgtgctgtctcttcaagggacatagaagtggcagtatgtctctcatgttttaaaaaggtaaagtgacttaacacaaaatagttttcatgaattagaacatctctgctcttaatgctcacactattttctattgggcctattagttaactttacagaaggctgcactgccctctcctgggcatagtttttaccttacaatcttataatacataaaatccaaaatccaaaatgctccaaaaccaaaacttcttgagtgtcaacacgatgccacaagtggaaaatttcacatacctgaccgtgtgacaggttgcattcaaaaatgcattcaaacctttgtgtcttgtacaaaattatttaaaatatgtataaaattaccatcagcttatgtacataagctgtatatgaaacagaaattaattttatgtttaaacttgggccctatccccaagatatctcattgtttatgcagatattccaaaatttaaaaaaaatttgaaatctgatacacttctgttttattttacttgtgaaacattttgggtaagagatacttaacctgcattctttttagttctgctatgcagttgccaaaaaccgctcgtgagattttaaagctcattcctaagagatatcatcttttctctaaagcaagttagtcatttttgttatgtctatattaatcattttaatcgatattttcagatgaaaatatatccgacaagagcagatctccatggcatgaaaataaccttttacatttcaatttatcacacagactcatttaatcaactgggtgtagtctgaaaatctaagagccataatagtctaggactttgcatatggcctgtcattcagctggggttgataacagtccaccccattggtatttcttagtagttctgacatcttcctggcatgggtccagtcacatttctctcagaattcttgataattccctgactttttcaccatagctaaaagagctgaagcaggtgcctttgacctccctatgtagcctctttcagtacagtctttgaagtaaaatattctagactagttgtcctgagtgtaacaaagattccaggtctagtctagggccacagaacttatgtgggtgaagtagacatgggatcccatgaccctgcccacttagcctcctcctccagcttcatggtgatccttgacttaggaccctgagggctccatcgggcacatttcaaaaatcagagttaaattattctctacctctttattagtctggcctctcacacaatcacaagaatggtcttttgaacatggatactattacatacttcagatgacttaagaaccctcagtagtttcccactggacttcttttaggcaaatttcttggcctttgacattaaaccctaacatctggcctctgcttgcttttccagcctcttccacttcccttccaagcactctatgatccaagtgcttgatacatactattccctgaaattttgtgccttattgcatggtgttctctgcctggaaaaccctacctcccaccactaggaaacaaaaagtctcagctcaagaaatacctctgagaagtcttccctgcccatgtatgtcttttcaggctgccataacaaaatatcacatacctggtagtttaaacagaaatgtactttcttccagttctagaggctggaaagttcgagatcaggtgccaacatggttgagttctggtgaggtctctcttcctggcttacagacggctgccttctcaccacgtgctcacatggcctttccttggtgtgtgtgggtgtgtgtgtgtgtgtctggagaggaagagatctctctcccttttcttataaggtcacctattccaatggattgtgacgttcaccttgtgacatcttttaactttacttcttaaaagcccctgctccaaatacagtcacattaggagtttgagcttcagcatatgactttgaggaaacacagttcagcccacagcacccccttcccctgcttccacatacccccaagttgttaggaatcattttcctttttatcaccttgtatacttacagaaagccaggagataaatacccagacctcattcttcatcactctgattttctgctggcacctcccattgtcccattgccagtgacaagggatcccacaggtgtagtccttaaggatcagccttctgggaaatagcacagagtactgaggcatggagaatgaatctggagaggtgaatggaagatgccggatcaaggtgtatcaccatagttgcaggagactaaaaattaattattaggaatttagagtgaacttgtaacttaactagtctaacctcattttacagatcaaagacctaaaccaaaggaagttaaaatgacttgtttgagcccatgagttattaataatataatttgtgaatgatttctatgtgtcacacaccagtaagcacttgtaataattttctactgctgcataacaaattactacaaactttgcaagttaaagcaacaactgttaactcaacatccatcattattattattattattattattattatttttgagatggggtttcacccttgttgcccaggctggagtgcaatggtgcgatctcggctcactgcaacctctgcctcctaggttcaagtgattctcctgcctgcctcccgagtatctgggattacaggcgcccgccaccacgcccagctaattttttctatttttagtagagacggggtttcaccatgttggccaggctggtctcaaacccctgacctcagcagatccaccagcctcagcctcccaaagtgctgggattacagacatgagccactgtgcccagccaacatccattatttttcaggttagaagtctgggataggggagctggcttagctgtctatgcttagcacctcaaaaagctgaaatgaaggtgttggccaggctaaaagtactcacctttaagtgcgagggaagaatctgctttcaagctcattcttgttggtagaatctattttctgtggttggagaaccaaggtccctgtttccttgttggctgtcagctgggggctggctactctcagcttctagaaaccagtcacattcattgaggtacaatgccttccatcttcaaagccagcaccactgcttagaatccttcctgcacctcacatgcctccaacttcctcttctgctgcgagccagagaaaattcattgctttttaagggctcacatgattagagtaggcacgcctggaaaatctcccatttgccatataaaagtaacataatcatgaaagtaacaccaggggacagaagtcataggggccatgttaacattctgcttaccacagcactgtatgtacctgattgtacctaatcctcctaatatttattttattatgtatgagaaatcaaagacgtaggaaagttaaataacttactaaagttatggcttatagatggcagagctgaatttgaactcagagttttccaaaacctttctccatggcagagtagatattagaatgcacatttttcactctcagggccagtgaactttgaactgcaccaggctgtcgcctctgaagtgtgattgttgtgacacagacatccttgtggacaaaggtgtacttttactgtgagctctctcctttttcagtgtgcccatgattacaacagtagaggaaaataaaaggttcaggaagcctaataatgacccaataagaaacactatctgctgggaatgctttcaagtaatatatagagataaagagtgtttattgaaatgtatgacacagacccaaggtttccaggagtttatagccagttatttcacattgaaggtataattaatataattgcaaccatgtcatttatcatattaagtaacagaattattgttttgctttacctttgttaaagtctcctaataaaacagttgcattttattaaaaatgcgttacttgattataacatacatctgttcagaatttctgattgatttagagctgggtgaaaactaaaaattccctaccataaatggattaatacttgtgttgaattctgtcacagaggcccacacttaaatccatatatgtatatccctgttacaaaagggcagcttccaacccttttaaattatggtttgtagcaatgccatggccgtgcttttaaatcactgtgaatgctggcagcatgtcaaagcactctagtttctactgcttgccttggaaaaatagtaagttttacaaatagtgatacaaaaaaatttcttttgggagaataaaggatagtttcttgatttttttcagcttgaaaatgtaaatatgtttatttgtctgaggcaatacttttggtagttttgttcttgcattcgctctcccaggctcgctctttctctctctctcactccttccctccccctcgctcctccctttcctccatacatattaatgtttgcatatatatgtgttaatggtgctaaattctttttgtacaaacaactttttatacaaataaccctcctccatccccacaccttagagcttcccaatctgccaatccacctttgcacctttttaaaagaatcatgaaaaagacttttaaactaacttaattctgaatccccttccctttttttccccatagaacttttcttaacatcctatggagaatctggagagagaactgctcaataggacagtttagaaaatttagaggtttgaaaactgtgttaaatatgggaactgatttatatactctcttaaaactatcaactcagtatagcacaaataaataaacaagctgtttaaatctatatatatcatcagaagttacttatggatcatctgatgaaagataatccacacaccgtgcaaacagccccttgcacatgggtattgtgctcacccatactctgtttgtgtttttgttttaggtttgtataaaaccacgtttttaaagttcttcattttcttaagggtagaatctgggttagtttaggctgaaattgaatatgtgataaacgtcccacttattctcaggccgctcttggataacaagatcacagtggcatccttttcttctccaattccacaacaaggtttttcttttaataaatgtattggattgcttccaaatgactttgaaagtttttataggtatttctaaaagtaaaatgttttagtttaaatgtgggagactcaaatataaaacactgtagattagaactctaagaaaaatatttttaaaacctaaaactaggtaagtggtaatagcacagatttccacaatagatagctcctggcacctggtgctgattttatagtatgttttcttgcagagtagtttgtagctggctcttctccttgtagaaatggagctccagtgtaaggcttctggaagggatgtggtcatcccaactgttttaatgatgacagctctagttgaagagccatcccacccttcttgggtcacattcttaccaaggactctgtcaccacaattcaccacattggaggatgcagatgaggcttttaatatagtcatgatttttaaaattataacaaatcaatcataggttttctctacttaggaaactgaaaattatatggcatagtatgacttcttaggtatttcttttttcttaccactagcgttattggtatgttgttttaacctgattttactcacttattaacaaaggtatgttgggtggttaaaggcattgatagaaaagcagaggcttcctgagattgtgaattcttctaattgtcaagacaaataataatttaaaaaaatacagagctggttcttctataattagtaaatttaactctttatatttaacactttcacagtaaatataacttttttaaccaagccacagctcaccatagtttattcatgcttcagaaatcatcaggctttatttcacttgtatcttttattatttatctttcagattctaaaatctgacccttattttgtggtattcatgttgtactggtgtagaacatagattgtaaaaatttccaaagtccagtgtttattatacggcctcgatcctttaagataccactttgctaattattgggatgcatgctgtagctcacagccatataaggatctatttagctatattaagaactaaattcccactccaccttcttcccccctcaggaaggtataattttaaacttgaaccaaaagcagtgtgatagttttataaataattacattgtttttgttaaccaaagagtaaaagtaaagaacatgctgtagtaggataacttgctgctttccactagatgggagtatgagataaccagatgttagaaagattattttatagctgaactagcatatgcaaattcttcaacaaattcttaccaaataaagatttctgactagtgtgcacaaggaaagcaatttgcctcttcaccacctatctctctctctctctctctctctctctctctgtctctgtctcggaatatacaagtcaaatctaatattttcagtttgcatactgaaaagtattttaagaaaattcagaatacaacaaactaaaatctataattaataatgtattatttggcaatgagatacatttgggtttttagttgttttttctgtttctgatgtagataaattccatgatttatattaattttaaatttagaaaacttagtaaattcttcttaatgctaattaatacattgcatttctctgtggtcatagcatctgtgaatagcaacagtttagtttttttctttctgatgaattcttgtaacttttcacactgctctgattagtaccttcagaaccatatgattagaattggtgatagcaaggttgctttcttgcttcacatcttaaaactaatgcagtaagtatgatctatgctgagtgtctgggtttgttccccccatgcctcatcctctaggaactctttctagaatagtttctatttccttttactagtttctgctattctctttattttccttccttttacttcaggcttattatgcctttttcctaacttcctgagttgaacacttagtactttattttttccttttttctaatttgagtgttttaaactataaattatttagttatctagttacttcaacatgcattcttagcctaattgtatctaatgttaatccatgtttatatagactgaacaatgtaagtatctttagaatgtgttttacaacactcagatcgccactcttattgttatgttgtcgttgccatgtatattgcttccagcttaaatttttaacaccactccctactcctctgtttttctctgtcaccttttccagcttcttttcctctactagactctttcttgagtccttactttttccctctacatttttgccaacaggcacagatgatctctttaactcatattcattatatattgttccctgaccaccaaatttatatttcctaccaggctacagtttttaacatgagagttatagatcctacactctgtgatatctttaccttgtctcacaggcatatcaaatttatcagtggtttcattttggagacttccatcaaccttccccactccatactgcaaaactgttcatcttttgaatatactatcttaataaattatattcattctactaatttactcatcccagaaacttggttttatttttcaagagactgagtgtattagtctgctctcagttagtcaagacatacccaagactgggtaatttataaaggaaagagctttaattgactcacagttcagcatggctgggaagtcctcaggaaacttacaattgtggcaaaagaggaagcaaacacatccttcttcacatggtggcagcaagaagtgcctagcaaaagggagaaaagccccttataaaaccattagctctcatgagaactcactcaccatcacgagaacagcatgagggtaacaggccccatgattcagttacctcccaccatgtccctcccacaacacgtggggattatgggaaatacaattcaagatgagatttgggtggggacacagccaaaccatatcattctgccccagcccctcccaaatctcatgtcctcacatttcaaaacacaattatgcccttccaacagtcccccaaagtcttaactcactccagcattaactcaaaagtccaagtccaaagtctcatctgagaccaggcaagtcccttctgcctgtgagccagtaaaattaaaagcaagttagttacttcctagatacaatgagggtacaggcattgggtaaatacagccattccaaatgggagaaattggccaaaagaaaggggctacaggccctatgggagatcaaaatccaatagggcagtcattaaacgttaaaattccaaaatgtcctttgacttcatgtctcacatccagggtgtgctaatgcaaaaaaggtgggttcccatggccttgggcaactccgcccctgtggctttgcaaggtacagtcccactcccagctgctttcattggctggcattgagtgcctgcagctgtccttggatctcccattctggggtctggaggatggtggccctcttctcacagctccactaggcagtgcccttgtggggactctgtgtgggggctccaaccccacatttcccttccacactaccctagcagtggttctccatgagggctctgcccctgcaataaacttctgcttggacattcaggcattttcatacatcctctgaaatctaggcagaggttcccaaacatcagttgttgtcttctgcatacctgcaggaccaacaccgtatggaagctgccaaggcttggggcttgcaccctctgaagcaatgggccaagctataccttggccccttttagccaccactggagctgaagaagctgggatgcagggcagcatgtcccaaggctgcacagagcaagggatccctgggcgtggtccacgacagcatttttccctcctaggcctccaggcctgtgatgggaggggctgctgtgaagctctctgacatgccctggagacattttctccattgtcttggtgattaacatccgggcaccttgttacttatgcaaatttctgcagcgggcttgaatccctccccagaaaataactttttcttttgtatcgcattgtcaggctgcaaatttttcaaacttttatcctccgtcacctcttgaatgctttgctgcttaaaaatttcttccaccagacaacctaaatcatctctctcaagttcaaagttttgcccctgcctacagattctagggcaggggcaaaatgccaccagtctctttgaatagccagagtggcctttacatcagctcccaacaagttcctcatctctatctgagaccacctcagcctggacttcattgtccatatcactatcagcattttggtaaaactcattcaacaagtctctaggaagttcgaaactttcccacatcttcctgtcttctgagccctccaagtctctaggaatttccaaactttctcacatcaacctgtcttcttagccctccagactgttctaacctctagctattacccagttccaaaatcacttccacattttcaggtatccttatggcagcaccacaccctttaaagtaccagtttactgtatttattagtctattctcatggtgctaataaagacatacctgagactgagtaatttatttataaaggaaagagatttaattgacttacagttcagcatggctgaggaggcctcaggaaacttacaaacatggtggaacgcaaagcaaacatgttctttacattgtggcagcaaggagaagtgccgagcaaaaggggaaaaagtcccttataaaaccatcagctctcaagagaactcaatcactatcatgagaatagcatgagggtaacagccctcatgattcaattacctcctaccacatctctcccacaacacatggggattatgggaactacgattcaagatgaaatttgggtggggtcacagccaaaccatatcactgagccttccctttgccatcactatgtccaaataaaccactaagtttagtcagttttttgttcaaggagacctcaaatttcttcctttcttttcatctccactgttgaatactctaatccaagccatagcatattttacctggaccacaacaataaccctccaagatgtaaattccatttgtgaagtagtggcagcatcctgttatttagaaccatgccattgcaaactggatgcataattaacatgttagcttgtctccctattgccagttatgtttcacccctaatccatttaccacatggcagatattgtgatatttaaaattacagatctgatcattttattccattaccaaaaagcctttgctgcttcctgattgctcttatgatgaagcccaaattccttaatgtgttctatgagcccctgcatgacttcatgcctacctctccagtcttatcaccctcctattgactcatcttcctacagtcataccaacctcccctggttatgacacctaaggggacaatttctttcctaattcaggaccactgaaggtattcctctttatacccaatactagagacttttctttccttttctcctccccagatacacacccacatacacagtttacacctatgtttcatacatcgtccagatctcaacctaaatatcatcttcttatggggtcccttcttcacgagtttgaagtccaaattacaccctctcaagggaccctatactttctttcctatcacaaatgaaattttctctgtgtatgtgtgtgtgtgtgattatttaatgtctatctcccaccagagagtaagttctagaaatcagagactaggccccttttttttttttttttttttaagcactatgtcctagtgtcaagtacattgcttggcacatgggcactcgtgtatgttgcatgaatgaatgaatgtctgtgtgccagaccagagtgaagaagagaacattgtccttgaactataagaaacaccatgatggcagagagcacatggtaggtggcaataagtgtttgaagaaataaaataagggaaggaaagagaaaggaaaaacaaagggaaggaaatggagggcaaaagaaattgagaaaaaaatgagaaaggctgtaaacctaaatctaggattatagtctttgatgggaaaagtttccctgtctctcactaaaaaaacaaacaaacaagaaaccttggataatagctataaaatgttaacatgcaataaagtacaaagcctcttgcttaaataaggaaacatataatttttgtggttttatttaattcatttctttttattatttattttattcactattgggtgacagcataaggaatatcagatggggttacactcagacatgtccctttaagtgtgcactttttaatcagtctttttttttaatggtacaattgaagatgtctattattggggccatcaccacttctttcagtgaattcattgaaaaaatcttggttggttttgataaaaatcaaatgaataattgcttctcgttatcatatcagaaatgcagatgcacgtttggttgacaaaacacactgaatttgttaaaatacttacttagaaaattcagttgaaacgttatggtaccatctaaatcacaaaacttaattcagtaatttccaaaaatacattattagtgactgataattctgctgctttcctctttttttcaccttccattttaggttcagaatgtacctgtgcagtgcaggtgttttacatgggtaaattgcatgttactgaggcttgggttataaatgatcccatcacccaggtagtgaccatagtacctgagagttagcttttcaaacgtttctccctctcaccctccccactctaatattccctagtgtctgttagttccatctttgtgtccatgtgtactcaatatttagctcccacttataagtgagaatatgtggtatttggttttcctttcctgtattaattcacttaagataatgacttccagctgcattcattttgcttcaaaggacatgatttcattctttttttatggctgcatagtattctatggtgaatatgttccacattttctttatccagtctaccattgatgggcgtctaggttgattccaccatgtcttttctattgtgaatactactgtgataaacatacgggtgcattgtccttttggtggaacaatgcattttcctttgggattgctgggttgaatgatagttctaagttctttgagaaatctccaaactgctttccacagtggctgaactaatttacattctcaccaacagtgtataagcattcccttttctccgcaacatctgttattttttgactttttagtaatagctattccgactgatggaagatggcatctcatcatcgttttgatttgcattccttaatgattagtgatattgagcatgttttcatatattttttggccatatgtatatcttcttttgagaaatatctgttcatgtcctttgcccattttttaatggggttgtcttttgcttgttgaattgttccttatagattctgaatattagacctttgtcagttgcaggatttgcaaatattttcttccattctataggttgtctgtttgtcctgttgccagtttcttttgctttgtagaagctcttcagtttaattgggtccctctttcaatttttacaacctagcttttaaaagccttatcaagcaaagtcgtgttttgtttccttcttgcttaaatatatggatacttattctccctcctaaaaaaggacttgcctttgcataccatgatatagaataggcctaaaagtattttatgaactataaatgtatgaacataaatatcaattaggtacaattaatcattttctacttattttcaaaattatagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggtaaatgatatggaacagagagtttctttattgaagttcctggagtatttatttggggcagtttctttgatgacctaatcaacttcacacatcccagatctgttattcttccggggttctcattactttgacttctgattcctgttctagtcttttgaatgtaagactagatacttcataaaatttttccaactccctagatatgtttacctttttgagggaatggtctaacgttcttaataattagatggaaatcagatgttttatatcaatctagtaactcttctagcttagtcttgagaggatttatcttaagatggtaaagaagagaatttttgtcatagtttagaactgaaaaaaatattcaacattatctttgtgtttttttcatttcctttattaatactatataagaccaaaaagatcacagttttatatcaagctccttccactattataacaaccaaatgaaacatttggaagtcttttaaggttagttaaatcattaaagtgaattttgcgatatcattttttatgtaataaaaatgttcctggtcctacagaccattccaaacatgtctgcctaaaagtttatgttttctttcaattgtacatttgtttatttagcttaagtaaacagtagtaactcagatcttacaaactgaaaaaatatataatttcatggagagaaagtgttactttttacccaactaaatctatttagtgtaccgtttttgagttttaacttcttaatatactgtgagggtgagttgctgctattggatagaacccacttctttcttaagtaacttgcttctgatgtgtgttatgaaacatcacactgcctaatggccaatcccagttaacattggcctccttgtggttcaggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatatgtaagtagagtggtcacactgttagcctgatttgtatactttacagaatttttttcccttactttgaacttttttggggactattcctctgagtttccaaaagggaataagtatggggaataaataggatttagattcagtttagacttcccacagagggtcatcgtgtttgaaacttctgtctaaagccaaattttctatgtatttattatcaaggataattgtggatagtgagttttatgtacagacagtagttggtattggcatgctgatcaaagacagcattattattctatagtctgtttctaatcataatgttggtattaattgcttatctctgctgcccataaataggaatatatgcttaggttaattcagttttgcttgtgagaacgtgcctaaaattcaaacttaaatttaatttttgtggatatatagtgaagcttttttttaagtctcttctaaagggagaaattgaagtattttgctaatgacttgatggtaggaggcaattatgacacagatgaacagacataagaactaaacctgctgtaatatattcctcatagctccagttagcacaccaaccaataaggcttagtcctgaaaaaagagcactaataagccctgaggtgatagttttagagaatctacttaaaattgacctgaaaattactattttcctttttccataagtgaccttaattcaggaaataatgcctgttacacacagggtgaatgaagtagatttgaatagccgggagaaagctgagattccatttcacagaattattaatacgttattatctacatcgacaaatttgtaatttcagtagaaattatgtctcttcaaagttgtttctctgaatttctactgaagtcaatgataagaaatggcagtcttagctgggcacagtggctcacgcctgtaatcccagcactttgggaggctgaggcgggtgaatcacgaggtcaggagattgagaccatcctggctaacacggtgaaaccccgtctctactaaaaatacaaaaaaattagccgggcgtggtggcaggcgcctgtagtcccagctactcgggaggctgaggcaggagaacggcgtgaacccaggaggcggagcttgcaatgagccgagatagcaccactggactccagcctgggcgacagagtgagactcagtctcaaaaaaaaaaaaagaaagaaagaaaagaaatggcagtcttctaatgactaggttgttctggatggcttccctttcagtcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgaggtatgttctatgggaccaccggcatgctggtgccctcttagaccctcatatggtccctttacctagaaggcaacaagacttgaccaaacagcagttgctctgtttacatccaaagaagttttaaaaaataaacttctgatatcattcattctgtctgtgttaattgggttgacaaatgaaagactagaaatataaaagattgatttagactaaactaagtgatagcataagttcaagctttaggttatcattttcaaactttagaccctgagaaagtatgttgttacagatataaatctcttattatataaaaatccatctttatttttatcttcttcctagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgagaagtgttctaaggatatggttgcctcagcctgctttaggacttgagtttatgcttttcttaaagcctcttacaaatgggaaacagaaagcagtcctcctaagtagaaagcaaattattcctaccacagggtgttaaaatcaaggcaattcaaaaacaatacatgcattgactatgagccacctcaagatttctacttgtgaaatttacaatatcaattataggtactgcttaataataaaatcctcacttaaaaaaattcttaatgggaatgagattgttttattttcatggttagcaatcagattccatttcaataaaggtgtctaggggctattgatattctttagctctatttgaatatgatgctttctgtttgtgttattggaccacccactggaattttgtttttgctacctggagattgtaagatacctatttcttaaaccctcattgaattgatttagcataacaaaacttggcctgcgtatttagatttttgtgtgggccaaacattccaatgtgaaagtatattttttcttgcatttactctgcttacacagagctgctgttgtataatggccaagtgatggtaatgtagataaagggtaaaaagttgaccatagatggtaaagtgtataatccaggagtatccaaatagacatttacttctttatatgcagcaaaacacatatgtgttaatggtcccctgagctatcaagtaaaagggactcctggctaaggaatgaaattacatatggtttatatagttatatatagttataagagtgtggtactgtgaagataaggtaacaagtttttatgtcaatgccaattttcagcgttcacccattgccccagatacagttattcattctctatcaactgtgcctcaccaatatatttcacattcttataattacaaccattctactttagacctttttttttgttgttattttgactattgcagtggcctcaaatttcgttcctccactttcattcatcttgctcaaaagctacccaccataatgatggaaaattatcttcctaaaatgcaaattattaaacttttgatagatctggccccttcttgcctctcctgtcccttctactagttatccaacgcaaatcatacatttccacacgttcaccatcattttctagtttacacactgttgtcttttgcttactcctaatagtttttctaatacaccgtacttttccctgttttacctgactgtacctacacatttattcctttagattcagtttaggtttaactttttttcggaacacctttcctgattcactatgcccaaactccaccatttcctccagactctccatgttcccaatggtgtgtgtgtgggtgggtgtgtgggggtgtgtgtgtgtgtgaatatcattcatctgtctccttcactagactgtaagcagctggagggtagagcttgccttatatcttgctttctatatcttcagtgtcagcacttagaaaatgtttgagtgactgactcgtgttcttaatatttctcgctttggggttaccatggtcattcctttacctagggaacaagacgtcaaatcaccatgtaacctgatacattatttagctaaaaactgcttcaatgaatattgttgcaacagtttttctacagactaaaggtattataatgtatacctttttttttgctgctgtctgacctttagtctcaaggactagaatgtaactccatcagggcagggatttttttatctgccttttctattctgttcccaacactaggacaacataggtgctcaataaaaatttattgaaacagatgaaactgcttttttttctttttttagctgttacaagcttctctgtattacattgtttctaatcaatggcagggtataaccacagatatgatttgtttaaataaaagaattttcaaattatttagttttatagcatagcatcattttggccaggcatggtggctcacgcctgtaatcccagcactttgggaggccaaggtgggcgaatcatgaggtcaggagttcgagaccagcctggccaacatggtgaaaccccgtctctattaaaaatacaaaaaaattagctgggcgtggtggcaggtgcctgtaattccagctacttgggaggctgaggcaggagaattgcttgaacctgggaggtggaggttgcaatgagccgagatcctgccactgcaccccaagcccaggtgattgatagtgcgacactccgtctcaaaaaaaatatatatatatgtgtgtgtgtgtgtgtgtgtgtgtgtgtgtgtgtgtgtagcatcatttcttttatgtttactttctcagtgggatataccattggcctttgcctaatattaaaatgagcatacatatccattgccagaacagattccagctaacagcaaagagagctacccacacagcatgctacattatataaaatttggagaaggttatctagttcagggcattgatctgcttagatcttttcatcttaaagagagaaaatacaaattatttttagacctgaaatcaagtgctcaactccaaacaacatttctgagaaaaaaaaaaaaaagtacctggaaggaaaaaacatggcagatgcacctactttgtctctgtgtagtcactagaactccatagttacccccagaattcacatccgtcagattcataggacactcctgcagagagctcattacaacaggtgtcattagctcttttacatcctgtgtacaaataagaagagggattgaaggaaataagaattctttgaaatattaaaggtttaggaacatgggaagatcaaatggcaggcaggaagtggtgaagcacatcatctccctgaagggttctgcagtccccaggcccttggcgcagcctgggccaattttagatttttgaggaattagggaacagtagattcgacctgtgattacatgtcagattttgaatgaatggtaatcaaattattagtaaaatgaaattttatgaaaccccagactttaattctctataccatttatgtgtactaattatctttttgcttaattttcttaatttcatgtgtaattgaacattagttatctcttttttgtaaattgcaactgaaaatgtgtgttttgggtaattttaaaaaatcacaggtctgagaaaaagaagatagatcatggtctgaaagcaagggaataaaacacacggtgtattttacaagaacacattcaaaatacataaacaagaaatattgaaagactgttcttatcacaaggaaatcataaatgtttaaggagagggatatcctaattaccctgatttgatcactacactatgtatacatgtattgaaacatcacatagtacacccataaatatgtacaattatgtgttgatcataaattttaaaatggaaagattaatatgaaatgcagaaaataagacattctaaatgcataataaagctataaaaatatatacaaaaagcagttgcttgcatggtgcagctgcacattagaaatgtgcttgtaattgaaacgttcatttttatagtattcaggaatagtgtgttgatcaaagaattttcattgtatctcagggaagactgggttgacctaacttatagattacagagctataatctctgtaatcagaagcaatgtaacaaaaatatgcaggtctgaaatggacatatataaccaggcctcacttcactgcctaaaccaattacccagtgagtagcagccacattttgaagtcttttcaagtaaggaggctcaagctgaatgacctccactcacctgttcccaccccttatccctcagtaattcctgacaatcacattacgagaccaagggtgcttaagattagtcactgtgataccagacagtcttgctggcttcttcacttgttatgaaatatttaaaacaaaaactttaagacagccatattcattcagaacatgtataaactataaggcatggactatccagtgtttcagaggtccgaactggttttctgttttctgctataacataggttatttattcattttcctcatgtgcatgtttgaataagaagaaaattttgtggtgtaaatgtatgtatgtttgtgtatgtatatacatgtttgtatgtcatgtatatatacataacacatactgaatggtacagggattgtaagtattaatgttctacaatattagattacacataaattatgactgatcttatgacagaatagaagccaattaactacaagttatatttttagtgcaaattcatttttctcaaacactgtcagtatttttaattgagtccttaattactttgaacatgattttaatttactactgtctagaaattagtggtgttaataatctcatgtgtcataggtaagacaggtaaaattaccacttcaaagctttaatgaacaaggaaaaatcataaacttctgtgtaattacaaatgtgcaatctaataaaatacatcagaactaagcacactgctttggaacttcccatcaagactttctgccttgaatgccatgaagttatcttacatgcatcaaatcacctgtttggccttcactcgttatttctcaggctgctcagaatattgacctccattaacagttggccaaaaaggttagctagaaggccaccctccattgtgtatttctgaggttgtcattatgagttttaatttatcatctaaagaaatatgtcctaagatgaaaatgttaccattacagcttgatctctcaccctcttctcttgtattatttcttaataggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaataatcattgtatctttttattcatatccttttttgagtgaaaaatgcttctgcaactaagcatgtgttacagcagggggcgatgtctccaaggataaaaattacccaaacgaaaataaaagtctgcctctgacaggacagcacagaatctagatgtttcattatggagaaaagataaggtttatgaaactttcaaatcaggacttttaagtttggtcatgcaagagtttttttctttttcaaagaaagggaaagtaattttaattaaaatttgggagagcttattttctattcagttggatctaacaagccttttatacttgggtttcaactctggtttctttatatgtaaaaaatattaaaagaagaattttttcatggaaacttatcgtgagacagaaagcaaatggggaatagtggtagactcatgcttcctaatgttagcaggccataatactttctccctcagtctacaattatttctgtcatagtgggagttgcagttttctctgatacatacccagaataacttgacttttttttttttccagctcctgtttggccaatagtacttctctttacattccacctctccactccccaccaccacacacacatgcacatgtgcataccaagcatacaaatttactccttctgcactatgccttcaaccatgcaaaagtaacttttggagcttggatacgtgtcaccttatctaaagtaatctaattctgcatataattttagaagctaatatcacaagtatcattactgtctataaagatcgctttatggttgctcatatctttatcttaaatggcaacaaatatattttccacagcatattgtccacaaagttgtacaacttaacttttcccagacatggctaagtgagaataaactgaaacagaacccatctgctactaacacggccaatcccttaggaaatctgggttgctcttgagacatactagccttcatatttgttgcatggtacctacatatctccctttcctccttcctttttttttttttttttttttttgaggtggggggggcggcaaatgagttagggattattctttcttttcattgactagctgaaacttctattactgaagtcttcaagcatagatttccaaatttgactttgaagtatttcagcccaatttcaccaaaggcaagggattcatcactgattcattctcaaggaatttccaacacatagcgtttaagcttatacaacttcaccgtagttaccaaagagacaccaacacccaagatcagtattcagcctttgtcttgagatgccttggcatatctgaacttgtcttctgggtattcacttaattctttggaaaacttgggtttccgtcaatgtctctataaaaaggcactttgccacaatttctcactcatctgccccttcttgacctctgctgatttaaatgcttgccgacaactttgatgactgtaatgaatgcccacatgtatgcaaaggacccactgtgctggtttatgtgtatgtgctttgaccacacaaaacacattctggctcgattaatagattaataggatcttttttcatatatttagttgatgcttaaatagctttggctaattattttgttctttcacagagaacttgtcattgtagcttttatttgatctgataatacaacttgaagcactcaaaataagatgccattaactttttatacttgttttgaatggcatcttatgatgacatttacgaaggctgctatcaattttttttcagtgatactcctcaccagggtatcttgcccctcagccaataataaaaccaacttgtatcctgttatctttacgagagtcagacattagtgaatacagagactaatattacagttgatttctccataaatattgatggactgtgaagacatcatggtatatagttccagggagagctggatttaggaatctagacaagacactttttgccacatcccattga

SEQ ID NO: 12764 - DNA, 74550 bp, Human; identical to SEQ ID NO: 12310
